United States Patent 7,868,149 (PLANT GENOME SEQUENCE AND USES THEREOF) - sequence listing, part 57

SEQ ID NO: 30874 - DNA, 29617 bp, Oryza sativa
catcactgaattgagggtttgcatattgatttgctagaattagggtattttgtgagggataagggaccgagtgcataaatttaataccaacaaaaggtgtaaccaaaactggcaagacattgatcaagccagtaaaactgaaatttcagttaaacaggtgggtttctgccatcttagaataagggggtcaatgtggaagggaaggccagaagctcaatgtgcctggtcgtacagatgcacactctatagccttggcatgcgtcttggacaattttaagcaatgtatgctttatcatctcaaagttgatgatttctagtaatgctgattgggtgaaggagttacatgggtggagagagctcctggaggtctgcgaggttgagaaagaacatgagcatgggacttgtcatggttgtggttgggacgggaccaaacaggtttttgtggctggcccagccaagcattagtcaacatgcatgcccagcccttgaaattaaactgtagatgagaacttgttaattgtgaatttgaagaatgtgagccagtgatgcacttagctgtagatcattgtgctggagatttggtttccagcgcattccatttacaactaccaaatggctgaatcttcgatgtttgtttgaaatttaaattcaaggatatcgttgttttgacggctcaaacttcaaagtaaacgtttgctgctcattggatgctggttataagtgactagctggatcttccaaaattatcttacaacggtaaacttggatcgtgtagttaagaaatctgatgttcgttatattgcttattgtaactgggatttgcgtattgggttaattaagcgaagctatagtgtgtttaattgtgtgggacacttggagaagaacaaaaagcttctgtttctgttcctcttgattggtacaaggattgttcttgtattggaattgaactaagaaattatctgtgattgctttcttgtagttgtgatctgaatctttcctttgctaatgcaatttttgtgcactcaatatgtggtcaataaatcttatttctagtgtattcagagaataaaacaaaggacttatgtatctgctctttctgatgatagataattcttttatcagtattgcattttagattttaggttgagacattgcccggaacttttcttttgcctatttctgagctcttatgacctctttggcattgtaattgtcatgtgatcctcctaatgatgttttttttttccttttgctacaatggattgtcttcatgtattcgacgtgcatgcaataggcaagaacacatatcatcatgttacttgcgattttgcctttctgccacatttcttaaatcttgactttaaagtttgacagaggagagctaattttaacaagatttcaccttgtccttgcagatgtattatgttaaccaggaacttactgttgaggatttcctttatgatgataattacaagatgtatcttcctggatacaattcagatgttctcaataatctggaaagtactggtcagctggaatatccacagttcaatttgccacaagagttaccccctaatgcatatcttgatacgagtaactgtggacaaaatgctggagatgttttcctccacatgtcagacttgctcaatacaatgtctccagtacctgctgcattcctgaggcccaaatgcgctctcttggactgccctcggcctgctcaaggatcagaaaggtggcaagattattgcagcatgtatcatgctgatttggccgtgaaggaagagggtccaccaggcacaatgcctgtgatccgtccaagaggtatcgatttaaaagatggccctctgtttgctgccctcagtgcaaaaatccaaggaaagcatgttggtattcctgtctgtgaaggggctgcaactgcgaagtccccatggaatgcacctggtaagttattgctacataactcctcccattgtattggcatggacaagtgtttgaattaatcgctggttcatttctatcattgcagaactttttgatctgtacatttttgagggtgaatctattagagagtggctgttctttgacaagccaagacgagcatttgagagtggaaatcgaaagcaaaggtcattgccagattacaatggccgtggttggcatgaatcaaggaagcaagtgatgaaagactttgggggtctgaagaggtcctattacatggatccacaaccatctaacagctatgaatggcacctctatgagtatgagatcaatgattgtgatgcttttgccctatacaggcttgaattcaagtcctctgatgcaaagaaaactgctaaatcaaaattagcttgtaacccactgaatgaaatccagcagcaaatggttaggctgagtgcagatagccctgtcgaaaacaaacggtctgcccgcagcaggacaaaggctaacccaaatgatatcaatagcaacatctacttagttcagaacactacagttcaaggcagtattccaaatgcttatcaggcagtgtcacaaccggaccagatgacgtatttgaatggcaatgttgtttatgggcctcatctcccatacggttactcaactgaaagaagtgacttctattggagctcaaatgatggagcttgaagaagggtaaccatattttatcaacggcatatttggccttcaagttctaacagctccagctatacttatggggtctaatcttattggcatggcccccatcattctaattgtcatgggttgcatcaacatggaacctcttcgaaaatgcctgcgctgcagtcgtatttgtgcacaataacttcgacaatgtaatatagcctagtgtcttgacatagcatctcccttggtgcagagcatatgtaacataaattgccaggtttgctagacttgtaaccttttatgtgggtctatcagctatttgatggacccgtttatttgtgacgctgtatatgcatgaggctgttctgaatctgggagcaatgttggtggcctttgaaggcactaacctgttgataaaattgtgttctctatgattgaaccccaattacatgcttgagatgaaagcatcttgtagcaatattcagctggttcgttatctgttctgctatgctgtcgatggctaccaccatttttgctacagcaacgagactactggtacaacataagttgatagaacagcagatgcctaaactgatgaaagttgtcgattgaagtggcatggagccatcaatggttcgttctttgatgtctggtctggtcccaactgtctatctctgaaagagaagttattcctttgctgtccagctcctgacaagcctcccaagattccgatgggaccattatgttgccaatgaaaatagcgtcactggatgctcgttgatcgtgaatagaggctttatcgttccgtgaaaatgacaaatatctgatgatatatcggtacacatcagggattcagggtccatttcttatgaatggaggaagagtcattatttcgataaacttgattctaacatacacatctcccttaatttcctaatcttgggctgtgtaatagacgggaagatcttacgaataagacctcttttagactcctttggaacacatgaattgagaaaaaaaataagaacgagaaaaaaaaatcataaattggacgtcatgatatacacaatcttgtaggtattgaaatcgcattgaaattaaacatatgtttgaatattccacaagaaattgaataaattttaggggaaaatattattagaataaagttaagaggagagataaagtgccttctacttttctaaggaaataaacacaaagaggtttgagctcatatgtttgaaatctaaaaaaatgagggaaaaatgattccaaataaagtttgctagtccaatatttcgatgggggcccttattggttgcccatattttctaataagttgtttaatagcttattattgaataaaagtcaataaaagtttgtttacaggtaggatttgatatatgtgttcttttagcgacttaaaagccaatgctgaaaacaaaactacgttgaaaatatcttaaaattaactccaaaattaagtttaaatttttaaattttagctttggtttttggcttattagggcaaccaatgaggctttgagttatttgcaaatccaattctttaaagaaaactaaaaataaggggtttaggcccctttgattcaaagtaaattcatagaaattttagagcatttcattcctataggaatttttcctacaaagccctttgaatcaaaggaatgaatcctatggaatcctatgaaattcctatggaatgccttttcccatacaagttttagaggaaatttaacaagaggtaaaacctcatggaaaaaatcctttgagtctttatctcacctcaaaatcctgtgtttttcctgtggtccaatcaaacggttattcctatgtttttcctgtgttttgcaatcctctgttttacacttatattcctatcagaatcctatgttttttctattcctctgttttttcattcctgtgatttaaatgggccttttaaattctacaagaatcatatagaatagcgatcatatcctcgtcattccaacaccaaaggcagagagctacaatgctccatgccattaactatttgcctatttccagccgttggatcaaacatgggagcactagatcaaccgctacaatagtctacagtaaaccaaaacataacaaaccaacattattttagggtagctatggtaaagtactgtagcatacctcatattttaatgttcaattctaccgttcggcccctaatggctaacgatgtgaatctgcttctaccattcgccccttaatagcttagaataagtgacctaaataaatagtacaggaaagtttttgagaaaaaaaacatatttttagaagcgtgtagcaaataatcctcgataataattcaaccaataaatttaaaaagggctaaccatgtcatgaaaaagtagtattccttaacactcactcactcctttgaattagggtatttatgtgatgtccctaacaaaatgaatttctagctctcagaaaaataaaaacgtgagctagaaactcgagccttgatgttggccaaccacatccaaatccatatgtgatgtccctaaccttcttcaactctggagcgacgagagagtggtgataactacaacgagcgacagctagcgggcaagacgaggaacggatgatggcaacctccttcaactacggcagacgatggaatgacggtggtggcgaaggcgcgacagcctatggacaatacgtggagtaggcgacaacaacctcctttaactctgatttgacaagggaacaacgatgacgacagggcgcaacagctggttggcaagacgaggagcgagtgacagcaacctccttcaacaacgcacgatgatggaacgaaggcaacgacaaggcacgacagtcagcggcaagacaagaagggtatagtgatggcctcctctagctcgtgcgtcactgatctccactaacttctagagcgctgcaaccttctcaagccgcgacacggtggccgggaatggatgaaagacagggacgactgccgacgagcatttctaacattggaggcaagaagaagagtgaagagtgtagtgttcaggatggtattttagtttagatagtctgactgaagttgatattttagcaaagcccataaaactaataggattttaacaatttaggggctatttgattgatggccataagttgccacactttgccacacttgaggttaggcaagtttgaccatgttagatgagtgtttggttggcttccacaagtgtggtaagatttctattttgtaatctagatcccacatgtaagtgactctaaaaaatgtggcatggtttcattttgttggctagagtgtagtttggattttgatggcctcacctttggtaaatttagctaagaaagtatgataaatctagtcaatattagtacgtaaaccaaacagctcctaagcttatataatggtgtactacaagtgcaatttttttggggaatggttaccagtacgtacggtgcacgcactcgcgcagtcggtcgcgtcgcacccgattctcagcagcaccaccaccggtctccatttcctccccagattttctcgttcctcagcccccaccgccctgtaaaaagcggccgcggcggcagtagggtttcggattcccaccccgcgtgcagcttaggcgaaccctcctccctccgttccacacgccccagttccccgctctctccccctcacctcctcatcctcctcctccgctgccgccgccgccttcgccatgggcagggggaagttcaagggcaagcccaccggccgccgcaacttctccacccccgaggagatcggtaccgacgtcgcgccctttcctattttcgattcggccctgtttcgttttcactgagaaatctggtgccagccgtcagccgccgccgccgccggcatgggcgggctgctcgatctgatgctgcggcgggggggttcgggtttcgctaggctgggatgtgctcgtagaacacgagcggctgtgaatttgacttgaacgcgatgcatagagcgctttttttttgtgatgctgtacgggttagcatacaattcgatggtgtttgatggtttgggtcgtggaggagggagtgactcgttgatctaacatgggtcttagcttcggtgtttatgttgcctgattttgatgctcatgtagtcaggcacttatctgcatctttagatgcttggctctatcccatgatgcagtagtacagctcgattctgtttcttcgttttgatttattagttttataaattccagttcactgtttcagatcttcacggaataagggtttgtgtggagtttaaacgcagtgagaaatcgattgcacctctgtctttatctagtctcagacaaaggaactctgttgagactgtatacaggagtgcaataatatttttaagttcttgatgtacaattgaagaccatttctttttagtttgtgcttctggattttgatttcgtttttgatatcctgctaagtgcaatatatatatttttacttgcttctgatcatcttttccattcaaataactgcagctgctggtacttcaggtcgtccacgcacatttaagaaggttcgtccacatttctaccatgtgtcgctcctagatgaaccagaaaaaaaaaacttttttgtcagttacacggtttaggataatattaaactaaactattttgcttttggcatttcgtatttcaccgtgaacaatcattgtctgaatggataagaagaacaactatttcattggttagttttgtttgttgtcaaagcatctgttccagtgcaaagaatagcacatctaatcgcttgtatttatttatttatttatattctgggcgtttccagtatccacatggatgaatgttgttaatccgcagtaatgaaatcaagagcattgcaattgcaaatgtttactcaattatttgcaccaaaccttggtttgtttcaacactaccttgtcatattcgttctaatgaatgaactgagtatcaaatagaatttagctgaggaggaaaaggaggaggaagaagacgacatagaagaatctgaagaggaagaatctgaagatgagtctgaagggaaggctgtaagtaatcttactctctgcaagtatatgttcatagttcagttccttttcttacctatctgacatgttgtgcaacaattccagaaacataaaggaactgaaggtcttattcagattgaaaacccgaacttagtgaaagcaaagaatataaaagccaaggaagttgatgtaagttggtgactactgataatattttggactatattttctgttttcccccttgatcttcatactatttgatagttacgtctgaatctttttgttcatgtgtaccaattagtatatttttcatgcgtttgtccaacttactttgcattttacagctcggaaagacaactgagctctcgaggcgtgaaaggtaccttttcttatttcagtccatgcattgtgtttagctgttcaggaaaattttaaggtacaatacttcaaatatgtttgaattatagagaggagatcgagaaacagaaagctcatgagcgctatatgaagcttcaggagcaaggaaaaacagaacaagctaggaaagatttgggtgagaattcttatctatattatgtccacctcttcccttcttttggtgttccttgttggttgtagttacttatgtatttatatcgcatgcgacctatgagcgttcattaaatctggttcagtatacctatagaaacagacactgtaacaaaggaaaatagcttaacatgctagcatgatgtacaaaatttagtatcagtaacaatggataaatcagggccctttaacccagttgatatctttaatcagatataaacatcagtgggtttagatttgacatcttactggacattggatagtactgattcagtaccgatactagcattatactaaaaaaacaagttatatgtggacaaatcctacaattcttgcatatttttcagccgacttcactgatcttatggatgaagtttttgcgtcttgtttaatgatttttaaccaaaaatcttcttgtattctttctgaacttcgacctgaaaatttactaatgcaatcctcttagatgtctcacaatggtgcaaatgttttccttttactcttcaagataattgtctttctagaacaaagaagattctattttatatgtgagacgcacatctaccatttaatgtcagattcagtcagaactgtccatttgacattattatatatctttgtagaattggcattgtatattttttttgggtgcgttcaatattgaagaattacctgtgaattgccaacagccatgaccctttataattttgcaaatgcagaacgtcttgctttaataagacaacaaagagctgatgctgcaaagaaacgtgaagaggagaaagctggtacatctcccttgctatttgtatattgcttcatggttttggttttcttgtgtcattcagaattggttgcagacatatcatatatgaaaacatattgtttgatcatagcatcatggagtgtatattcaattgcttgtgaaattttgatgcctttgtttactagttttgataacattatgggtgcattttgcaggtaactaagtgtttagcactgagatgaagtgatgctcattttacacattcagttagtaacatgttttcttagattgcaatatgtatactgatgttaattttattcttggcagccaaagaacagaggaaggctgaagcacgcaaataactgcggcaaccatgtggacaatgaaggcgtgagctgcgtcggctggatatttatttcttatatatatgcccctagtatcttttaaactcggtctcgatttcgatatttccataaaattatgcattgactaactgtagtattgtcgacgtggcttgatgtaaacttgagcttggcagggtgcatatgtagtatgatcagtttatgcaaaatttgcgtttacttacgttgatatataaatcaagaacgttgtgaatactggagataatccatggtcatgctgcttaacattaagataacctagctatcttctttaggagaaaaataagactaatcatcattgagaacctgaaatttctcaattatgcccaacatcaagaagtcagctagtgtccatacattttgggctttgatctttgacaaggcaagacctgtaggtcgtagattcatactgagggggttgatcgtaggctcgttgcagtcactccatgctttcattcaaagatcgtaggctcgtagcagtcacttcaagctttcactcaaaattgcctatgcgcaagctgaagtagtgacatcctgtgattgctgattttgaatgatatgtagcgtcgtgcacttctggagttcttcatgggaattaatgagatataaaattaaaaccagatgactgattgattgacatgagaaagcaagcaaaaaaagaaaagaaaagaaaaaaaaagtaaggactcctttgaaacacaaatgcaaacagaaacataaggataggaaaatcgtagtatttaagtgccatgtcaccttaaatttatagatggaaaaacacatgaaaacaatagaaatgatcgttttgatagagtgcgggaaaaacacgggaatcagaaggaaaatgatcgtttggatggagcacagtaaaaacacatgaatgaagaaaaatggatgcaaatgaattttttaaagaggtagaacctcatgttaggaagtctccaatatttcagaatcctctaaaattttctatgtttggaggcaatcctgatgaatttggtgaggccatttctatatttcaaatgaattcttttcataggaatccaaccctccaaaattcctttgctcgaaaggagccttacataaaatttggttgcgattaattgagaaaagtaagtagataggagtatattttatgacaatttgaactccataaatagctactccctctgtttcaaaataaaatacaagcatttcacatttgatgacgcttaccttagttctaagagaatacatacttatcacatcaatcttcttttttttcttcaatttccctccacctccaccaagtattttctcctcaaccttattccaccgtctcttatttaatatgcgacacaaaagtcgtttctcctcaaccttattcactgctataacaacttggaaatacttatattaatattatgtaatagtaagaatattttaaaaaggggaagggagtatgttgtgtattaaaaaaataaatttcacaaagtcatatatattttaaccaaactattacaaaattacatatttaaatcagtgtatcacaaaactatagaattaacaatacagttattacgaaattatagatttaagacaaagtattgtaaaattgcatatacaaacttatctaaagcttgaatctaactttagtgccaagggtttaaattttaaaatatatagttttgtgataacaatcaataatattgtatgttttgtgataacaatcaatattgcaccagtagtttcatgatatttggtattaaatctaaatctatagttttgtgaaaaaatggtgctaaatactccctccgtcccataatataagggattttaagtttgtgattgcaatgtttgaccactcgtcttagaaaaaaattgtgcaaatataaaaaacgaaaagttgtgcttaaagtattttggataataaaacaagtaaaaaaaactaaataataattctaaattttttttgaataagacgagtgatcaaagagtgcaaacaaaaacgcaaaatcccttatattatgggacggagggagtatacagttttgcaatataatgtcttacatcataggtagatcaaactatatgtagttttgtaaaatttagctaaaaaaactaggaaactctacaaactcatgtcaacctgtcaacgattttatatctcagaaaaatatacgacgtaccaacgagcggtttcatgatttcatcagaaagcgaaatgttcgaatatacggcattacgtgtaaaacaatgctcatgacgaccttctgtacttctgtcttagttcatgcatcatagcgtttcaaatgatttcctttcatctctcagtaacacatgcccatacaaatgtgaacaaaaacaaccagcatcaaaagagactatagctgtcattttttcagcactcaactagaaaagaatactatgaccttcaagggcaatatctatggtcgttccaacaattactgtaaaaaggctatcaaaaggtataatcgccttccagaggtaatccatgttaccagcccacccaccctgttctgtatttctgttatagcagtagctccaatcacgggcttattcgttcttagcatgccgtgaatcattatcatcccacggctgaataaaattttcatgctgggtcatggtgaggaacgctggcagcacttgaaaaagctatccgccaacctatacataaataggatgcatctgcgccttttggattattatagactaatgtagcagcactcacaaaacttcgtttagtgtcactgaagcttcaatccattggtttgtttttcatcatcttacgtttcgtggcatccagatatttcttccgaagccgaatgaccttgggagtaacctgatgaagctcaaatgtcaatatgaaactccaggagcaaactggaataggagttggaacagttaagcttaaatcaagcaagaagattattttcttttggtaaaagattgggagtaatattccacaaaataagattattttcttaggataatctgcacttctaataaacaaaaaaaagctagcagcatgtagagtaacttaaatttggatttgaatgtggactaacatgcatatattgtagcatgcattttgttttgtaggctgcattcctacattccaacccatgcacagagaacacatctctaatttagatttctgataatcctttacaaatgctagtagcaaactatatagcagaaactgcaggtggatgcttattgattgctttctttgtttggttcttaatattgtttgtaacatgccattgtattatatggtagaaataacaatgcacccattcattagcctgcagaatctccgtctggcagaggatttttttctgaaatgtaagtggttttatacattggcaatagtcgtcaacaagtcatttcaaaatccaaaaaaaaaaccaggattttttttttatttctagagctaaaagtaacaagccaaaaaagaatcggaataagaatcgggaaaaatggaaagctcatctctatgcgctgcttgtgccacttagtcctcacacaagtacaagtagaatcatcaatagcaaatacagaaaacttgcctcaataagctcatctgcagcaacatatccaattgcctcttccaaactcatctgcatgattcagtgcctttagttaagattatgtaacaatcatttccgaggaagctaaaggaaggaagcaaatgacatttttcagcaaagaatgcacataatctagatttatggtctcctcagttcccaaaacccaagggagagtgtgacgcgaatattataaagcttgcaaggcttccgttggtattaagttgttaactagtgtttaaagcagcaccatttagtctgtagggtgataaagtgatatctcctgaatgctgatgtcttggtaaaagttaaaacacaacataccaatcgtggtggagaaagcctgacattttcatcctttcctggagctcgaatgtttgtaagttctttagttctcacaggattgatctgaacaacagaagagttatttagtttgtgtattagaagagaaacctaattcattgataagcatataatcaacttacatcaagatcactgtcacgtgagtgctctccaacaatcatgccttcgtacgccttaaagaaaggagaaagaaagaggaataaggaaaccccctactcttagatggtagatcatagtaacaaaatgaataaatgtcgatacctccatcccaagagaaacaaacagaataccacgagcttctaaactcataagtgcatgtgaagtgataagtcccttgccgacagatacctacatatacacataagagcacttacatttgtcatgttgagttgagcagaataaggtgcaattcatcaaatcctgcttacatttaatgacatattccttcttttatttcaattggttaattcttggtttaaaaattcattgctgtctattattgcgaaataatgtaaaacttggttggtatgaagaccggttagagttaaccggagaaattttggaactgaaggaattggcattaccagaactccttttctaacattgcccagctgacctctgtatttagcatatgctgcaatcatagagaaaccaaggtcaaatactctcaataaaatctagttggtggcatcaatggcgtggtttacttcaaaaaaatgcataggcgagttaaggaaatcatctaggacttaataagaaatagcataccctggaaagcgcgatgcataaacccagttccacgtgtaaagctgctgaatattcctttgaatcccaccaaacccctgcatacataatgcatcatttcgtatcataaaaaattgagaaccagactgaaatacatggcaaaagacaatcgagtccaaaattggcatcaactataatatgcttttgaaggtgacacatcatgcagctggtaattatatgcactaatcacctagatgggcaggtcaaaaagatccgagttctcccagttgtccctggaacagggcccatgtccattacttcacccttcctgtgtgtcagggtttccatgacaaatccaacatgctcctcgtctacctacaatatgttcaaacattaacagtttatgaatacaagtttagaacaaagtaaacaactaaaaacaaagaagttcaaacaaggttccatatttctacctcaacagttacttcttcaataggctctaacctttctccacggtctgttctatacctatttcaattaatacataaattagttaatagtgggaacagtgctgccaaattgctcagatacagagttcgatatcagtggaaagtgtatttccacagaacagggaatataactacttcagggtgaaacaaagtaatagaacaaaatatctagctacaaacggttagcttctctaatactgttggaaagaaaattgaactaaagaacttcaggctgaagtgaaaacgtaagcatacaaagagtataatatgtggaatattggtgctcacatcacttttgggggtgaaactgaaagctcaaatccttcgcggcgcatattctcaatcaagattcctggaagttatgcagatcatcaaatgctatagttggcaggaaacttttcattatattgtacacgaggttgacgtatgaagtgctctcaaataaatcaagaaaaaaaagcagttaaatagcatatatcagaaaaagaagggatttcatcagtggtacatatacttacctaactgaagttctccccttccttgaacttcataagattctgataatggtccaggaagaacattaattgccaggttcgtttctgcttctgccattaggcggttgcctattttcgctccagttagctacaaaattttagatggacctcagaaaaagagggcagctattattgcttgatttattgaatacaaatttatattactatagcaccatacagattggtaattaggctctttccagactatgtgtagtcagcataggcaacctatgaagttgatttagaatagctgtggttggatctatctatgtcattcaaacaaaggagatcgaacgctggtgtgttttacttagaggcaccaaggcttccatactttgcatcgttatatcctaatttaaatttgaccgcaccattcctcagaaacaaatgacataaaacttcacattaaataaaagtatgtacatactgcccaaaaaccagcctggatagcattgcaaaaacacctaggaggctagtaccataccttggatttagacctccaagactaatggtgttagcttcttagtccttactctcacctaccaatttaaaacttcattcagaggactagctccaccgatagatttaggaaaacctatgcgctagtaactgaattcagatgattaaaaatgtatggtatgtttgccttctgattattttgacaggaaaattatgatctagtagtatcatgctcagcaagtcaacatttgatatctacccattatttgtagttcaagacttcaagtagtgactatgaacaagatctagtgatacaagttatattgcagtgagcaaatgttatattctctttttcttaaaaaggaaaaggtaaaataactaatatatttcagtctgcaacaaattttcagatccaatatgaattaactagttccttaaattttagaatcctgcatatgacatccccaaatccagagcaacatagtgcgtggaagttataacaccatctgattatcatggttccattaacatattagcagctcctacaggaatctgaaatctatcttaaaacaataacctaactttaagcaaaaaaacaaaataggaacatgaaaagcaaaataagaacactttgatgtataggaaaacaaaacaaatatgcatgaattttcatcaaaagcaaaaaggacaatgaaaacaatatgaggaataaataggaacactttgatgtctaggttaattgtttgctacttacatgagtgccatcgcggccagacagtggtgaatcattcacaccaaaagtcatagatattgtgggagggtccaactcaattgtaggaagggcagtcaaaatctatattgtacaaccattattagtacaaggaatatctgacaatagaaacacgttcagcagcacgaattagcaacctacatctgaatttgacacagtatgcccaattgctggagcagccaatccagccattgaaattatgtcgccagctcctgcagcctctactattaccatacttgttcctttctttttcatgagcttgacaacctgaatttgtttcagtagtttgcaaaggtccttaaggcatttaatgaatacaataatttaaacatattgaatgagaaaaaagtgtcttcagcgtttaagcattgccgagaagaagtgcaagaaattcagttaaacctttccatcttcgatcttctgaacaccatcatctgtgctacgaagaccatgcactttgtcaccaacacggacaaccccagatcttactcgtccagtcagtattcgtcctagataaaaatcgcgttccatcatggaaacctgtagaagactatgaattactggctccgcttaagaattaccagtacaaccttacataaatatcttcagaagaggtaaatttaagataaattctagggtggggaattagagaaaacttgcctgcaaaagttaaataacacacatttcggaacaagaagaagtgtgtgaagtcttaaattctgaaaaggaggtggaatcttacaaatagctattgactaagagtggagaaaacttggccaaaaacgaaggcatcattttgttttggttgctaaatcaagtggaactctattacaaataaacaaatcgccataatacttagtcgttcactcattctaataaacatgtcattagagatggatggagaattacaaaagaaatagcaagttttccctcgtctaaataaaatatccatttcagatgctgtgcaatacactaaccaacatttggaatggagcctcaaggtcagcttttggagaaggcacatgctgtaaaatggaatcaagcaatgcagacatatttttcgcattatcaggagggctcttggtgaattctagagaagcccagccttctttagccgatgcataaagaactgggaagtctaactgttcttctgcaaaacccgaataaaatagtgtcacatatttatgaaaaaacttccaaggcaccaaattgaagtactagaaatgcacctgtagcaccaagatttgcaaatagatcaaacaccaagctctctacttcattgcaggtctcttccgaaactgttggagtataattggttagttaaagagctatagcaaacataatatactagggatatatatatatgccaaaaataatgaatataatgctttatctatttctgagctggtgtatcccactgcagttggccatttttactttgtgggaagtgaatatatcgcagtagctcatctttcaaacaaaattattgctaacgctaaaaaacattcaatgctaataacaggctactcaaaaggaaaggccttctaactaaaaattacatgactggatatttctctttttctgtaaacatagaaaacaaaaggtagcctaattttgtgacgggaaatggaatattgtgtcattttggataaaaattattgtgtatttacccccaaagtatatgtttctgtttatctgcttaaactaaattacacatcaaaacttcatacttgctcagcttaagatcgtagcttgattcatatctaagacaattgaatcactttgttatgtacatgccatccattgctcacaaaatactgccatagtgagcagagcatctgagaataagcaaacctgatggcctgtcaaccttgttgagaaggagaattgggcgcaagccatacttcaaagcctttgaaagtacaaacttggtctgcgctaaaggtccctccccagcatcaacaaccaagaccgccccttcaaccattccaacaactctctcgacctgtcacataattggtgaggatcatgtcagataccatagaaaaatcatcatttcttcttgttcttaactgtatgaaattataaaagagtgctgagtgtgtacttcgccaccaaaatcagcgtgaccaggtgtatcaaccatgttgagttcgttctccttccaagagacagaagtgacctacacaaatagccgagacgaaaaaagtgagatgccacataaaaagttaccatactgaatgctatgcagctattggaccatcaatgaagaagtttcaacaaaaaaaaaaatcagaaggatgagataatgattatctcagcagatcagatttcgggagtgatttattgaactacaatagatgtgcaggctttacggagtacagaatgagcagagcagttgaaccataagtgacataaatcctcccagaaatttacttacgcactgaaatctgccaaggtgctcagcgatgtataacagggaaaacagtagcgcaagtttgagaatggcctttgaagcagatctcacttccttccccaagccaacattctaatccctcacgtgatgcacgcagtatgttcgacggaatggacatttaacctctcgtgtgccctcactaaccacgcggcgcgcgcgagtggtggaaggtgggttaccttggaggcaatggtgatgccgcgctcgcgctcgaggctgatggagtccatggcgcgctcgtgtgggatgtcggcgccgcactgccgcaggagccggtccatcagcgtcgtcttcccgtggtcgacgtgggctatcaccgccacgttgcggatgcgggacgggtcgagggcgcctccgggccccagggccggggaggcggctgccgacgcggcggcggccgagtagaggcggcggaggagcggcgagacgtagggcgccggggacgaggcggaggtcgggaagacagggctcgtccggctcgccgccgagcggaggccgcggagcagcatgcccgtggccatggcgttcgcggcggcggcggcggcggtggcgtgatatttcgcgcggccgggagaaagggaggcggctgcggccaagggttttattcgggcgtgtcactgcgacagtttaccaaatgtataaaagcccatctgaccacaggcctgggtagtttgtcctgggcttctttcggcccaatctctctcccgtcgagccggccgcctccgccgctggggcgttccacttcccgacgggcgcaggcggccggcgtcgactctctcctgtccaacaccatagttgtggcggccgatgctatcgttaaggatcgcggccgcctcgcgcctgcgagggctgctgggcggcggcgcagcgaccggggcgcgcacacgcgccttctcctatgggagggtggtggatgccgctgcccgggacggcgagctccgagttttcgtggtcgccggtgaggtctcaggcgactcgctcgcctcgcgcctcatggcgtctctcagggcgctctcaccggtccccgtccgttttgctggtgttggcgggtctggtatccctccctttccccccattttcgtttcagtacttctgtggaatcgatgtactagggcattataacttgagtttgtacattattttaggttgctcttaaatcggaccagcatttgtccaactttttgtttgatttgatttttcatgtcaattttcataggtccattgcgtgcttatagattgtttcgtttcacatgaacataaacaaaacttccattgttgctatgcttggcatgctcacacagtcaaagaaagacttattttggaaccgcttacttaaagtttttttctgaatgttgttggaaattaaattctaattgtattgtacgtagagctagattcatcgatgcacacttgaaatgctcaaatttgcatatggagagcaagacagagtttcagccaataccttgagacttgagcaaggtgtctagcatttagtggagagacaagcaacagatttttcattgtaattcttgttacaatagtatgtgatgctcttctctcttgtagtaggtttattaggttgtagcacattgaagaaacagtaaatttttattctaagcaatcctcaatgcttggcatataagattggaaaagatgaagagaaaagaaagaaaattgggagcaaaatggaattccagagttaggggattggattgttagatgctgacctatataagggtattcggcaagtctcttggatctaagcaacaaagatcaatctataatattccccctagttcatcaactcatcctacattccgcttctcatccctagcagccgatgccgcccggctatccttctggtggtgtttaatgcaattacaccttgcccataacagtgtgtatccatctgtttaattatgaagaaagttaactttttgtgtggtcaacattcccatgtaataattaattcagcatcattgcatcatttcacttctccatctatctgagttaatccaaacccaatttcaagttggattccatggttttactgcaagtatgatccttgagtttcttgcctcttaaatggagctcaatccagactcaatttcaagttggatcccatggctttacttcaactctgatccttgagtttcttacctcttaaatggagctatggactcttttctttgatgtagggaattaatgcgcaataaaggcttgcagtcactttttcccatggaggaaatttccataatgggattgtgggaactgctgccacacatatataatatcaaggtgcaatgttgttctgtctcatactctcatgctttgctttttgttcatgttctctggacttgtattttaattatgctcattttggttttacagaggaagattgaggatactgcagatgctgctgtattgtttcagcctcatgctgtagttactgttgattcaaaggggttctcttttcgcctcctgaagcaattgaaatgtaagtctattagcataagcattttttacaataccattcctaatttctcgtgagcaaatatgataaacactttctgttgtctaggtagatacaatcaagttgcccgtcctctacatgtccactatgttgcaccatcattctgggcctggaaagatggtgaaagaaggcttgcaaagttgcataattttgtggaccatttgttgtgtatccttccatttgaggaagaaatttgcagattaaatgggttgcctgctacatatgtgggccatccattattggatgatgctattggcttgaatatggtatggacttacgtgctttgtttcaacatcagtgccatcagcctaatatatttttgttgaattttaagacattgctgtccaaatctctcaacagttttactgcactttcttaagtgtcttctctatccagttatctcgttaagatttctttgcataaatgctttgcactacacaatgaatgcaccatctactacatagaatggcaatttaatgtaccagaatgtttctctctataaccagtagctattaaattactactgccgatgcatagcagcagtataagagaataaaggtaaggttttgtcatttattcattttataaagtgatcattctcattgatgtatagctactagtagcttcttttctagttcagttgttaagatatgtgcacaagcatctagtgtcttcatgggaatgagatgaagatgattgtgcgaaggatgtactattgtctttctactctgttaggaaaaatgttggcacggatggaataactagtaatggctgtcttatcgcaggtgatttaaatatttcacgtgatcttttatcaactaagcattttgatctggatactattgtctttctactttgtttcgaaaactgatgacatggatggaataactagtaatggttgtcttgtattgtagatgaaatatttcacattttcatttataaactaagcattttgatctggtaatctggagatgctcatggcatgtatataaattgctagtgctaatccactgacttgacttacatattctttatgcttgccaaaataatataggagaaggaactatcttctgtcaattccatgcatcaacgaagtggtgaagattttcgacaggagcatgaaatttccccaggtagattgtatgtgtaattatttgggtgtgcttcttttagtggtaatgcttatgttttgttttttgttttctgcttgtatttatcagttctatgaattatatatctgttatgtggtttatccatttctatgaacttagccgagagaccagacagcatcacagttacatgttatctgttaacagtgcaacttcaaatctgcaaactattcggcagttgcaactgccatttaattttgggcacacttgcacaccatcacttgtcaagtgctactatactatctttctgggtaatgtagtattgtataagtgaaaactcatggctgctgcatcaaggtttaataattcctatataattcggtgctgttagagtagtcgttgcaaagtaatctattttttgtagcaagttctaagtagcttactcataatatggtgctacaatcagatcagctttcaataatgagatgcaaagcattttttttacgggaaatgcaaagcatatattacacagatatttcaactttcttgtgaattgcatttatcataattttcacatgcaactctggtaaaacatatagttaaacctgaaagctacatgtataactgagcacatattgttttctttttatacactgcaaatctgcaggactatgcctggacctggatccttgcatttatcatgttatcttgtgcatctaggcattcactgaaatcatatctggatatactgctccaaattacatgttatcttgtgcatcaatagctagttagttctcctctatgaagctgcatcaatttttttttcataggcttaatcttatttgcatttttactctgtgttatttatatgtgcttgttttctaatgagaaaatccacttttgctagattccacaatcataaccatactgcctggaagcaggatgcaggaggtagcccgtatgcttcccatcttcttgcaaactgtgcaacacctaagtcatacatttaatgaactgtcactggtcatcccagttgctcctcatcgggatgtgagggtatatgttgataatgttgttcgatcaaggccatttccagtggtactgataactggggaaacactaaaagaaagatatgatgcattcaatgtaagctcacatgattttagttctcgagtgccaattcaatttttgggtactattattttgaaaattggttatgtttcaaagtatcttatctccccaatgcttatatcatggacttttgtttttttacggaaggtttcatatcatgcactgcacctgtaccctgtgcttgctccagaacagtgttaatttgacaaagttccctgaattgctaagtctgtatctgaagtacattttcttgttgcaatatgcagacaaaaagttatctaatctagaacactgttgattactgcagctagtagattgtcccatgcatgttgttttaacatattctgtccctttcactcaggcagtatatgaaacaattccttaaccacagtaagattcagcattattatgaatgattagactagttatacacataagaaagattgtgtcagtactagttctttgttttctagagaaaaacatatttatttcttgtgaggtaccatatttttgttaaggtgcatctgttacgtcttttttttctcaaacacgtatctgctacacctcaagccaacatatcttatagtagttatttctattaatgaaagagaaacatgaaatttatatgatgtaattgatagttaatatgtgagacagatagcaacctaggtgggcttcttgtgccagcagcccagtactcgtcatgaaatttcattggtaatgtaattgcgtgctaaataccgcaggtctgcagtcgatttcttgcagtttccagaattcatgtgagtaaactgaagagtgttgtttcgtcttgcaggctagtagagcagcattatgcacttcaggaacagctgtcatggagctgatgttagcaaagctaccctgcgtggtagcttaccgggctcatttcatcacggaatgtttgattcatctgaggaaaaagatagactttatttctctacccaacattcttttaaactctccaattgtccctgagatcctttttggggcttgcacagcggaaaatctagctgcaaaactaaggtaatgtcccccacccaaagaaaaaactcatagatatgaacatagttatctcccatggatagcatccatatgggtataggtagcagtattcatatagattcatatgccttgacatgcctgttagttaacacaattgcttaacgtgcttccattgcttctttttttctgaatgatgttcattcttcattattgagaaatagtatgtatgtattcgacacttggacctgatcatatttcatcccattttgatctgaccagtgaggtcatttgtaatgatgaagcccgtcagctccaagttgaatcagctgaacagttactggagatgctttatgaacctatcaagcaacgaggtggcctatttcaagaggagctgcacaactcgagcctgccgtcaaatatctactccccaagcacgattgcagcattgacagtgctttatacagataaccatcaacaagcggtgcaccagaattgagtggatgtcctcagtagcagacaaatatttttatcagccgtgatggtcgctattgcgtgcaatctcatcttctccgtctgctgttcgtgatgaagagtgtactttctgcagatcctattggctgccctaggcccacaattggagaggcaaaacgagtttttaggtaaaaaaggcttttcagttcttggtttctgattctgaagtgccgcatgaagtcaggtcagcatcgtattatcattatggaggatgggaacgcatgtgttctggtgggtttagtgcgggtcctggtcatcattctgcgatgatgcgtttggcgcaagattcttccatggttagaatttcctggagtgaacagttggcagttgatatgtgagaacaattacaagagatttttcggatggttttgatactttcatggtcatcgaaattacgagatgaagtatgaacggatgcacagtaacgtcatcaggtctgggcttgcttgatggctgctctagccatagaggatcctcggtcagtgagaaagcatagattcccacgtagccggcgatcacgtcacggctgagctcatctaggtggtggcccatgcacgagacggcgaatcttccatggaaaatatttcgaaaattgttgcttcggttttaattacaagttgccggcattgccagtgttccacttgggaatatctaacgcttttcttataacgattttacctgccaactgcagcatggcatggggaaaagtcttgagccatcgtgtacttaaattgtgtaatcatctggtgccactagctatccgtgaacttcaggagtaagttgatctagaatggtgactggtcaatggaggccttgtaattgtaatttgtaaaacaatctaatgatgtaacatctcaaggcattgccagtgtggtcgcggtgcatggattcgtttccctggcatctcggtaagaaacagtaatatttcagtatttcacagtgataagtgattattagcattggacccggtcactcggattctgttcttttcaagagttcatacataggtcatttttttaatgtaggtttttaaaggttgtttatgaaaatggtcttaaaagtattccttttttatgaacttggctttacacaggctaaactgtcatcaatctagaacgctgcactttgatgatatcttggacatatcgccatgttacaatattttcttcgtgcttggaaagcacgattgatgccttcaagtgaaactttgctcacggaattggtatcacaccacgaaagatatcataaaaaatgtgagcactaagcacagagtaacaaactacatgacatgctcttggtaccactgtaccatcaataaggcagaacattaccacactaacactcaggccaagtgcctactgcaaattaaccctgggttttgatcctcatcctacgcgctgtacatgtcaaactgatcttcatttcatatcacgcactcaccgtcgctcatgccgacctgcttcgcggccgcggcggcgccgcgacgggcgccgtcaccggcgacagccggcgggaagttgagcagcgccttggcgccccgcatgcggaacgcggcgcggtcgtacgccgcggcggcctcctcggccgtgccgaaggtgccgagccacagccgcgcgccgtgccgcgtcgggtcacggatctccgcggcgtacttcccccacgggcgccgcctcacaccgcggtagtgccgcccgccagcggcgccgcccctcgccgccgctcccctgcctccgcctccgccgccgccacccttgcgcccggcggggtggccggcgaccaccggcgccgtcgtccgcgcgcccagctccggcgacgacgacgacgacgacgacagcgccgccaccgcggaggcctcgcggaggacgtcgaagaggaccatgtccagcgagtcgttctcgttgagcgggaggtacgacgacggctgcccgttggccgcgcgcgccagcgacagagacacgtccacgcgtggcggcagagcaccggcggcctggagcgcgggcgcggcggcgaggcgatcggcaccgacgccggcgccggcgctaaaccccaaggagagagacatgcggggctgtacgcgcggggcgcgctagctcatgagacgatcgagagaggtggatggatggagagaccgagagagtggtttgcagtgtggtgtgtcaggtaggaggcgatgcgtgatgttgtcgcgctatttgaacccgaggaagagctagcactggaagtctggaactctggaaatggaaggattaattatttttaactaaagtggggccatcatgtgtcatgcaaaatgtgatttcgcaacctcctcgggtgcaaatcatgtggttcggttcatgcatgctttggcctttggccaattactcccatttttctacgtagttttgctgatgaaatcggccaatcggggtaggcccatccatccaccgttggagcagccagctagcgagcagtagcagatattctgtacggagaggcacacggcgagcaaagctaggcttttcatgtgtagctaaattgtaatatcccagttggattccttgcatctcacgtaggcaaagatgtaatatagcgctctgtttattaatgcacggatatgcatgtatggttacctactctagtgaccaatagaagaagatcctcctctaaggctgtgtttggctctcagggttgggaacacatatactgcacacgaaaatggaacggtgcattagcgcgtgattaattaagtattatgtatttttttttaaaaaaaagatcaatatgattttttaagcaactttcgtataaaaactttttgaaaaaacgtttagcaatttgaaaagcgtacacgaggaactcaagggtatcgaacacagcctaacttaacttcgcatgcaattgagtcactgatatataagtcccactttgttatgttccacatgtcagtggttcaattacatagtagttagagcacctgcaatggtaaattaaggtgctctctataaaacatgtacatctcaacaataaactagattaatagtaaaccatctcaatagtatgtctacatgggtatctatagctctctaatctattgcctcgtttttctatatagactatctccaggttagtatatagctttgctctctctattcatttaatttctttcaagtaagaaaatatgctgatatgaatattttgtagagagactataaataaccattatgggtgttcttaagttagaggatccctttataagggtccaagggatgggaggggttaatagcagttgatttcgagtcggctcatgctgtctcgctactactccagcttttaactttcttttcctccattattttttctttcatttcattgattcattctttattttttcagtagcgcttaatagctttctcgtgggggcattgacaggatgtggagactgcgtggacgctttttagcgccatatggtacacacacgtctgaattcttgggcagaaaagcaatacaactaattcttggccatatactccaaaagagaagaccagagaaagaacttgggaaaattcactgcagagccgtggcgtgatttggcacgtcttccttttcagatcggctaattattctggatcttctgtgaccgatcgaggccatcgacgtcgtgccggtgcggcattacgtacgcgcgcaaacgtaaacgagagtgagagtggccgaagcgacgacgagaggataggggcagcgatcgattgggccaggccagtggaaccttccaaagccacgtacggagacagcggtcgtcgtcagctcgtgttgttcgcgaagggccaagagcgttttctaatggctactacttctagacacagcgggcagacttgagctacccgctccctcgacgatatcggtcaaggcctcaagggtcaaaggagcattattgatccatccgtttcataaaagcaacgtcgtaatatagagtgcaacccattattcaaatttatagtagtagaatatgttatagcccgtgttttatttttaagagtgaagagatatatttgactgtcattaccggatcgatgtggctctctctaataatcacccatcataaatgcatctaacaaggttatttgtgcatcgttgcattctcaagaacgtggcaactcgttagattaaatttaaggttatatatatgtgtcgcactatcaaacccagtggagcgcgcaatcggtaataggctcttccctgtcggccgttagaccattaacattgggagcatcgatagttcgattcctgatcaaaagaacaaaagggaaggggaaaaaggaaaagaaaaaaaacacgtagattgcgcgaccgttgacgatct

SEQ ID NO: 30875 - DNA, 6471 bp, Oryza sativa
  unsure (1)..(6471): unsure at all n locations
gtagttcatcaatccatttcattgcgagttccgtcttttgtgtactttctttatcacaaaatttaaaggatttatagattcgtattaggatgtatctatctcatgtatttaacatctctatatgttaaagctcacttgtgataatcccttagggtgtgtttggttggtgggatatatccggataagacatggctgccactttttggagggtgtttggatgctgggcgagagtgggatagggcggcccagaggggaatattccctccagatgctggatagagggatccggctgatttggccggatgcaaccgctcgaggctcgggtgagccgagcaagcgagttgcgtgactcgcgtcactcctcaccaccacgacgcgagcgaggcgacgagcgcggcagccggcgagaggggcgacgagctcggcggccggcgagagaggcgacgagcgcggtggccggcgagagtggcgacgagctcggggcggcggcaggaggaggcgagctgcgcggtgggaggaggcggccggcggcgggaggaagccggtgggaggaggctgccagcggcgtcggcgagcccagatctggcgctgctttttttttcttttttcttttttctatgtgtatttataatggaatgtgtatttataatggagtgtgtatttataatggaatgtgtattatgtattaatttgatgaggtatattcaccatctcaagtgagaggtgaccacacctacaaatccaccgtacttcctccaaccaaacaaaaaattggatcaccagatccacctttgttcctacaaccaaacaaaaaattggatcgccatattcacacaaccaaacaaaaaactagaccgccatatccagcaaaatatggaccgccgtatcccatccaatcttgaccaggaaccaaacacacccttaatttttcagtgggtatggttgacttgacggacgtactactccatactaagtcgcttaggacaatgtttaagtcaaatcttgggaatataaatcatgaataaccctcaagttgttgagtttgaaaatataaaaattatatgaatagatttgtcttgaaaaatacttttataaaagtatacatatatcacttttcaataaatatttttatagaaaaaaaaatcaaagttatgttttggagaccgtgtcgttgtccaaaacgacttcctttacgagtatggagggagtactgtttggttcggtcgggatggacccgaactccttgagatcagcacacccgggcggactgcgagcgcatccaacggcagatgacgacccaaccaccaagtcgtcgccaagtctcctcctccgctcccgccactctcatcctcctccacctcctcgccggcgccgccggcgccgcaccaccgctcgtcggcgtttctcctcaaggtgacggcagagccgcatacctaggcgttcgctccttcatatcttttccttactcgacctgaccaaatagcctctgcagacgaggcgtacttcgcgccggcggtcatcgcctgcagggacggctcgggatccttcccgaagcgccgcctcaacgacgggtactgcgactgctccgatggaaccgacgagccaggtctcccaccgcctcgatctctgtttccgattcggcccgaccttaactgcgaaatgcgaacttcggggtcttggggatctggtcgatttcgcgtgtgtgacgagatctgatggaatattgcgttggatgttaaaattggtgtgatgggaatatttatcttgttatggatttatcacttgcgatagaacaatcctttttttcccaattcaccaaggagaaaaatgtgcgattttgttagtaaaaaggatgtgatcttgatctttcagaggacatgaggaatgtgcgattttgacagtgctttcgaggattgcttttgctgtgttttacgccaactccgtgctaatgcaaatcatagattactaacatatttagctgccagctacattaaatcaagtttattgatagtattgtggcctgccgttcgtgtacactccctccgggctggtttattttgggacggagggagtacagctgaggtgagccagtgaccggccacaccggcacagcattcatttgtgacgttctgaatgctaacatagaaaattcttccacatctatgtgtttatctgttgcttcatagtagttgataatagcaccaatgcaaaagatgttcactaatataatgctgtccctcacattatttgtgtcatccaggtacttcggcttgtccagatggcaggttttactgtagaaatgctggagacacccctcgtttgttgttctcgtctgttgtgaatgataaaatatgtggtatgctattgcttttttcacaaaacaatgttaatatcaagagaatacagttttttttatcctatgttcaagttctctgtttcaaaaaatccgcttccatttactttcatcaatagcaaattttttttactgtgttttgttatgctcttatagattgttgtgatggaagtgatgagtatgaaagtggcatccgttgtccgaacacttgtaggaacataaatgatgttagaaaggatgatgatgttggtataaacagaaagggtgttatgaaggatgacggcgttggtatgaacataaaggatgttgcagaggatgatcatcatgataggaaacgtactctagatatagaagatctcatccaaaagctaaaaggtattatctctgttcagcatgccacttagatgtagccattccaatggatgtgcattttgttaaatgtgattttaattgtcctgtttgcaggattaaaaatggctgtagtcattgagataggtcttgttatatgtacatttgcagtctgcttcgctcggcgccgtaccagaacacggaggagacattatattttgaaacgtaagaaaacatcgcccccccctgcatattaaatcattttgtcttgtctagtaggaattctgtagatatcattttttgaagtaaagggcaggagcgctgccaaagtgccattcaatggaagaatatgattacaatagcgacacaccaatgcctgccacagaagggcctgaccacttaggccagtggcaaaactatgattacactagctagataagctcattttgtaaacatcatattctataacctaatttacttggtctataattcataagatctttacttgccaacgaacttatgatttttgaaattttattggcatgtctatttccttggcgtttaacccagtgagatgaccctctgtgtttaacctgtccgtttctgataacataaatgggagagggttcacctctctttctcaaaaagaaagaaaatcagtgtgtatttattgatagtgttatttgtgtaatattcctactatgaccagatttctttgccgcataagtatatggtaaaagtgtagttttacaaattaacctttcaggaccatcagtagctttatcaccatgtgaagctgctgtgaacacatagcccaatttattttcagtttgtgatgaagtattctcggaaacagtataaactcaccatagaatttgtgttttattttcaggataggtgagctgtcactcagaaagtccaaagattgatatggagtacaatgatactcatttgcaatcctcgaagtctccaactctccaaggatgacgggaaactggagatagaagaagggatttacacgcttgctcatcgagacgtctggaacatcaagtcgaggaaaaaaggcatcacgttgtatgagtacgattatgtgttatttttgcccgtattttaggtctcctcagcagagttgctggttgaccaaggccaggagatgatgaaatccatgtagagatgtaggataaactacgtgaatatggcatcagctggcgacgcattattgcgaggccttcctaaacttctctgtaactgtgattctgtgaagtgcactgcaatgattttaagttttaaacagctaataacatagatataaaaattttattcataaattaattttcgttgctttcttcattttattgtggcttatcaacaaggctcctcaaattgcacatgctaaactgctgctcccttgttctcgccataagctaatactaagggcctgtgggagagtttttgcagctgcaacttctctcaaaattagaaactcctaccacagtctagttttttattcagattgtaagaagtggttgtagaatccaaaaaatgaattataaactagaagaatccaaatccagaaataaattataagctagaagaatccaaaaaataaactataagacagaagctaaaatctcagcttctccatattcttacaagatctcagcttctccatattcatagaaggggttaccaaacagctatttttcaaaatcttaacattacaaacctcaagaagctcagtgtcgcatcagtttgactgcatttggcccgtttggggttattacatatgggcttcggcccatgatggaaagtccagcccatattcaaccattccggccgattagggttttacaccacctctctccgtgctcctcctctccacactcgcctcccctataaaagtcctggacgccgcaaaaccttccgcgccgccgccatctcggaccaccgtagcacgccgcctccccgcccagcgacctcggcaactccggcgaagatgggcgccttcagggttagcaccatctctcccgcttcctcccctccacttcgagggctggtttgatctcgcgagatctgatctgacgtttgcttcgttcttggtttttgcgcggcgcagttccaccagtaccaggtggtggggaggggcctgccgacgccgaccgacgagcaccccaagatctaccgcatgaagctctgggctaccaacgaggtccgcgccaagtccaagttctggtgagggttcggatccccctcgcgaatgcgccattgtttcgcgcttggtttaggtgtttggatgtcgttcagtgacgttactttgtctgcgtgcaggtacttcctccgcaagctgaagaaggtgaagaagagcaacgggcagatccttgccatcaacgaggtgatctattctttcccaccttaccttagtctcatgcgtgcatctcggtgctttcctttctgcagagtataatggcgtattaatatcaatgttgagcgaactacttagttctgcacttttgactctatatagtgtgttcttaatcggtgaaacgaaatgtactagtcatttcatgtgccatacaatgttattgctaatttttacacgaatgctagtctatttcactgatgtctttttttccatgctcggtgttagatttgattgcctactgctagacttattgtcgttttttttcctgatgtacaactgtgtatacttgtattatgacttattctgattcttctgctgtacatttaccccttggagattttatgataaattatgattgtggatacacaatgatttaaattggctgagttagttcacgcttagtttattatcagctttttcaatagtttacctgataatatttccttttgttgttttatctgcagatttttgagaagaacccaacaactatcaagaactatggcatctggctgcgttaccagagtaggactggctaccacaacatgtacaaggagtaccgtgataccaccctcaatggtgccgttgagcagatgtacactgagatggcttcccgccaccgtgtcagattcccttgcattcagatcatcaagactgctactgtccactttaaactctgcaagcgtgacaacactaagcagttccacaagtcagatatcaagttcccactggtgtacaggaaggtcaggccccctaccaggaagctgaagacaaccttcaaagcttcaaggccaaacttgtttatgtgatccaagtcgccttccatgttctgtaagatctgccagtatggtgtagtcgtagttcagaacttaagatgaatcttatccatatgaagcctgtttttgaaaagttctggtaggtccatgctgcggtctctctaggttctcgtatcgtatcctggtatccttttcttttgctttgtgatcatctgatgcctcatactgacaattcccagtttgcgttgatattggtttactgaaatattataacgttgctattttgctcactgcttatggtagcccaattgaataatccgtaaaatcatagtctgattgaactgtgtttcaattttcttgctgtatatgctaatcttagtgacttgcatcaattgggtgttatgtgcttattacgtaattctgtaaaacgaaaaatacaagttaattcttcatgattgttttttgtttcatgctttcatatttcattggttatttgtttggcacaaccgcacnnnnnnnnnnnnnnnnnnnnnnnnnnnnnnnnnnnnnnnnnnnnnnnnnnnnnnnnnnnnnnn

SEQ ID NO: 30876 - DNA, 861 bp, Oryza sativa
  unsure (1)..(861): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagcagatagagctgctgcaattatgaggaagaagccaaattgtggggccaaggagctaaagaccatattagaggagcggtacaaggtacagattccttactccactgtttggaagggtaaagagagggccatacaaaagatttgggagttcatgggatgatagctttgattccttgtataactttaaggctgagatagagttgaggtgtcctggcagtcgagttgaaattggtaccaaggaagtaaatggtcaagttcactttgagaggttcttttgttgctttgagccttgcatcacaggtttcttgttaggatgcagaaaataccttagcattgattctacggccctcaatgggaagtggaatggccacttggcagcatcaaatgccttagatgggcataattggatgtacccaatggcatttgggttctttgatgcagaaaccactgataactggacttggttcatggagcaacttgcagtgtgtattggacatgtggaagacctggcaatatgtacagatgcttgcaagggcctagaaaatgtagttgagagggtttttcctaactgtgaggagagggagtgctttaggcacttgatggaaaacttgacaaagagcaaaactggtacagtttatggtaacttgtggccagctgctagagcttttaggtctgagatctatggctatcacatggataaggttttataagctgatccggatgttggtga

SEQ ID NO: 30877 - DNA, 46580 bp, Oryza sativa
aaaactggtacagtttatggtaacttgtggccagctgctagagcttttaggtctgagatctatgactatcacatggataaggttttatcagctgatcctgatgttggtgattggttatacaaacatcataaaattctgtgggcaaggagcaagttctcaccaaagatcaaatgtgacttcatcactaataatgtggctgagtcatggaatgcatggatcaaagaattcaaggaactgcaagttgatgccctagcagatgcaatcagagagaagacagcagccttgtgggctaagagaaggaagattggagaaaaactagaaggcagaaacattttacctgcaattgtcacacaactaaaggcagcaactagaggtttagccaacatgagagtcatgaagggagcggatgatacagctgaagtgactgagctccataatagtgttgaagtctataggcatgttgtgtatcttgaccaacagaaatgcacatgtagggagtggcagttaacagggaagccattctctcatgctcttgcagctatctccaaacaaaggaatccaatcatggatgattttgttgatcccgttttctctgttagttgctttagggctgcatatgaaggtgtcatcccctgcataactgacaagtcccaatggccaacagcgaacaaagattttaagttgcagccaccagtgcccaagcctagaactgttcctaggcaaaggaaaaacatgattccttcttgtcttgagaaggggaaaggaaagatcagaaggcaggtgaaatgcccaagatgtggtgggctagggcatagacagagcagccaaaagtgtcctcttaatgggaccaaaaagaggtaataattctaacatgttaacttgttctatattgtcttaacttgcttcaattattcattcctttcctttcttaacttgttaacttgtcctatctttattcactgtcttcaacttgtgttctacttgtgtttttttaggaagaggaaggcaaagaatattgctacaaaagctaggaaaaagaaaactgctaaggaaattgttgaaactccaacaagatcaaaggttgctagagttcaattagttgatagccctgctcgagtcactaggaggttaggatataaaagagaccttgcttctttttaattacatgatcattattgtgatgactgcataactaacatctttttttcttagtcaaacaaggacaactggaacaccaactattgctagagaaggatgctcacaagattcacctggaccagtgacaaggaggcgcttggctatgactgaagcaacaccatcacagccactaccaccaaccaagaagaaattgactccaaagaaaaaacagaactgatgttgcctttttgcttttgttacatgaaactggactcaagaaagatggggttatttatgtatttaatggcagcaaagaccaatgttaaggccagccatgcttgctactagacgtgctatgtagaaatgcagaaaacaatatttgaagcctatactattttagttctaagaaatgttccgttgaattgcgttatatacttgttattatggtgcaatgtggctgatatattttgtcagattgtgcaatttgggttgggatggtatgaacgagggattagagtgactgggatgtcttaacagtgctcctatgagagcagttgttcaattttagtgtcagtggcaatttgtgtaatttttatgttaaaacataacagttgagaagaggcaggggcaagatagacatttcacgctctcagtgccaccttggttggtgatgtggcagccatgggacccgaaattgggtgtaaaatggcagaggagagctgatttgtggggacctgggcaaattgtctaagttatttgggaagatggcatttgggaatgctacatctaagggaatggcaaatagtctaaaatcccacacacctcttcacaataaaaatatcttcctctcctctcagcaccagatccagatccagattcaaatcctctcctctcctcctcacctccacagatccactcctcctaggcgtcggcgtcctctcctccaggcggcatcggcggcggctctgccgacggttctcgggtggtggcggtgacggcgaagggaggcaaccgtgcgcggcggtgacggaaggcggtcgtcgggggccgcggcgatggcgacgggaggaggagtcgtggggcgcgacggcgactgcaacgggaggtgggggtgcagtgaccgcgacgggaggagctgttttggggcgcgacgacgacggggggcgcggtgacgactgcgatgggaagcgggggcacggcgacgggacgacaacggtgacagagggcatggcgagcttcttcttctccccctcccccaacccttccccctcccacggtttcgctggtgagcccggcttcctagatcggggcttggtacagcagaagagctcagcggcggtgatgctcggcgacggggctcgcacaaccggtgctgctcggtcggtgacggcgacgacggcctccttcctctcttctgttgttgctgtttttctttttctttttttcatgttcaaaatgcttgtatgctgtgttcacttccatgttcaaaatgcttgtatgctgtgaactctggatgaggatttgaatcgatgctcgaaaatttggaagtggatttgaatatgtacacgctgcgaaaatctgattttggggatatttttggtgtaatttttattgcagacggctggctagggttgcggttccgttttgattatttttcttccaaattattttcgctggcgggtctcattacctgccgccagtgaaaccaaatttttgttggtggccatccactgccagtaaaaatgaggaaccgctagcaaaaatatgttttcgctagcagtccacataagtcagttttcgctggcggctgccttacatagaccgccagtgaaaaatgaacttctctagcggtttttcgccgccagcgcagatgcttcatcttcattggcctttgctttgtggcggctccaaataccgccagtaaaaacccaaaatggctgccatgaaatatagatttggtagtaatgaggtgtaattgacatggttttttaattgatacatgcattattggagaatgtgtgtgcatggtgtattgattgatgtcatttaaattatcattggtcttggtgtataagtatatatgatgatcaatttaggatggagggagtattttttgatccatgcataaatacgtgcttacctaaaaacacacggatatatttagctttatgcgtgcataccctgcgtatagctattatcatagtcggaatacactttggccgccgcccctaataaaccgagaagacaattcgttgtagcctctctctctctctctctctctaattagtggctgagcatttagaagaggtggcaaagttaacatacttttgtcttaatttgcatggtttcttagtcagcttgccctcgactgtagagatcatgtccgttactagcttatagctacacacgcatcatatctatcttacgtggacgccacaaggttctataggctatataagacgatgcaggcctagatgtgtagctccacacaaacccatcatcaccttcaacctaacgatcgacctgtacgtagaactagctttgtcccaaacccaagtctcgagccccagctagctagaatccatcagctttaatttcctcccaaaaagaggccatctcagcaggcgacatggcggcacgtacgtacctggccgtgttcgctttctgcgccatcttgatgctttctgccgtggcgcgctcggcctcggccagggctttgagagaacgggcgccggaggaggcggccgttgtcgccggccgcgcaggcgtggccggcatgatgaaggtgcccgccgcggcggccggcgaggctgcagggcggaggagcggcggcggcgcggtcgtcgtcgtcggcggcgcggcggcgcacgagtccaagcggcttagccccggagggccggatccccagcaccattgatctctctcagtcgtaggtagtcgtcgcctcgtctgcatcaacacaaattaagaaggtttttttttgtatggtcgtcgatcgcccagtgctgcatgtttcagtgttcgatcttgcggttaattttgtttaccacttctgtttcttcgtcttgatttgtttctgtttttcgctttgtacggcatgtgttcttgtccatgatcagaccatgtgtagtgtagaactgtagaactcgactaattaatcgttctgcactgtatgttgtcagatagatggacaatatagacgagttcatttcgatgcatatgcatgcatacctgtgaaacaccatcggaagggaataattaatatagtgatttcactttgattttctatttctagtacaaatctactcgacaaagcgcacaagcttagttttagtaacattgatcggatccgctctgtacgtaccatcatatagatcaataagatcagcggtcggtcagtggagtatgtactcgtacaagcttttctcaagaaaccaacttaaaaggacagtgctagagtttaaattgggctgcaaattgaagcagctaaatataatcattcgtcaacgatatatatatccgagctaacaatgacacaattaacatgcattgactgtatacattgaaaatgaacgtacaacactatattcctgtgtcatgtgaaaggaggggttgtttggttggtgactaattttgcgacagctaaccttagctaaagtgtgatcatggtagaaaaaattatgtccatgaattattatgtcacaagtgtggtatggttcgaaaaaaaataaatgatttaggagtttaaagtataagaaagtatggtaaatctaagttgtggccgcgaaataaatacctatctaataattataatatgattaagatgtggcttgataaagtgaagtagtgaactaaacaacccgacacattaataagcaaattaataaagtataggaagcaatttatacacgcagcttcagacttcggctgtgtacgaagggatgcacctgctgccaactttagttatgtgctgtatagctgtaaggccgaaaggcaccgttctgcgcatatatatcgcggccccatatgtgcatagaaaatcggcatcaatgatgagcctataatattgctgcatgcttgaccataacgtgaatgtatttcttagtgatgaacttttcagaaggaaacattgacatggcactagtcaatggagcactaggtacaggcgtacagcggttcatcaaataaagacgtgaatattaggaaatggcctattatacaaataattagaaggggtgaggcttcgaatacatatcgctcaccaccttatgaagctagctggaagacccggctcttcgtaccccagcagctcatcaaatcgttgagtaactccagataacttctcaagttttagctagtgaccagcagtccaatatatacgcttgagtaaatcactaaatgtactttctactgacaacaaatactacatctgtttttaaatatatggtgctattgtcttttaaacttgatgtcgcgtttgattattcattttatttgaagttttgtataaatgtgagaaatatgatatgaatgcttgaaataccttcactgacaaaagtaagtcataacaaaataaataatacttactacatatttttttaataaaactaggatggttacacacaatgtctaaaagcctacaataaattgttgattgatcttggctaaccaggccaaaaaccgggaagtgctcagttcacccaagcccacaggcacagcttaggacgagtctccatgttcgtgtgcatacgtcctctagttttttttttttgttacgtattcttcagggggtaattttaccatcattcaaaaaataccggaaggtatcacgttttctagtataaaatttagtagcaacgtcgtattaccaaggccaccccattaaagagttcactctttgggctcgagaacagaactgcgatttacaaaattcaacaaagtgattaaagttattcatcatgatgtcatcattacaaaggcagcgttcgttccagtgagtttgaggaagaaagcacgtcgttttccgcgtgcacgcttcccaaactactaaacggtgcgttttttgcaaaaattttctataggaaagttcttttaaaaaatcacattaatccatttttaaaatttaaaatagttaataattaattaatcatgagctaatggctcacttcgttttgcgtatcttcccaatcactcaatcctctcctcctcaaacacacccaaagtttatcatctatatctaacaattaatgcttcatgtaaattcttgtagcaacgtcgtattataagtatcatccagtaaaacgtgaaatgaaaagctcatctccgtacgtgtggccttgcaagactcgacagacgattatcgcagtaggtctaaaaagaaagacctcgaccgatgccaagaataacggaggaaaaaaaaaggtagctctggactcacactgctctgacaacagtcactcaagcattaattagtttcttgttttcaatcaaggaaaagagcattaactctttaattagtctgctcttctcctatctaccgatcgaggtaagcatgcaacttttcatttttgtcattgcttgcgacgtgccttgtcacgatcttctcattctataggttcttaacgaatagggtaatcagagagatcaaaagctagtccatgccttaaaaaaaaccctttgcgattaaaagacccaagaactttttggatatgatatgccatcgtcagaaaattgctggtatctacacaagttgcattgctttaactatttttttcaggtcttaaaccaaattaaatcgattgtgctcgatggatcgagctgccgtacgtcacggctaaaccttttaattttctgctctgttcatagtttcatatgcttttcgatggggccttggtatcagacgcagcctatcgacgaacaggttcatcgagcggttgttgggttggccggttaggatggtgtaattaaaatacaggtagggtacgtttagttttgcctcttcagggttcagaaagcgtaatactactagactagaggttgacggtcgactgaatattatatgacgtgtgctagccagagcttcggtcactagctagctattctgcaaatcgtcgaagcgattggctttcttgtttcttattttcaatctccattaatctcattagcggctggtgcgcgtgtgtatactaatccggtttaatttggtcttgcctttttatgtttctctcttaatttttcgctgagatatggtggttggatcgagcaattcaagatgagtgcgcaattagaatttttccattgtagtgatcgagcaattcagattcagtgcattgtactggaaatattcatgaaaccacgctccactcgaccactccgggctcccggaggctccactaacgattctcatgtcaggatttcaattaaaagtttgtcatttccaattaaaggatcacacaattgatttaactttcagctcaagattgaataatctttcagctaaattttgcaattgtaatttaaatgggatgacacgctttttttttcctaaaatgagggagacaattaaatccttcattgcacaaagattcttggagagaaacctttaaactcaaatcgtccatggtattagtttgagaaaaggtcggtgcaggcacaggccagaatgcttactgtcaagagaagataagcaaggcatgcaccgccacaccggcaatatgcaggcagtaggcctcgatcggtctgccggccaccagaaattaaagatactagtaattaatcaatactctggctagcatgttattgatattctagtatagttagctaatgctaatgatccaagtcagacatgatcatggtccaacgcagcagatgcattgcatatgcatgaggagaaacgccaatgccttatcaactggtacctaccgctaacgattccaacattgccgcggccggccgccgccctgtaccttccatgtcggccaaaagaacacttagtatatatatatcaagcaaaaggagatcgatcgatcggtcagttcatggatgggctatatatcggtcagttcatggatcggtcagttcagggatgtttggtacacttatatagatttgaaggcaactccgagggatccacaccctgctctggatcccttggagttgggtataactctaccaagtagagttggccaaatctataccatccactgtttcctacggctgagatcatgcctcatcaaatttacctaataaattaactcctcaacattaatggttatagcttgagagaaaaattagttttttcaacgcgcgcttcctctattttgattatgttctcaacaaaaaattaagtgaaaaactttttgttcttaataaccacgtacagtcgatcaactctaagcaacagtatataccaacacagtgttttcatatatatgcaacagcgaaccatatcaatattaatatgtataattttttaataaaatagatgaagtatgaaattcttgtattaattctacaattctatagtaaaaaaaaaatcctgtgacatgttgttgatgcaagtttatttgttgcacggttaattacttgttttaagtatatattaatgttaacatggcttaatcttagccgttgaggtacacggaatggcacaaatcatggcaactccacctgatagagttgtagccaactctaggggatctagaccccgcctagctagctatactataggcgttcactttgataccatttttaaccttaccaaatttcgataaagtttccaaaaaaatggctatatttagtttgctgccaaattttagtaattatataagaaatcctgccaaaatttggcacgttgccaaaattttggcaactatactaaaatttttggtaatgccaaaatttggtaaggttttttttcatcaaagtgaaccggccctatattatccagggcggcattttatagtacactaagtctgcatgtggtacatatgtccaagaattcgagatactgatgatcgattaaaatgctaacccggatatgacgaagatactgaagatcatttaaaatgctctgcgcaatatggtgacagataaagagaaaatatgcaaatatcatcagatatgcaatgcaaaaaaaaaaacgttttttatgttgcaaattgcaggaaaactggcccggtctatcatgacgcacagcctgctcagcggaagccgtcgcgcgctttccttgcagtttcggcccgatgcaccgccacgcgtatttccggcccaaaccagcccaactgcaagcgcgctcgggcagataccccccggtgaggagcccatcgcaacgtcgccgcgcgctcgtttgcgattcttccttcccctcttctgccgctgctgccacgcgccgccttgacgccgccccgcctgctgcggcgccgccggtcgccggggcgcgcgattagctgtgcgcaccgcgagcatctcgtgcccgtgacggcacgcctttggccttcgccggcgcgccaggagtgacacgccgctgtcccccccatgccgcacccggcacccgctcgacggaatgccgagcccgagtccgagcgcgccgccctccgcttccctcttcaactccctcatcgcgtcccgcgcccgcgccggccgcgccgccgagggctttgcgctcctcgcgcgcatgctcgccgcgggcgtcgccccgacggcgttcaccttcgcgccgatcctctcctcgccttcggccggcgcccgctgcgcggcgcagctgcaccctcacatcctcaagagcgggctgctccacagcgacccctactccgggacatcgctggtggggttctttgggcggaatggccggtttgatgatgcactcaggttgttcggcgaaatgcctgtgcggagcgtcgtcacctggaactgtctcatctcttcgtttgcgcagcatggacgtgcctgcgatgctgtgatctggttcagggcgctggttcgaagcggtaacagcgtgtctgatggctctcttgtggcagtacttcctgcttttggcacaccagagcaagttcatgggcttgtgaagaaaattgcgatagattccttctcaacagttgcaaactcattgctgaattcatactgtactcacagttccacgtctttggcagagaatctgtttagtgagttcatgttcagagacgtggtttcttggaatacaatgatcattgccttcgctaggagaagcttgcctcagagagcccttgaatttttctggatgatggaaggttggagtgttttgcccaatgaaataacatttagcagtgtaatttatgcctgcaccagtataaatggacatgaacatgggaagtccattcatgcaaaagttatcaaacacaatctcaatacgagaccatttgtgaacacttcactgtttgatttctattcaaaatgtggttgtacgaaggatgctcacaaagttcttgaagaagctcctgaggatagcaccacacgttggaatggactgatttcttgtcactcagatactgatgttccaacgtcgttttttattctgagagagatgttgcgatctggtgttatgccaaacgaggttagtttgtcttctttgctcaaggacccatcagtattcgatctgttgcagattcactcgttggtaacaagattgggttacgacggctatgactatgtctcaagtgccattatatcttcatatgcttcacatgaaatggtttctgatgctttggcttatgggggtatgttagatcctgactcctgtgctgtctccatgaatgttttagctggggtatataacagagtccgcatgtatgacgaagcgaagaagctacttttacatcagggatgtaatgacactgtttcatggagcatacttatcactgcttgtgcaaggaatggtgattatgctgaagctcttaaatttttcgaactgatgagaattttggggcatcattttgatagctatgtatctgtgagcctgctaagcatttgtacaaagtctaatagccttgttcttggtaggttgcttcatgggcttatcatcaagaccaattctggttgcttagatacttatgttcataatatgttgctagatatgtatgctaagtgcggtagaattgaagaatgtctgaaagcctttaaggaaatggaagataggaacattatctcctggacagctataatttctggccttgcacttaatggtttttctcgtaaggccctggcatggtttaaagccatggaagaggatggcttcaaacctgacaaggtagcaattacagcagtcctttcagcttgtaggcatggtggactggtgcatgaaggaatgaatatattcagacatatgaagtctgaatattcaatcgagcctgagatggagcattacatttgtgtggtggacatgctatgcaagtgtggtcatttgaaggaagctgaggttgtgattagaggcatgccattccaaccaagtgctgtcgtatggcgcacattcctccaaggttgccagacatacggtatgatagatactcaagtacttagctagcaaatctgtcatacaaagtttggttatttaaaggaagctgaaattgtttgtaaaggcatgcatttccaaccaaggcctgtcatatggtcacatttctccaaggttgccaaacagattcacaaatatttagctagcaatgtttcaggtgaagttgcatttgataaacaatggaggtgcgccttttcttttttacattgactcgccagtttaccgtatatcacttcaacatttggatcatggtggatatcaaattagttttggttgatcctgtacaaaatagttagtttcgtctgtcctgcagattctttgtttatatgatcttgtaatagatggtacataactactaggcatcttcattgatcactctgcttctgttccctgcatctgctatgcaaatgaaaatgagaagtactgagttggaaatatcctaagcgatcgttcagtcacttatattcaggtaatagatgtaaggttaaaaaaaaaaagaataacgtcatcgcttaaggttctaggtggatcaatatttttactattatctgaaaaaggttgctttcatccagagagtggcaaaaggtgtggtgtaaaaggaacagcattgtcgctttcgaaacagattgcatctagtcacttaacacagtatgtagaaagattgttgactggaatgatttcagtaactttttcctctatattaccatggaatctgctgattgtgacgtacaaccgactcagttaattaatatggcttctctggtgcgagtatttcatcgtgagattatttcatggttttgacggaataaagagaattcctaatttttgtcagtaaccatatgttttgactttttgagggacgaagttacggatggatcactccatttcgtatctcaaaccaagcaagtcatacaggatcgaattaaagtcaaatgaccgtatcatttctcagctaaacagacacttagaacccgaaacgtggactctgtgttaacaatcaagtggttcttatttgtaatctcttgggtttgatttcgaccatttatcttataaaattctgcaagctgccttcttgcattatgaggaggtcagacagccgttacatgcagaggatgtggctaatcggttgcaaagatataaagagcaaatctgcaaccgaaacattaactaacctttcgaggtactacagccttttgacgaagcaggcacatagatgagcaaaatgacatattgacatataaattacatccaagcattggattttattggctactcgttttcctttccactaagcactgtctacatagctacgtagcgggctcgtatactaatggttggtgatcgagcatatttgttttgatgctacaaagtgatttggtcaaagaattcttttgaattttcatattttacaattgccttccatattacctattgtaatgtctggtggcactaaaaggtatggatatcagtagcttcgtatcaaagtcgagattgcaaatgttgatagccaggggacccagtaatactgaatgcaggattgcaattctgaaccagattgattcgcctttggtttcagctcaatatctcatgctgtacttaggaatttatccaggtaatttggcgccgtacgtgctggcggtactgcattcggcgcatagccagttcagctacactactagtcttgtccttggctttgattctactcaatgtttactgtgtgtttaattaatttcttccatcttacctgtgacatttgtgaattcgacaactccaagcactcgttgtctaggatgcctagctagctgacagtttcatccaacagcaacctacatgtagtacagccattgcaattagcatacctcacactctaatgcctaatgcaaaagccaaaaggggatatatatatcctcctcgtcgcagaaagtggcaatggtgtgcatcatggtactgatctattactagctagtagcagcaccagcaattgtggtggtggtggccagtggccactcggacgaggccagaagaaaggctacgtagaatgcgccaatgcggtggtagttgagattagtaccgaacttatccaagaaaacgccccccggccggcgccctttggcccccacacttatatgtttcttttgtaaccgtcgctgcactagttccaccgtctcctctacaccccctatataaacacacctcgcgccggcacctggccatgacaacacaaacgaacctaagctagctagctatagctcatcgacacacacacacacacacgtacgtacggtgaataatttcatcgatcaattgagatatggctattcgtagttgcgtctgcattgtgctctgcctggtcttggtggtcgtcgtggggctcgcggccacgcaggccgaggcggcccgtgccttggcagagtacgccgctccgccgggcggcgactacgacgacgacgtggctggcggcggcggcggcggcggatttggtatccgtggacgtcgtcggccggggaggtggaacgtgaggagcctacagggcggcaagcgggaagtgccgggcggcccggaccctcagcaccattactagacgacgatccgatatatatatcgagcattattcgtgaaataatctcgtctgaggctattatgatctcaaagaaataatctctctgagaggcttaggttgatcgactggtgctcaatagttgtactactaaacccttgtaactaagggtggcagcaggtagcaagcaacttgtgtagcggccgggttattcttttggcagcaaataatgttttctctgcagctagctatatatatcatcgtagcatatccatccggccatccggggagtagtagccatgcatatgtatacgtacgctagccgctgcagctatctagcatatatattttgtatacgctgtagtttgaattgtattgttattaccaacattgttgtgacaaagctagcttcagcaaatatttatatatgaattacgaacgaatgtcaaatgctaattgctgctttcgatgtccctgcattgctactttaccatcgaagatttgccaatccgaatataatcatccgtacgggtgacacatatatatacacgacaccgagcatgtggccatataaaggttccttttagaaacttttccatcaaaaattaagaaaaatatgcgcaactttacataggtcatgaatcatgattgtgccacattgcaaataattaacaaatggacgaccagcacgtcatctgactgagaaaagggatgagaaataatggctagctcggtggaaaaggctcttgtcaagatcaaagggagagcgtatagctttttcggtcaaaacgttctggccctgtttggtacaactccaacttctaaatttagctccaggagttgagtttgaagtgaagttgtagagctacctaaacccagctccacaactctagtacattttgtgaaagggctccacctaactctactcccagttttggtggagctgtttggctgagctccagctccagaaagaatggaagtagagctagagctgtgccaaacaggcccgcctcgtcgccgtcgttgtagcctaccagcaaaacggctcgcagaaggccatgacgcgggccattgttacggcctaatggttgtgggcttcttctgcgatgaggcccttcgggcttaaatcagttaacgtcgtttcggactttcgatttgccacggaaggccttgcttcggcccaatttatggatgttagcctgtgagctgacagtcttccgtctttcactaacttaaaaaacatatccgtgcgttgtaacgatgaatattattttatttgtattattgttagcaaaagtatatgggattttttttattttgatagtattgatatctagttaggaactcttattgggatgatagatatatcgtgtacgttgttatcttatgggatagcgagaattgtgaagcatataggagtctgactctcgtcccaagttaacatgaatttcttacacgactccttctgtattttcaaaagcgaaagaactaaaaaccaattcaaatacgaacgacataccaaagaatcagcggaagcatcgtcaatttttatagtaactagaaaaaaaatgttcgtgcattgcaatggttgaaggctattttaattttattattgttatatggtttagttaaggtgaaattcaccatgggtattcacttggatatatatttttttagaaaatcatgaattgcagttaggagtccgatcgtctcaagtaatctgcttggatatatattttttcagaaaatctaaacatgagctacaattaggagtctggttgtctcaaattagcatgcgagttttttttaaagaaatcattttgtattttccaaagcgaacaaacttaaaaaccgactcaaataaggatatgtatttccaaaaacgaatgaacttaaaaaccgactcatatatggatgacataccaaggtaccggcaaaaacatctttattttttataatagtagagatagagatggaaggaataagttcaccttgactcccttaactagtggtcgtattggattcgtattcttgaaccacaatactggatatcccaaagttatgtaacaatagtaacaatagtgataaactctaaaatatatttatattttgtatatctaacagtgaagccaatacctatattacaattgagcggttacctaaactctgttggtgttataaatacagttgagttgagcagttacctgaactctgttggtgttatcatgttggtgttatcacttgataaaaccaacagagtggtaaccgctcaactgtaatataggtattggcttcaccgttatatatatatataatataaatagattttctttaaaaataacggtaagtgaatatctgtacttagcatgaatatacaactgatttttatagactgattggacgattgtaaaaatttgcagagaaaacaatgattatacccttatgtcttgtttagttcccaaatttttttttaaaaacatcacatcgaatctttagacacatacatagaacattaaatagataagatgaaaaactaattgcacagttaggggagaaatcgcgagacaaatcttttaagcctaattagtccatgattagcgataagtgctacaataacccacatgtgctaatgacggattaattatgctgaataaattcgtcaagcagtttccaggcgagttatgaaattatttttttcattcgtatccgaaaaaccttccgacatttggttaaacgtccgatgtgacacccaaaaattttcttttccaactaaggccgagtttagttccaaattttttcaataaactttcaactttttcatcacattaaaacttttttatacataaattttcaacttttctatcacattattttaattctatctaaacttttaattttaacgtgagctgaagaagacagtaccgaaggatagaatttctccaacagaggcgctgcaggtttccgtcaatgtgagcgtccatctaacaagcaaccgggacggcgacgcctttgcttaattaacaccccaggcggccgcagaccaaaccgaccaccaagtcgtcatcctcctccctcctcttccttccagtgccaatcaacccaacccccgcttccctccccccctcccctccctttccttcccctccaaggaagctatccccgtctcgcctaaaccctagcgcgccgcgatgtccggctccggcgtccccgccggccgcggctcccgcagcttcgacttcggcgccgacgacgtgctctgctcctacgacgacttcgccgcccctccgagcccaagcgccccgatccggccgacaaggtattactttctcccccccccccccccccgccctctctcggcggcaacccacctttgatccctcgtgaatcgtggtgcgtgatgatcgcgtgcagagctctgaccgaggcttattgccgcacgatttcgcctcagcggtgtcgtattcccgtgaatctattcgttcaactgaatagtgtggaaacggtccgatgaaaattggctgaacagcactgaatagtttcagttttttttttgcccaattgtaacgttcacatcgatttggttataggctcgttggtactatgcagccatcgcttgctatttcattttcttcctgacgaatgtgttattccagctatgcctatctgttgtaattcagagaatatcatggatttattttattgtgtgcatcaaggtttatatggtacctgctatacttgggattttcaggtcttattttgattaaacccacactgaattcctgatgtgcagtgtaggtttgtcttgaatggtcaatataggctggagatagtcaatgagaaattcatttaataagctatcaattgaaatattcagtgggttatttctgtgagggccactgcacgagagagaaagatgcctataggatatagttttcagataattttttctgacattctgttgaataagatttatgcaagtcatgactatttgattcacacgtaacattaataccgcctatagttttcatgttcagtaaaatttttgttacatataaattagtgaccatgtgtccaggacattgctattctaggtaaggaacacaatctaatgtttagagaaaaggtggattgacgttgattttgtacttgataagtttacctatatgttcagtctgtttagggattattgtcttgcttatctatttgttcagtccatttatgtttagagattattgtctttatgggtgaatgttgaaagtccattatagcattctggaaacttctgatgacacccttggtgttgctggaggatggtattctatgttctaacaggtgaaatataaataatcacctgtgggttggtgtgttttgggatgtgttcttggtaggagggactccttgatccctcctatgtaaatatttctttcttcttaatgaaatgaagcgcagttctcctgcatcgtccaaaattatataaataatcaaattaagctattactgacatagttggagagagcattacaaaaatctgatgtatttgtttcttaaaaaatgaaatttgtcaaagatatctgcatttttacaagcaaaattaatttaatgattataatagtagaaatccttgtgctatattcatccctcattcttgtacttgtgcagcaggactttcacgacagtagattggggagaccatttggaaaagcttatgaacaagagagttacggcaaggaggatgtactttttgctgttgagaagtgcatgaagaaatatgctgataatttgctgcgatcgcttgagggaattactaatcgtctttcacaactggagatctattgctataagcttgagagatccatgggtgaacttcgaagtgatgtgctccgtgatgagactgatcaaagattgaagtctcttgagaaacatcttcatgaagtaagtaaatcactattttaagaaaaaatatattttgagactagatccagtatttcacattttccaccctttcagtttctgcactgaagggggacagttcttttgcatccagtgtaattatgatcatgtcatatactcatccatatattataccccctccattccaaaatatgagcatttctgcacgtatttcaaaatttatatgcctatttggacatccccgcgtgcagacaaaaatgcttatattttggaacggatggagtagccttttgtgttgattgacatgtacagtacatgttttctttatttgttgtgacaacttaccttttctttatactgtgtatgtgattttgctccttcgctttaaatgcatgctccaattcttatatgtatttaaaataccatctagtgaatacatagggaaatattaggcttatgtatgtttagcctagaggccctaatctcctaagttgttgtggtttttgtgggctatggttctttagtattttgggctgtgattattgtttttttcctttgaacaaaaagtacaccatttccaatctctaagaaatgtgatggtgctataccaccgtccctttcagacaaagggagagatgtcttcctggtctctcaaaggctgctccctactgacctgttcagaggttaatgcacataaatgtccttcttgttttgtactttcttctgataaactagtcttgttgcctgttgtgcactcgaagcctggaatccactcttgaatatactcagtatgtctaatgtataccctgtgactcaaccaggattggcaacactcctctgtatttaaattggcaactgtggttgataaataagtgatccctgtgatggatctgttctaacatcttataagttcagagtgcacaaatgctaagggtatacatcatctcatatgttccatgccagacatgcatctgttgagccataatggccatttggagtcttaggtgctaccacgagcttcaagatgacacttatttagaatttggagattaaggcctgaccacaaacttcgagtatttctagcaaacagaatatttaagtatagttcattcttggtattcatcgagattgtcctgcagtctaaaatgacatgcacgttgcaaaacattttggctatcacagagctgttgatgggcacatgaccgtatccaagttcagaagatgtgacaatttattattaaccaacaattcaatctccaaatgtttaatttctttactgtttatgtactgtattttatatctttgagcattaattctctgttgagaagttttcaagtttcaactctaatcaaattttcaaatgatgcaggtgcacagatctattcaaatccttagggacaagcaagagttagctgaaactcagaaggaattagccaaatttcaacttacacatgacacatctaaaaagaaggaagatatgccaacaccatctttccctgagcaaaagacgcttgaagaaaaggcagatgcacctggtcagcagctggcgattgttttgcctcatcaggtgaactcatcccttgcacctagagcttctcaaccagtccaacagtacaaagatcagacagtgcagcagccacctagctcttctgtaccacagcaggaccgttatgttcttagccaagccattgtttactacccacagcgtcaagctccaggcattcaggatacacaggggcagcaagtacaaccagaggtgcagtacttgccagtaaggccttcagcaacgcaagatgttcctgtccatgcttcatctcaacagtctcaggcagcaaatcaaacccagcctcagtctttccctccctaccagcagcagtggccccagcaatcttcccagccggctcctgcaccagtggcccagccacagccgactttctcgcagccatttcctccacctgtgcagcagccccaattatctaacactcagcagtttcctccacaaccaatgcagcagccccaactatctaacactcagcagtttgctcctcaaccagtgcagcagcctaatgctcaacagtttcctccgccaccagtgcaaccgcagcaatctaacactcagcttcctcctcaggcaatgcaaccacaacagcatcctcctgtacaaaatcagatgaggcctcaaactccaccaaactaccctcattatcaaccccaccagtccttgaaccctccccctgaaactctacctggcagcatggctatgcaaggaccatacaacacggttgctccggcagcggggagccgttctgaagtgccatattcatacggaggacctggcatgccaccaccgcagcacaacatgcaaaggcagcagctacctcctccaagccagggctctttcggacctccaagtaaggggggctatgccggcccgccacaatatgcgccgcagggcagctcacatggctacaacactgcatatggctaccccccaagtggtccttcagcagcccaggcacctcagatgcctccagctccaggtaatgttggtatgagtcacccaggttcgcatcagatgatgcgcggccatccttatggggaaatgattgagaaggcaatcaccatgggatatcccagggagcaggtgatgaatgttattcagaggatgaccgagagtggccagccgatggatttcaacacattgctggaccggttgaacgaagcagggtccggagcaccccctcgtgcgtggtgatttcgtcctgggttgggtttggacctctctccatcccggcacggcgctcatacgtgtgcaaagagtggtactatcgtgtagtagttgaataaataagatttgaagtgatgccatctgttgactgttgcgtatttgtacgatgtacatattatacattgatcttaatcttcatgtacttcctgcacgtgtaccaccaacttctttgcaattggaccatttcagcagatctgtgctaatccaaattattgccaggtatattgtcattttgcggtgtgaaatgtcaggtgattgttgccagttgctacttgtgtttttaaagttgcatgtaaattgttccaacttgatcgagcatcttttacctgcagaagtgcagagacggtattttctgatagtatatgggtatttcctcttttacagttttcactttgctcaatcaagttgcgtgactatgtgactaataaaaaaaaaagtaaattttataaaactacatgttttatggtctaagttgaagaaaacaacatacactttgatatttggcatttaattacatatattttggtcgtgtagtttcacaaaaccacactatcgatgaatggattcactcgcgagatgatgtggttgtttcacataggacgaggacatggcatcatattaccagccatcagacaaaattaacaggatgccacgtccccatcctagatggaacaaccacgtcatctcgcgggtaaatccattcatggatagtgtggttttgtgaaactaaactaccaaaatatatatacttaagtgccaagtgttaaaatgtgtgtggttttctacaacttgaaccataaaacatgtagttttgtgaaatttacttaaaaaaaatacgagaacacccgagtatgggtgtcgtgacagcattttccacacgtcagcaagcgtgcggatatgcactgaacgggctagaattttgaattcggattgacgcatgtgtgagttggaacttgagctcacgagtaaaataaacgggcctacgatcctgagcgcggcctggctagaaaaaagaggagtgtggtatctgtgctccacctccacggcgaaaccatctcaaatgcgctgacacctgggaggccgagcagggaggaacgaaaactcaataaagggtaatctctttctacctactatatctactaatacctagtattgcatagcaatctcactgtatgaatctgttcttcctgtttctcagcatctcgattctcctacaattccgaccaggttttaggaagagatcgaggagcagctgagccaagctgagacgccgcggcggcggcggcggcggcggccaacccatccggtgagacccttcccctctccgtttcgctagctcgtcaccgctgcctctgccatagattcgccagctcgagcttctccggctcaggggatttcctctcccacggccaccggaaccgacgatttcgattcgattccgagccgacgacgacgaggccagtggcggttcacgcagctgcctccgccgctgcggcgattgacgtgttcctcctcctccccctccccccgaatatgccggcgccatctctctctctctctctctctctgccgttttccgccgcgcctgacaggtgggcccacgttacagtcccgcgggtcaaaccccttggtctcagtagcgaaactgcccggtcccactttccagtggcggatttcctcgagccgtgcggctacccgcacaccaagtgtcccccgttctttattcagagtgcagtgcagtggagtgtggtggatctcctcctgcatgctttgcttgagcctttttgcttctggcgtcaacctctcaacccagataataaaacgcgagcaatagcgtttagcgtgtgcggtcgcttaaataattggcactttggcagcaacatatggtttgtttaggggttcatcaaattcaaatcatgggtagaaatagccgggaacacccagtggtagttgttttcttactaccgccgattttatatagagtttttttttttatcttcgcttctgaatgaatagaccttaccgtttacgagctccatagtccgtatttctaattctccatccacatccagagagattcagattgcggtgtgatagaaataggctgtgaggtgtcgctcttttgtgattagtgcctactctagtgcaccgaaagctggcagtgcaagctcaataaaagcttagccaaaaaagcgtcttagaggcgtaacacagaaggatttagcaccaaatatgccatacgacaagtgttcctgggtcacaacgacaagtcctcaaagaaagatgatagttgctgtcagtgacatcataaaaatttgatgctcctagcaaaagaagaataaaatcaccgttttataacatttattcagtgtggtcaaggtatcgatcccgtctgaggttcaagaactgatacgccattcaccatctttgaaacttgtacttacttaactgctgtaattttttcccctgttattttatccatatctgacgcctagtagttctttcagttttttagggggacatcgcacgtgaatagcatgtaagcaatagtatccaattgtttctctctcaaaagaaaaggtttccaaatgtagaaaagatgtttaaaaaaagtgagagacccttatgccatatgaccaccaacattaaaagttatgctcttgtcactccctaattcaaaagtttctcatgcatcgaccactttctgtttcatctcctgaaaatggagtgaatataaggctagaccacactcatctgcacaaaattcactcctggtttctcaaatcaacacctttgctctcacccaaattccgtagcttgagcactttacttaggctctgttcgtttcctggagttcccaactcccccatctcattttccgcgcgcacgcttttcaaactgttaaacggtgtgttttttgcaaaaagtttatatacgaaagttgcttaaaaaaattatattgatccatttttgaaaaaaaattagcaaataattaattaatcacgtgctaatggactgcttcgttttccgtaccggagggatgggttcccaactcaaccaaaagaacagagccttatagggtgtatatactagtatggtcttacctttatcttctttcatcgattcctaccacaccagatgccatacaacacaagctaacaaaacctgagtgcgagtggatggtgagatttactccagaccattacaccaatctgtcccattcacttgtagacttgctttgctgacctccccttttttttgcttacagtgcatcagtaatccgtagcctaccagtagatcacaaatccattgcatatccctcctccaaaaaaggagtcacatcttctcatcgccatcatcattagttcattttgcccccaccggaaaatccagcgcacagaaacactagcggcatggttagaaaccccacaagcaaagcaaccaaaccgagccccaaacccacacccgcctactaggcggcggctatgatgcaaactgttgaagcgatcacgcacgcctcgcttccgcctaatccgaaggagacaagcaaatcaaacaagcgaacaaaagcggcagcccgaataaaccagctgcgcagcatgtgattcccacctaggttcctcccatcatcccgtgtacttcttcgcttcaaagggctcacactcgtcgagtgatttttttgcagctggctgcgtgagacggggagatgagcttgctgcggaaccgccgcgccgcggcggcggcgggttcgggggagcagacggtggtgcaggcggcgtacaacatcatcccgatccaggacgtggtgatgcacggggaccacccgtcgctgcaggtgccggaagtgcgggcggcggtggaggcgctgtcgcacgcgtcggacttcccggcgccgccgctggcccgcgtctgggacccgcaccgcgccgacatcttcgactggctcggcgccaccttcgggttccaggcggacaacgtccggaaccagcgggagcacctggtgctcctcctcgccaacgcgcagctccgcgccgcgccgggattccccaaggaccaccccatcgacgtcctccacctcaccgtcgcccgcggcatccgcaggaagctcctcaagaactacacctcctggtgcgcctacctcggccagaagcgccacttccgcgtgcccagcggcggcggcggcggccgccgcaccggcgccgccaccggcaacgacgtccgcatggacctcctctacacggcgctgtacctgctcatctggggggaggccgccaacctgaggttcatgccggagtgcctctgctacatcttccactacatggccctcgacctccaccacgtcgtcgagcagtccatcgacatcgagacagggcggcctgcgatgcccgccgtgtgcggcgaggacgccttcctcatccgcgtggtgactccgatctacaacgtcctcaagaacgaggtggaggccagccggaacgggaccaagccgcactcggcgtggaggaattacgacgatgtcaacgagtacttctggagccgacgagttttcaagcggctccggtggccgctggatccatcgaggagcttctttgtggagcctggaaagactgggcgcattggcaagactggctttgttgagcagcggtcattctggaatgtctaccgaagtttcgatagggtatgggtgatgcatattctgttctttcaagctgcgatgattgttgcatgggatggtaaaaccccatgggttagcctcagattccgggacatccaggtccgggtgctgtctgtgttcatcacttggggtggactgcgctttgttcaggcaatgcttgatgcgggtactcagtacagtctcgtgtcgagggagacaaaaacagtggctgttcggatggtgctcaaggtgcttgttgctgcagggtggacaatcacattcagtgtgctctataagcgaatgtgggatcagcggtggcgagatcgcaggtggtcctttgctgccaataccagagtgctgaattaccttgaggcagctgctgtgtttgtcatcccgcaagtgcttgcgattgtgctcttcatcatcccttggattcgaaattttctggagaaaaccaattggaaaattctatatgtgctgacctggtggttccaaacacgtacatttgttggccgtggtctgagggaaggtctcattgataacatcaagtactccatattctgggtgtgcctccttgtttctaagtttagcttcagctactttctccagattaagccgatggtggggccaacaaaggtaatcttcaaactccatgacatcaagcgtaactggtttgagttcatgcctcacacagagcgccttgcagtaatcatcctgtggctcccagttattatcatttacctcatggatatccagatatggtatgcagtcttctcatcactaacaggggcgcttatcggccttttctcgcatctgggggagattcgcagtgttgagcagctgcgcttgaggttccagttctttgcaagtgcaatgcagttcaatttaatgccagaggagcacctggataccgttcatggtggcatccgcagcaagttctatgatgcaatcaatcggctgaagctgagatatgggtttggccgtccatataggaagattgaagcaaacgaggtggaagctaagaggtttgcactggtttggaatgagatcattcaaacatttagggaagaggacatcattagtgataaagagcttgggcttcttgagctgccggcagttgtgtggagaattcgtgtggtacggtggccttgtttgctgctaaaaaatgagcttcttcttgctctcagtcaggcagcagagctggtggctgatgacaggacacattggaacaagatatgtaacaacgagtacaggcgatgtgcagtaattgaagcttatgacagcatacgtcacttgctgctggaaataatcaaggagagaactaatgaacacattattgtcaatcagctattccttgcatttgatggtgcaatggaatatggaaagttcactgaagaatataggctaaccttattacctcaaattcataagtatgtaatctccttagtggagcagcttctattgaaggacaaggatcagatcaagatagttcgtaccttgcaggatctgtatgatcttgcagtgcatgattttccaaaaatcaagaaggactttgaacagctgaggcgagaggggctagcactatcaagaccaaccgaatctcagctgctttttcaggatgccataaaatgcccagatgacaatgatgttagcttctataagcaggtgagaagactccatacgattctcacatccagggattctatggacgatgttccaaagaaccccgaggctcgtcggcgcataactttcttcagcaactccctgttcatgaacatgcctcgtgctcccaccgttcagaggatgatggcattcagtgttttaaccccatattacaatgaagatgttctgtacaacaaggaccagcttcgtcgtgagaatgaagatggcatctcaatcttgttttatcttcaaaagatttatgaagatgattggaaaaactttttagagcgcatgcaaagggaaggaatggctagtgatgatggcatttgggctggaaaattccaggatctccgactttgggcctcgtacagggggcagaccttagcacggactgtgaggggaatgatgtactactacagggctctcaagatgcttgcttttcttgataatgcatctgaagtagaaattacagagggaacaaaacagctggcttcttttggttcagttcagtatgagaatgatgtatatcccatgaacgggggtttatcacaacgacctcgaaggaggttagagagaggaacaagtactgtaagtcaattgtttaaaggccaggaagatggtgctgctatcatgaagtacacctatgtggtcgcttgccaaatatatggaaaccagaaaaaggcgaaagatcaacgtgctgaagatatcctaactcttatgaagaaaaatgatgccctccgtgttgcttatgtcgatgaggtccatcctgagattggtgatacgcaatactattctgtccttgttaaatttgatcctgtcttacagagagaggttgagatataccgtattaggttgccaggtcaactgaaacttggggagggaaaacctgaaaatcagaaccatgccatcatattcacacgaggtgatgctgtgcaaacgattgatatgaaccaggataattattttgaggaggccctcaagatgcgtaacctactagaacagtacgactattatcatggaagccagaaaccaacgcttttgggcgtccgggagcatgtttttactggatcggtgtcttcacttgcttggttcatgtctgcacaagaaacaagctttgttacccttggacagcgagttctagctaatccgttgaaggttcggatgcattatgggcatcctgatgtatttgatcgcctttggtttttaacccgaggtggtataagcaaggcatccagagtaatcaatatcagcgaggacatatttgcaggtttcaactgtaccctacgcggtggcaatgttagccaccatgagtatatccaggttggtaagggacgtgatgttgggctcaatcagatatcgatgtttgaagcaaaggtttctagtggcaatggtgaacagaccctaagtagggatatctacagacttggtcataggctggatttctttaggagtctttctgtgttctatacaacagtaggattctacttcaacacaatgatggtggtcttgacagtttatacatttgtttggggacgcctctatctagctctgagtggtcttgaggctggaattcagggtagcgctaatgctaccaacaataaagccttgggtgccgttctgaatcagcaatttgtcatacagcttggcctcttcactgccttgccaatgattatagagaactctcttgaacagggttttctgcctgctgtctgggattttttcactatgcaaatgatgttttcgtccgtgttctacacattttccatggggacgaaaagccattactatggccggacaattcttcatggcggtgctaagtatcgtgctactggccgtggttttgttgtgcagcataagagttttgctgaaaattacaggctgtatgctaggagccacttcataaaggcaatagaacttggaatagtattgactgtgtatgcagctcacagtgtgattgcaagggatacacttgtttacataatcatgatgatatctagctggtttctagtggtatcatggatcatggctccatttgcttttaatccatctggctttgattggttgaaaacagtgtatgactttgatgatttcatgaactggatctggtaccctggtagtatcttttctaaggctgaacacagctgggaagtttggtggtttgaggagcaggatcatctacgaacaactggtctttggggaaagattttagaaatattgttagatctcagatacttcttttttcagtatggggttgtataccagttgaagatcgcaaatgaaagcagaagtattgctgtttatctgctttcctggatttgtgtggctgtgattttcggcatttttgtcctaatgtcatatgctcgagacaagtatgctgcaaaacaacacctttactaccgggtcatccaatctggtgtcattattcttgcagtgctagtgctgataatatttctgaaatttactaaatttcaaatcattgacatcttcacaagccttttggcattcattcctactggttggggcttgatttccattgctcaagtgattagaccattcattgagtctactgtggtctgggccagtgttgtttctgtggcacgtttgtatgagatactgcttggggtgtttgttatggcgccagttgcattcttttcctggttgcctggatttcaggaaatgcagacgagggtacttttcaatgaagctttcagcagaggcctccagatatcccgcattcttgctggcaagaaaacaattgcagtttgaggtacagtacaataagccttgatgaattatttggcctgtttagaattttttttttgtgagaagcctatttagattttctttagcattaaattggattaacagatatatctttatattttaaactgttcgcattttgctatggaaatttgatgcttacataagaactaaaaagacaaaatttagtttctatttggatctggttgtatctcctttcattacgggcggggggacaaaaacttatcgatccgagaaaagagcctattgtccaataagagctttcagtaaatagctcttaccttccctgtcaaacagaaacctaagtgtgcatcaaagaaagtgtggtcactttgataaaattttacttattaaaattaacaaaatactgtcgttacataggtactccctccgtccctaaatatttgacgccattaacttttttaaacatgtttgaccgttcgtcttattcaaaaaatttaagtaattattaattcttttcatatcatttgatttattgttaaatatacttttatgtatacatatagttttacatattccacaaaagtttttaataagacgaacggtcaaacatatttaaaaaagtcaacgacgtcaaatatttagggacggagggagtataaaagtctcatgtttatcctctacctgctttttatgtacttgcacgaaaccttttgatgcttctaatgaagaaatcagctcgcccttgtatttccatctgttattggttatagtcagactcacagatgacacctgcttagcactaccaccatacctataccaatcaaagctgaactgtgatttttatgaaaattgtgtaaaacgtatacctctgttttatggcagtacactaaccatctgctgtaacacaagataacgatagcaggggcttaacttggtcatatttcttgcaattgtaaagatcaaactgtgcattttcagtcttacttccgatgattctgactgctgattttcttttgccaggctctaacaaggttatcgcagttaggccgtcctccgtcacctctgtacagcttcttatgcaatgtggaaggctttctgtttactgatatagcttagatccatattgaaccttttagatggctgattagcttcagtcatcttactctagatgttcagatttgtactgagtaatttaggcctctccagttttgcaccttcttagagctagttgtatgtagatgattctgttgcagcattacccgtgaactctaatggcttgtttgttaacctggctggatgttccattttttgcgcctggaaaatcaaagtgcaattgccctccttctgaaggttcacctttgggtgtcatttctctcatttcctgggaagatgttggaatgatgctgcctggtggtgttagccaacgttggcctgaaagatttgcctcattggcagaatgcagcgagtattctatcgtctgtaactgtaagcacaaatgcttcgaagtattgctttaaatgaaaattagtagaggcacaattggtgcttcgatgggcaaccttggactttcggtgcagcttggtgccttggtcgagcataataacaacacgtaaggtacgggtttaggttgattgcccttcccttgcacgcaaagatgctaataagagttaatgatggctatgaagataagtttatctgatggatgcttttagaagtgatgctcgaaaactctattcgaaagtgtcgtcctatcatatccaactcgaatcaaataatcacatcattattcgcgagatgagcgtagctcagtttgtttttatccggtggaacataactgctctttccatctcattttaaccataagtttctgtatctaattttgattattcgtcatatttttctttaattagtatttttgttagtgctttatgtgtgacttatgtttttaatattttttaaataaaacggacgattaaagtttggcacgaaaaattatggctgcacttaaaatgagatggataaaggagtatttatatcgagttattgataggtctaatatttcaacgatgctcatgtacacggtggcgtatgtgagtgtcttttttttattttttttaataacaaatactcaggttattccctaaataactactactctactcaggggcatagtagcatagcatagggtatcactcatggcggccaaattcccaccgaactgaacctcttccttttttttttcttgaccttttggcaaaggagaagcggataatactccttttgatccatcctactggacccggtaatgatagcgtctggttttaacaagtcaccgccgcgcgcgtcgctagtggtggcctcctcctcgatcgcctattaaattctctccccgcctcatctagggtttggccctccgtgtaatcctattcctatctctatccattactactctccagtgttcttttttccgtacccatggcggcggcggcggcggcggcgaaaaggaagccggtgttcgtcaaggtggaccagctcaagcccggcacgggcggccacacgctcgtcgccaaggtgctcagctccaagaccgtggtccagaagggccgcgccgccgcgggagcgggcccggcggcgcgtcccacgaggatcgccgagtgcctcatcggcgacgagaccggctgcatcctgttcaccgcccgcaacgagcagggtacgatctgtgtccccattctgtgcatagtattcagtttccgttaccacgtttgcttcctttgacgaggctggttttgaagtcgcatgcttagtgttaaattggtacaataatgtgcgatagtatgtacttgtaggtgtttatctgatatcaggcaagagtatactactgtgttccatgtaatgcagcatgtggtttttagcacaaccaaactaagattaacgtttggttccgaaaatttggatttaaatgtaaaatatgcttggctgctggctggtgtatccagttggtaagattgaggctatttgtgtaacccaaatggtacaggtgtcactttctatatttatctgtgtaaggttatgtaagtacctgtacgtctgtacttgtgaactgtgcatcattgcatgttttagttgattgccttctgtttagttcttaatctctgtagaaatatttgcttgaaaactctgggtgcatgaaactgcaatggcatttgatagattattcttgagttgcgcaagttcaccctctgcctaattagtgttttggattagttcatatatgcatgacagtatatgcttttgagcacatcatttctgaagctggttggatgattgtcttttttttttatcggtgatagattttaacatgccttgctcgtatatgcacatatctaattttactttgcttattatcgtaagtgtaattcataaatgattactccaaaatgataagtacatgtcctatgcatgattattcacatgaatggacaattagattcataacatgcccagtccctgaccttttgcgtattatagtacaaacgtaattcaagaatatcttcctaacttatgtagtgaacaagtttttacttgggtgatgtctaacaattgtattctatttacagttgacctgatgaaggctgacagcactgttattatccgcaatgcaaaaattgatatgttcaaaggatcaatgaggcttgctgtggacaaatggggccgcattgaagtgactgaaccggcaagtttcaacgtaaaggaggataacaatctctcacttgtggagtatgaacttgtcaatgttgaagggtgagatcgtgttggtttcgttgttattcagaagttatgtgttccaagcctatttggtcaaattctaccttttgagttggctcaagaaagtgaaagatgaaggagattctgaggttaggttgtagcagttggtctgaactgcttcatgtcctcctatcgagcatttctatgtacggatgggtattagcctattaggtgctgcagcagttgtggttgtaagaacaaatgtgatgtgagatgatcagtcaatttgctgctgcattttgagcctctaaaaggatatgatttctaggagataaattgtctgcagtgcttctgattcgaaccgtagtaatcttatgtttgaacctctggtccatatgggcaaaaattgtttcttggatgctgagtgtttccctacatcgttgtttgttatatatggcaccaccttcccctctagaaagaagctagcttgaattacaatgctctaacagttgggacgcgatggccaccatggagatagaggcctctgatactgctcgtcaacggaacagagagtaacggcgtctccagcttaatacaacacgataatactgtactgctgtagtaataaggtacgaaactgtcgctgtacataatacagtaacagtgcagatagaagcaaaccaatgtagaattagaaaatttccaactcagcattattttctcagcgggacttaatcagtagtaggccatcaatagtaaaatcagttggacaaccggaggtaagcgtcgcaacgatcaggtaacaatcttgtagacgcttacacagaccaaaatcccagaatactgaacatgtcgctcagaagacgccgacggaaagtactttaaattgaataggaggtatctcgtagcagctatcgtcacatcaggctccgataacaacaaatcatccatctacaaatagaaacgcaacaatctaagatccaatttttaactgacagcgtaaaaagttacagccaaagaaataaattttcttttttgttttaattccacgaattacaaagtgataaaacatgaagcaacagaaatgacaaagtaaatactagcatgtcttcatctcagacaccctccattgtcactaatcacagacctatagagatatataatgtgtcaaaaaacaagtatatacaagaactaaaaacataatcatggtttcattgtagcttattataattccaatagcatgatagcaggacaaataaactgcatacatcattaggtaaggtccaaggacatcgaatagcatggtcccgaatgatcacaaagaacaaacataatcatgtagttcctagttaattaaaaggagaaacaagtaccctggcagagatttatatgcgtcttcatctttcattttttgtgcaaaccatggcaggaaaattaatagaacatgactatgaatatatgctaacatggatgctccttaaaaccttgccagacctgtagatttgagttgacgggactataatctgctacattccacctagagtttgtcacacgtcatcattgccagctgggccaatacaaaagaatcagtgtcccttttgcctcaaatttgtaattcatgatgattagcacattattataaattgaaactctacttcaatattaaacctacaaattacaaacagtttcaataaaacctaagggggtaaacgatcgaactaaaatggtctatgatttgaaaatgtcgctcttgggagagttttgatccggcaacacaaaaggtctaaatgtatgcttgtgacataacacgagaaaaaacaacaaaaggataactctaaattatccggactgtggaatagcacgatgaaacatagtttggttttcatttcctgcactccagctacatgtttacttattaatgatgaagcgtacaatgcattcctttaaataaaggtatcttgtctccgtaaatccttcagagccataaattagtgatgggaactatccatcaacagttattagtatgtgaatccttaaggtttattcacctttggtgcttggtgttcatctagtttcgtcttgacctacaacaagggccatgcgaaaatataagattggtttcaacatgacaaacttcaggactactacattttaactttaatctaggagagtgctatatagtttgcataaggtttgtcatcacactcattccctacaacaagggccatgcgaaaatataagattggtttcaacatgacaaacttcaggactattacattttaactttaatctaggagagtgctatatagtttgcataaggtttgtcatcacactcattccttgatgttattataggatggggctattaattttgtgcactgaagacacttaacaaacataatgccaaaagcctaaggaatgtgtcacgttatattagcaaggctttgtccgtatagaatgtaaaggagttgaaacataagaaatccaacatgtttggaattgttcatctaacaaacaagtgtccaaaatgaccagggaacaatgaaaaatatgctctaaaggagttggaaacaaggactacaagtctgcaataaacatggattaaagctgtaagcggaatgcccactgcagcaaagatgaattgaaataaataatgtgggacagtccatttggtagacaaaggaatgcgaattcataattacagttgaaccgattgttttcatgtaggactctaaattagagcctggtcctcaacttattatacttaggtgttgatgaacaataatacatctcttggtagcacagctacaactaacaaacatctcatcctattaccacttaatagtgcttgatgtctttctgatctgtccaaaccagcacctaatctattccactctacagtccagcaacaaacaaatgcgctccataactcaaagccaatgtaccgccattggaaaagcagttaacgggattgagatcagggagaaattattaccttcggagagccagccaaagctcctgcacgcaggggcagcgaggagcgacgtcatgagcgccgacgccgtggcgctgtgcatgggcatcagcgtctccaagcagacgctgctcatctccaccggcgacctgcagaatccaaaaggaaacaaaaaaaaacacaagcactaaactccccatccagatcaaggaaagcaaacaaaaattcctagtgaaccagaagtcctcaactccgagatctcgcgcgtacctcaagatgagacggggagcagcggcgggcagcctcctcgggagcggagccggcccggctcgggatgcggctctcgcggcggcgccgcggatggacgaggaggaggcgactcccgatcgaaggaacgatctcgcggcggcggcggtggccattgcgtcggggcgggtgcgcagtgcggtggcgctacgccggcagaggacgggggcgagacgctaaaaccctacggttagatgggcctgggaaacgtgaacgcgtacttcgtttttgtaacccgcggcccatttcacagcgtccagcttgggtaagcatcgccacggcccgcgagtgtctcagcccgccggtccgcgccgtgctccgtgaggaaaaagtgcacccaaggtccctcaacttgtcatcgaattacaaaatcgtcccccaaccacaaaatcggatatccggcgtcacccaactaaccaaaaccagtcataataggtccctcgacggttttaaccccggttttgtcctatgtggcggcagactcagcgtgagacccacgtgggccccacatgtcaggctgccacatcaaccttctctctcctccctcctctctctcccttcctcatctctctctcccttctctaactcagccagcgggaggaggagggcggcggcagctgacgatgggcgacgtgggggaaggagcggcgcgcggactcctccgccgaccgccgcccacgaggcccacgaggcagaggaacagcggcgggcgatggcaccgcatcggcctcgtcggaggtgagcgcggcggccccaccctcctcgaccgcgcggcgcgcgaagagggcccccgccgcggcgtcgaagtcgggcgtggagacagcgaggtgggcggcggcgacggcggcggcagcagcggcgagggtggggatgggaacggtggtcagcgggggaaggggaggggagcaaatcgagggcggcgcgggagaccgggacgggaaggggagcgccgccgatggttgccgtcacgcggggaggaccgtggtggtcgtctgccttccctcctcccccacgtgccgcgcggcgccattgccgtgaccgtgcatcatcgttggggtgaggcggctggcggctggcgaggaaggagcgcggcaaagaggagggcagatgtggtggcggtggcgtcaccgattcggcggggaagagggacggcgcggccgacggggaaggagaggcggagaggagaaggagcagcgaagagggtcggcgcggccgacggggaatgagcggcggggaagaggagggcagcggcagggaaaaggcagtgtcggcgggcgttcgcggtggcggagaggcagcggccgcagcagcaacaggcgagcgcggctacggatggggagcggcggcgccgacgactccgcgccgcttggcctcatcgtcggcggcggcttcgagtgggggcaccacgccaccggcttcttgtcgctcgtccgtgacgggggcgccgcgccgccggcttctcgtcagttgtccgctgggccgcggccggaacggagtggcgagcgtcgacgacgacgaggcctacgaactggtgagcggcgcggacctcttcatcggtggcgacatcgacgacgagggcgagggcgtccgtgcatacctcctccgcctcccccgccggccgcagccgcgcgccaccatcgccgacgcccgacggcagcgacttgatggcggcgtcgtcgagtcaatctccgcatgatggcagcagccgcacgcggccatcgccgaccgcactaggggaatggggaggctagcgagcccgcgcgcagccactcgggagccaccatcgccggccgcgcgcgttgccgctcgtgtgagagcagagagcgaggaggaggaaggaaggagagaacacggagagacaagagggggaaatagagtatgtgctaatgtggcagcctgacatatggggcccacgtgggtcccatgttgagtcagctgccacataggacaaaaccagtgttaaaaccgccgagggacctattatgaccggttttggttagttgggggacgccgtatatccggttttgtggttgaggaacgattttgtaattcgatgtcaccttgggtgcactttttccgctccgtgatacgcgtgactcggcgtgcgtgcgtgcgacggtgcgagcaagaacgggcagcaattatctgggagagacgcgctggcgcgcgggggattagtggatgatacaggataagtggggaaggagaagcgcggcagtggcacccgctagccacctaccttgcggtccagccaatgccaatcagcgtcctaacaaaaaggcggggtcgttaatgctagcgggcgcggaacaaaagaggtttggtgggcttttcctacggaggcgcacggtcaatttagagcaagtttaataatagagccatccataagtataaggttatcttttttttttctcctcgtctctctatttctcacctatacatttaatgtatttattttgaaggatgtgaataaggtcattcccaactcaatgactagaataaggccattcccaacccaatgactaggatggtgtccatagtattaaataagctgtcacctaggataaaaaataatatggccagtgaataaatgaggaaagagaatgaaaccatatattgcatgagacatggtttctacacaatatccaagacatcgtgtgaggtaagtagtattaaatttaagtatggaatagtggtgtttgcattggaagagtagtgtctagtactagtttcttgatgatgtggaatttatggaaattatgtctagtgttttgggttgggaatggcctaactagctcttgcatgagggccaactctctccatttttcaaattatctttcctccacataagactatagttggcttatactccctccttccaaagatctgagacatatttcattctttgatttttccagaaatctaagtcctatttgtagttactacgtgctaaattaaattgttaatcgaaaaccaagaagttattctaggactccctccatactcataaaggaagtcgttttagacagtgacacggtctccaaaacataactttgacttcttttttctataaaaatatttattgaaaagtgatatatgtatactttataaaagtatttttcaagacaaatctatttatataatttttatattttcaaactccacaacttgagagttattcatgatttatatttctaatgtttgacttaaacattgtcataaacgactttctttacgagtacagagggagtacttattggttgcatgttcattggttttgccacatgatgagtaagttaattgtttcttggtattgatgcaaaaaggaaataggtctcagatttttttgaaggagggagtagtgagtagtctactatgtattatatttgctcttagacctggcacgtaaaacgaagcagtgtttagcgcgtgattaattaagttttagctattttttaaaaaatagattaatatgatttttaagcaacttttgtatagaaactttttgcagaaaatccgcactatttagcaatttgaaaagcttgcgcgcgaaaaacgaggagggagtgttgggaatggctgggatgggaacgaacgcagccttagagcaagtttaatatatagtatagctaactactagctccaaattatctaaagtcaatttaatagccaattcatacaatagttacctttaaacatatactacactattaatacatggtcccacctgtcatacacatattacatcttggaatccgtgctacagctggctacaaatctttagtccactattattctctctactcttttatagcaaggttaatagtatagccaactactagctccaaatcatctatagttaatttaatagtcaattcatacaatagttacatactatattattaatacatggtcccacctgttgtatacacattgtgtcttgaagtccgtgctacagctggctacaaatctatagctcgttgctcttctctcctctattatctcattaaaatatatttatagttggcttatagcctgctattgtacatgctcttaggctgtgttcttccccatgggtttccatcccacctccctcgtttttcacgtatttcacgtgtacgcttttcaaaccactaaatggtacaagttttgtataaaatttatatagggaagttgctttaaaaaatcatattaatctattttttaatttttttttataattaatacctaattaatcacatcttaatctatcgctccgttttttataatctgctatagcacctgctcttatgtagcggtacacggtggtcactacagcctgccgattcattggtacaccgtggtacatacagcctgccgattcattattactgtactcgtgtacgagatgccgctgggacactgcgcccgttgccccgtgctccaattctctctaccttggaagcatttttcagccgagtctggaaatataactcaatggccgctacgttcattaatgaccgacggggttggttgtatcgtacgcagcgtttgcaatgccccggtaggtacgtggtttcggttcgttgtttggtgcagacagcaggatccggatcatccaaatccaagtgggggcaatacttccgtgactttcgttatgcatgcgcctcgatcggggagaacaaatcatggcctacatagagttagttcgtcaaaatggcccaaattatagtgtgcaactgtgcactatccagcgggagtccacgatagaatactgactccagtaatgttcggcaaaaatggcacaactcctatttctcccagtttactgcagagatgttaccagcaaaaatggcattgctactgaaagagcaatcacgtgctacaagcagggctgtctgtgtaacccaacaaaacagagacaaacaagatgctcctaatcaatcatcgtttgcgtagtggggcctaatttttactctttacccatagtagcaggcagaagcgcctcttgcaccgacgatgaacggcaatggcaaaaaagttgtagtgacatatagtactgtagcatgcattatttcttgtacagtgagacgagtacattccactagttatccgacaaaagtgattcatcccttcaatcaccccataacaagcgcacgtacgagagcgggcgagcgaccagctcgatctaccttcgaagtaacctaacataacttacttccagcacacaaggaggtgaacgcgagtatactaccactgtactacaaacgcttcgcagtataacatcattgagatactcatggaatgtactgcccgttcgcgtcgtagtaccctgccgccgcattgtcatacctcctccccgtctgcacgccggcgcgctgcccgatgccaaactcctcgtgatcgttgccgttttcgtactcttgcccggccacattgccattgccatacctcctcacctgctcgccggcacggtggccgacgccgaactcctcctgatagttgccgttcgcgtactcttgcccgccggccgcattgccgccaaacttcctcccgccgttgaactcctcgggccgcgtccgcaccgggttggactcgcggccgtagccgtacttgccggtgttcacgtcgtagccgtaccggccgttctggtacagcctcgtgtcgctcatcccgtattgctgctgcggctgttgctgctgctgctgtccgccgcgcatgcgcgcgtacgacatcggccgccccctgccgctgcggtcttcgctgtacccaagcccggtgccgtcgcgtgccggcgccgcgtcctcctgctcggccgtggccaccgccgcattggtggtggtcgtttgctgctgctgtccgcgcgggtacggccgcggccgccccctgccgctgccgtctgcggggtacccaagccaggcgtcgtcgtcgcctgccggtgtcgcttcctcctctttttcttgctcggccgtggccgccgccgcgctggtggtcgtcagcttatcggcgtcgtggtgcacgccgcggcggaagtaggcctccgggtagctctcctccgggcggccgtagaggccgtacccgcggttgtggcttccgccgctggacggccgagaaaactcatccgacgcgcggttggagttggtggcatccggcgccgctgccgctgccggtgtcgctaccgccaccttgtcaagctcgacggcttcggggcgcgtcgccttgctgaagaacatgcggccattgccccacgccggccacgcgtcggcggcgccagctgcgaggaacgcgagcgcgaaaaggaaaaaaaaggtggcgagaaggggaggaggtggaagccatggaagcgtcggtgggttggcagctagctagcctacagcgctgcagctcgtactactactgtctattgtttccgtgcgcactcactgatatatagccgggccgatctgtgcccactagcggtgtggtacaattgcagtgaggagcactggtttcgcagcagtgtgcgtagaaagggaatgggaacagagaagcaatcaggcaaactcgggcaggttagatcaaaaggcgccactcgccagcgcgtgaaggggcggggattgtggggagagcgtgcgtgcgtgcatggcgccgctgtgcgcgatggtaattgggacacgctgctgcctgcatgcgagatctatgaggaattagcgtaggcctcggcctcgcagtgattgaagccatgagctacgaacaaggacgagcaacaagtgataagttcagcactgggccactgagcattttggcagcgtgagtttttaaatgcctcccatgatatgagccgtgagttgcaagcacacgatgcgaagtgttgatgcgagcctgagttattattactatcaccttgttcgcactggttaattgatatatattgtactcgtgtggatacatcatcgcgcacttgtaaaactttcctcgggtgccgatttggtgggatgctgagggaaaaacaatgtatagtagtaacaaacttgaatatcctgtctatgatggttggagtggtagaaatgccagccctgatttgaacctctataatgctcgataaaagattatgttcgcgagaagaaataagctaaccgaccaatggccaaaacggcatatttgcaaaaaaaaaaaaaaaaaaaaaaaagcaacgtttcacgtcgcgtcctttgtgggaggagcatctttccaatccttgaggaggtaccacgaggtaatatgaggtacgagatatcaatttaatctaactgttagtttatcaggggtatgatcgggctaacaaaaataaggtctcatctcttccatctacggccgtccatgccagccgtctgcgtcgcgccgctgtcgcgcagggagcccgccaccgctgtcgagcatcgagcccgccacgccatcgtatcgaggccgtcgcgccgtcgtcacgcatggaggccgttgccgctatcgcgccgccgtcgcgcatcgaggccaggaatctccatcgccatggactgcgacatgtgtcttctcatgagcacgagagaaagaggagaaaaaacaaaagaaaaattgaatgggtagggattcgagggaaacacatgaatacctcccaaaccagatcttgccctctgcgatactgcttgtgcaaacaaacatatacacctatatcggaaaaggaaaaaatccgattgaactaatcaatgggcgggttaatcattttcaacatctcccgacgacccgacctgagtggaggcgctgaggggagttgggcaccgaaggatgaggaaggtgggaggagcatggcactgactacagtccgtcgccgccgtcatctaataggtctccgttgtcatcgtccactccgacgatcaccgcctctaagggaggaggagccaaggaggtcgagtagtagttgagccggcgtccctgcattttcctacctcccctagggtcgccgctgcgatttccccctgctcgggaggctgttgcatctaccgcgctgaactcatcgcccagaccgatggggattcgctcgattcgctacctgcactagtacatgcgaaagtacaatcgtgccctcccaccatcaaaagccattcggtacctgctctcacggtggtgcggtaccacgaggtaccgaaactttcccagccgttagatggagtgtaacgaacggccaggatatggtacctcctctcctcaaggacagtaaaaaatctcttgttggagcgtggctttggagaatattcctgatgcagcttttgtcattggtggacttttggaggccttcacctttcctttctacattcttgtcttgtggtggatgaccgactttatttgtttgtttttattgggttgagtcgaagttatttcgttgttggagtgcaatgaagcttagcaaaattatttatacgttgcaatctttttttatgggtcctgttgctatccgtgtgtagtaagtggtgctttgctggcttgggttgattccaccatgggaaagtcgatgttggttgttcgttttggcaacaagtttggcaacgatgacatgatcatagtgaaatg

SEQ ID NO: 30878 - DNA, 27315 bp, Oryza sativa
ctcatagagagttttttcaaaaacgcccatccaaagggcgttaaggggtctaaatgtataatttccagtataacttattaactctatgaatttgcaattttaaagtgtatcatataaagttgtctgaaatcaaactttatatcataattttatagctcaaggaaatctacaacttcgtagttaacaaccttttcatttaagattgttagttgcccaaatgttcattacaaaatataaaacctattttaacaaaatctcaaatctacaatacaaacgacatcagacggagatgaactttatataaaagttatagatatcgatgagatctacaactttataatttattaccttttcatttaaaatcatttgtaatgtcgaataagcattattagttttttaagcaattaaaaccaacggaaatggtttgaacacaaataaaaactttacattcaggtcccttaatgccctctggaagagccattttaaaaaaccgtcaaggtgtgaggcatctatatttgtaaattttgcaacacgaatttttttaaaaaaatattttaataaaaaatgtaaaaattaaaaaaattcctggtgctgaacatcgtgcaaaactgcaaagccacataccaggcttgtcgcggcccatgtcttcatcccaacctcagtactctcaggctctcagcctcgtcaagagagtggcaagagcccaagacgtactcaaataagaagcttggatcttgggccttctctgaattaggcacatatatgggccatgaacaaataggaatttatgaactcgaccgtgtccatgtggattttttctcttgcaatccagcaagtccctcgcgtggaaacgacgaagtgcatgcgcgagcaggccgagatttcgcaatcgtatgaaatcttcccagcgaggcagcggcccagcgtcgcgccgctcaaagcataggactacttcaccaatcacagccacctgggagctgggaagctttaggcattcccaagaggccccgggatatgtttgagtaggttaagattttaaaatgcagctgctgagaatctgaagaagctaaaaacccgcttctagcttttagttcatttttcagattctacaattacagattctcagaatctggataaaaagctgagctgtttgggtgagcttctagcaactggatattcttggataagctgcagctgctagaagctcccccaaatagaccagcaaagcgctatttgagtagtgcgtaattcgaaatcgattttactactctaaaaatataacaacttttaattataattttgaagctctggacaataagtactgctatacgtatgatccgattatataactagagacatgtactcataaatcaatcaaaagatatcatgttataaccgttaatcaaatttagtcagacagatatatcgtatgcataacaatcttcatgaacaatacatttaggatgatggtaacactacatttttttgtcgccatgtttcttggtcagttacagttaatttgtaggccatttaggatgcaggtgcagctcagcaaattagacaacacgtccactctagttcaagcaattagaagcaacgttcgtgacaacaagttggctagttaatggttgtgtttttccctccttgtagcacatgctcacttcttctcgagcacaagagtaagaataaggggatgttaaaattttagccaaaataaagcttatcaaaatttttggtaggatttcttaagtgcttattaaagtttagcaaaaaactaaatgtaggaacaactttagcaactttactaaataatgttatggttggaaatgatattaattccctaaaatttagagtgtaaatttgagaatttacgatgcaagttttgaaaactgattatgtacttaaaaatataacgacgccataaatatagtgatctcgttggaaaattagaatgagccatattttcgaccgtttctttgtaaaactatggtgccgtgccgtgccgtgccataataatgtatgtctgtactcccagtatctttgtgttagacaaaaagacgcgccggtaaaagatagtagtacacccctctgaaaggaaagagatgactagtacagtactttgatatgctttctcatcgcacgtgaactcgtgactcaaccagattcaagaggtagcgaggccaaagcagcagtactcgtaatcgaagaaggctgctagtgctagcgcaggtccacccgggacgtcgcatacgcagcgaagagccaaacgtattcggtcgacgaccagcacggcagcaacgggccgggcccgtcgtcgcgaaagcagaacggctctaatgtcttgtcacccgacgtgccatgccaccccgtgtaccgcccccattccatcacccatcccatccacatcccacaacggggaggggaggaggaactcgcctgaaaaaggcggatctgggcccgcgcgcccgtctccctgcttggctgcttccctctcgttccaaaagacgagcaaagggaagagggcagaggagtactactactcctgcagtcctgcggtgcgtgagctgtgcgtgggccacggccacggacacagcagcggagcgggggacgttcccccgggatagcagccgagcgcgccgcctcgtctcatcactcggccggcccgcgcgagattggctgacgaacagtggctcgcggccgtgcaccgcatgcatgcagtggcgctctgggctggcggcatcggctgccgcgccgtcacccatcgctaggtaggcaggcaggcacgcgtagggggaaacgggtggactctggtaaagccgcacgttgcctcacgggctcacggcaagtagggtacgttaccgagtaggaggagtaccagcaaggcagggatcggcgcggcggtatcattgttggtttcgttgctcctgcatgctgtgcgagtagcctgcgactcgcgaactcgcgatttcgcgagtggtcgcccggaggggcccggtcggatactcaacgattattgaatgcacggtgagtattaaaaatctctgaaaagagtatactgttagtaaaaaaaagagagagggcatcgtgacagagctggtcagacccgtcgactgcgtcgcattgaacggcatcgtgcaaacgttgtatatgctcgcagcctgggcattaataacgtgcagaagtacaacactggtcgtgacggccaagagcatcaattcatcacacttgggtaggctgtcccgtaaaacagagagcgtcaaatgagacgcaatcaacacaagatgcttccactgtatgcttgtttcatcagtttcgcagatgaagcacacccaggtaccaacgcatgtactaagcttcactttaccaccatgtgttgatgaaaagggtcggaatcgcaccgttctgaatccatccaaagcggaactgtgctaagaacagatgacggcactgtgcttccttttctttccacgaggcgctggcggtggcattggcatcctggtgggggaacagtgacccccaaagttgcagctgccagcactacggccgccccacagtagccagtaaacgcgctgcagctgcagcacgcccccgcaccgcgccaagggctaaaaccgaagtgaaaaaggaaaccgcgaccaacccgtcgcctcttcacccgcaccgcaccgttgcagcccgcccactcgctgactcgctccagccagcagcagcagcagcagccactgctcgcgacggaacagacgacaccaccacgacgcccgcgtcataaaggcatgggcattgtcgcaggctagccacagcgacggggtagcagcagcatcagcagcagcagcggcaacagcgaccggcattgatagcggcagctgaggaaggaagagggcgcgcggtcgccgcaggagcggagcagggggggcatgggctgggcgggctgagcgctgagcaggagatggctggagagcgacgccctcggaggcattaatggcgtcgtccgcatcctcctcctcctccccatcctcgcggccgccgctgatggctctcccctctttttaccggcccccttggccgtccgagaggggcggcgagcagcgagccaccgactgttgggccggatccccagcggcgggaggcggccgggcgcgtgccaccgccatgggcatcgacctcaacaacaccgcgagcggcggcgaggaggacgcgccggcgccggggccggtgtgccgggatctgtggcacgcgtgcgctgggccggtggtgtcgctgccgcggcggggcagcgcggtcgtgtacctgccgcaggggcacctctccgcggccggcgccggcggcgggatccgcggggaggtggcggttgccctccctccccacgtggcgtgccgcgtcgtggacgtcgagctatgcgtgagtgaaccgctgtcgctcgtggtagggttttcgctgtgaggccgcgcgtggtgggctgcatttacatgctggactttgtgcaggcggatgcagcgacggacgaggtgtacgcgcgactggcgctgcgggcggagggcgaggtgcaacgctgcttcaattatcttattgattcatgtgcttccgggattggggattggatgagattcttgggggcgtcaaatgttggttgcctgcatcctcttttcagctttgggcgtggcataagctgcaatgtgatgggtgttgaatgagctttgatttttattggatgtctaaaaatagacattgttggttcattctaattttagtgagccacataatttgggacttactagatctacttggccagcttgatatagtatgagtgccgttttctctgcacaatgtagcttcatttagcacatctatcatgcctctaatttgtatattgtaccgatacgatgaattgttttggcataacaaattctattaacagatttgatttatcaatggtacatttggttggttcaggtatttgagaggaacttgcatggtggtggaatcgaaagggaggatgacatggaggatggtgatgaggaaaggaagtccaggatgctgcacatgttctgcaaaacactaacggcctctgatacaagcacacatggagggttctctgttcctcgtcgggctgctgaggattgctttccacctctggtgatgagattagaagtttgatttgtttcctattgactcttcaagtgactgcttgtcttgtgatgtaactctaacgaagtttgttttctttcgtgccttaataggaccacaaacagctaaggccttctcaagagcttgttgccaaggatttgcatggagcaaagtggaggttccgccatatttatagaggtgacatccgagtacttgataagggatatgcaatgcccttgttacacaatctatttatttaattgctagtaaatgtttgatttgatacctttgtatcggaaacttgtacgtcatactcatgtttgatgatcgggcatatacagagcattgctaaattatgtgtgactgttttagctttgaaagaggtcaggaagtattttagtcaatgctacaaaatatatggcaggtgtagcttttcaactctttgaatgtttgacattctaagtggtcagtagttttgcctgtctgaactgcgcgttcagtcgtctttgccattccctaggatgcaaattatttccttcctagttcatcttctgatacaatttatgttattcttttgtgacttccatcactttgttatatatggtgtgttatctctgcagtgaaaattacttctgttaataaaactgtacaattttgctcagatagtagtgtccttgaaacagtggatagaggatgctctccaatcttattgttgtccaagccaatatctccattttgattacaagggaaatgcacaagttatcttgtagttatagcatgtgatggagcaaagtatgacattatgaatttttaacattcttttcattccaggtcaacctcgcaggcatcttttaacaactggatggagctcctttgtcaataaaaagaaactggtctcaggggacgcggtgttatttctccggtaatcacttgatccaggtgttaaccataaagctaatgctttcttgtctatattttctaacgaagcattttaagcgtttgcaggggtgatgatggtgagctaagattgggtgttcgaagagctactcagcttaaaaatgaagcgattttcaaagcttttagtagcgaaagttcaaagatgcgcacactgtcggctgtggctgattccttgaaacatggaagtgtttttcacatttgttacaacccaaggtctgctgaataaaacatatagtgtttcattttgtgtggtccaactcaatacaatgtcattttctctggggcagttggactatatatccattcacatattgtaatcattggactttgtagggctactgcttctgagtacgttgttccatattggaagttcgtgaaaagcttcaaccatccagtttgtattggaatgaggttcaagtttcattttgagagtgaagatgttaatgagaggtttgcatttttcagttgaactatctttttttgtttttgcataatactttcttgggtcttactatctgtgttgtaggcgttctggaatgattgccggtgttagtgaagtagaccccatcagatggcctggttcaaagtggagaagccttctggtatgcatttgagctgcttttttattaagcttgttgactacggaacattaacttttggctacctgccaagtctttgaaacatatattagggcaccacatatagtcaatttcagttactgttttgtctatcggattaaatgtgaggttatttcacacattaaaataaattcatcaagttagctgaagtgctgaactcttgaatatgggtgcaacatccttcttgtcaaactcaaattttgaatccaagcctgatcttgtggagtagagaaattacttaggatgttctatgatcttttgtttgtgagtaaatatgtgcaaacattaataaatgctcaagtgagaactgagaagttgtcgaaataaattcaatacgtaataaaaatggtgtgctataaaaatgattagatgatttgtatcactttgattcctacattttgcagtctcttgcttagcccacattagtggttgggacaaatcatattagtcaattgggatgatatatcaagaataaaatgccaacccatctaaagggaatcagaacaaatggtcttgtaagtccttgaggcaccttaagacaaatggtcctcgcatgcatttctttttcacacttctgatcccaagattcccatgtaggtttaccattagcagatgtcagatagagaattgtttctgctggagtaaaatttcttaagtatctaggcttttgtagtttgagaactttgtagttcctgcatttctattaatagaaatggggagtttggccccttgataaaaaataagatagagaattgtttcacgcatatttggattgaaaaggacaataatgatgtaggatgtgtacaatctgtttatccgttttgctgtttataacatctggttggcagctaaaaaaaactctcttgatgaggaatttcgttggtcttctgccagttgccaatgtttgtcgccctatgccgcccaatgaagctcattgagcacacaggagaaacaaaacagtgaagagaatactagaggcatgttattattgcttgctaatatgggctggaacttgtttgctttcataatgtaagctgtaaggatcatcaaagttgtgcaaaaccaattatttagaggatttactaactgtaaccatatacattttaatgctatcaacaccttttatgatggcatccatgtctgtttaggtggggctaaatattttttattggattggaccaagaccacattatcaaggccccataggaagcctaacagcttagaatttttatagattttgatttgtccattataaatcgtttatggtgaatctattgtcaatattacccaaattcgctaatgttagcaatttgatttgctgtcttttcatacaggttcgatgggaggatgctactgactgcaacagccaaaatagagtatctccatgggagattgagatagttggtggttcaatctctgttgctcattctctgtcggcatccagttctaaaagaaccaaattatgccctcagggcaatttggacgtgccagctctgtgtgagttccaagagcacgaggtcaatacttggatctataaattctttaaccctatatgcttattggtttttgtgttaatcctgtagatggaaatggtcgtccagactcggtggaaactgaaaagttccccagggtcttgcaaggtcaagaattgatgggttctaggacccatcgtgctacttgttctcctcagtcaatcgacattacaaaaagtaagtcttttgatgcttggagattccttactgatacacgaagctgcatgttgggcagttcaacaagcagacttccagtgcagtactctggctatacccaccaatctgtaagcttcggtgaatctattggattcccagaggtcttgcaaggtcaagaaatttctcagacagttcctccgtttcaaggaatgttgcctgatgcatgttcagcgaaaagcagatatgaattaaagaattatgtgtgcaccccagctaccatgaatggactatcatctgcaaatgaaggatattgtctctccctgtcaactgtgccaccttctccaccttccagtcttatgttataccaaacaggggtaccacagcttgaattggcaagcaagaacaatgacaaaagtggaaatgacagccaaccagccttgcgacagcacaagttgctcagtgaaactagctgggaccagtttaaaattggaaaggcttcaacacctgggaatgctactaagcctggtaatggtggaagggaggttgacagaactagttgccgcctttttggtttttccttgaccgagaagattatcccaacagacaaagatggtgaaaaggaagtgagttatgaaactgattgccaaaatccacggatgctagacttgtttgggtacaattgcagtacgcctggtgctcttcatgccctttgtgctgctcctttgggaatatgatgctacttgagtaactggtatgctctagttcttccttactgctgaaaattcacttctcctgtacctttggacctcgtactctaccattatccaaaagctaatttggtcactgacatttacacagggagggatacgtacatgtggagacgcagccactccacgcttcatcccagatgtaaacggcatcggtctggttatggtcccaccgttcctgatgctttgcatgtaggtattgctgcctcacgcctgaatacctacgtgcggtcaggcgaataaagcgactcgattgtatgtttgactgcagctctagctgtcgagtcggaagggcgatgatgtttatcgtcgttaatgtaccatcggcaccctgtttatgcagaaatgtggacctaattattatgaacttatttccttagttctatgtatggttagcttctgatctagacctagttatgagcctatttcagaagtgctatgtatggtttgcttgtcaacatttgtttctgtatcggtacaaatcactatgtttgtatgtttattatgcacttcttttgtgttttaacatcagatgcgttccatatggatttcgtttatttccgccattgtgatgtatacccggcacaggatccataatagagagggaatcgtgggctagcttctgatctagacctagttatgagcctatttcagaagtgctatgtatggtttgcttgtcaacatttgtttctgtatcggtacaaatcactatgtttgtacgtttactagaggtgaacgcgcgcttcgcgcgttgcaccagtggtgccaggagagggaaatcattgattacatctgttggttctggtaggtaactgaaacaaatgctatttgcaaggtctgtgaaggtcaagtataggctaacgacatggtgtgagatttaggtttagtgtagtgcaaaaaatgaagttttgtgacgtgagcatttatattgatagttgttatagaggctaaaagctaatcacaacatatatgcagattgtggacagtcctaaatagcaaaatgtgccacatgtttgatggcaggatagacagtacatagtagttttatagtggtagcattgaaacagagcacataggagtataggactataaaactatattacacatggctaaattctactaatatggtttggatgccttcaccgaattcacacaggggcccttttgttgatgtgcaaatggaagtgcaatattttttgctatgatgaattgcttctcccgtgtacatagctgcctgagaagtgatgcaaaaatacaattttttttatcaatactggcagtcaataatcttatggcattgaactactcaacaatattagaacaattaagcatccttgtttcctagtaatgttctttttctgaatgtgaaaaaagcaagttaacatagttgtttttttggtatatattcagattgtaagaatcaaagaagcaattgccgatgtcaagtaatctgtgaatgaattaactgaaggaccaccagcaggtacaaatttagccgaatgtgaagaaattaattaaacatctcaaatagcagggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttattcagcaaagaaagttggaatggatggtattgtaggattgtaaaggtcaatctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagttagtcaaataatacataacttagttaaaatgggattttaacctacagggcagcgctcatcgtcctaaactgaagctttatcatcccaaaccaatagttatattatcaatagtcctgaaaaaccacttctatggcaagagcaaataataacattagtcgtttcaaagaaaacttcaattttagaaccctaatcaagccaatcttttatatgctagtctaagcattacctaatcatcacatattaaataaaaaaggacataaatattagaagcattaggtagaagattcaaagtgagctgcaataaaaactggatgcatccaatgtagaacatgagaagcatctgaaggacaagtcagttacatttgtaaaatatcataggcattactgaatgcaaattagaaaacaatgtaacatcattttttttatatcaagttaaattctgttgcacatcgtggggatgtcatgataatttaatatgttcagagttaatgtctattatgtcatgataattaatttttttatagagttaccaatcttcagctataacttgcaacagaattcttgttcacaaacaaccaaattatagaactaatatatgcctatttggtaaacagataatcaactaaattttcacttccgtaaagaacatgtcaaatataatttaaacggtgaactcaaggtaggcaacgaacaacgatcagccaaactggttgccagtggtgccatttctcctcctggaggatggcaccaatgcaggcatcctttgttctgatctactatgttgtgtgcacctggagtcttggcgtgttaaggcaggcatcagcctatcatagcctagttttgctactgaaaccattgcaccagctaaagcctacaagaataagagaagtggacagctatgccagtcctttgatcttgcaccaatccatcatgttttctttggttcttctcatattattcgcaaagcaataatgtaatccattgtaatgcagcagctgattggcgttgggaagattagatagcttagaatagaattgaagctatagatggattgtgcaacaaattgagataaattgattttctattgttaggcgccggccctaagtggcatagcgcgtagctgtgctcgacgggagggcgaggacgcacgcctcacctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttgatccaacatcacggcgcctgctctggctgttggcgtcggttccggcgctgatactgaatgccccacataacatctatagtgcaaaaagagcagacacatagcgagctttagtaatcacatccaaaaataatacagagaaaattacagttcattaatttatttttggtgcaacagtaatatacagttctgatccagacctgtataacctttatcaaatgcacttgtatatttttggtacaacagtaatatatagcagcagtagtagtgattagtgtgattagtgtatacgtttagtctcagattctgcatgtaaaaggtcatctaatgtcaagttacaaacatgctcgttataaattaattttatagaagtcactaccttcaaggggcataattagtaatgaacaaactaaaaatgcaaagccacaatctattttgatgaagatgcatgactacatttggatggagcattatcaaattattatccacaaaaaatattgtacattgctatattttgctggaacaaatcagcatactcatacttcaacaaaagatatatcaatttcttatacttggaaacaaagaatcttatgcattaactcatttgtaatttaaagtcatctgcatgctacaatggatcgtagatgaaccccttaaagaaatgcacagccaaattgacagcaacactaccaaagcaaagctcgccgccatcaaagtggggtcacattcggtggagatgcaacctggttgtggtggcagatgaccttagatgctgtgccagaggaccagtagggcagcacggccgtgacgcaaggggatggaggtggcagcatcctctaggaaccccgcgccgatgcccttctctgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttggcaaagatataacatgcagtatgaaattccagaggaaactttcctctcctcacctccttccaaaaaggcagaagaagaggtaggatggagctgacgaggagccctccatgcggcagatccagcagcacccgccgtactggagaccgccgctgtccgaaacgggacaccaatgccacagatcatgcagctccctctccaaatcggttcaccgacctcctggatccagtgattccccgtctcctcgacgtcccacacgcacgtccgtggccgcctaatcgcaggcatccgttgatccggaaatgaacaggatggagagggagagggagagggagagaggggcagtgccgggcatagaggtagaagagtagaaggcggctcctggcttcccctcgcttcagggcggccggatctgccggcgaggaggccggagtcaccggatccgacagtcccggcctcctcgttggcggatgcggtgcgggagcgagaggatggcgatggcaggacgacggcgcggcgacagcaacagctcgcagtagggagtgcgcgggggaggtcgccaactgcgggaagaagaggatgaggggacggcacgcggcggcggccgtcgcttgggcaggagagagagcggagcgagaggagaggaggcagaggaatggtggcggctagggtttggggaaaggggtgagggttgcaaaaacaacccctaaacttctagttttcagagcgcggttcaattttccgttttttcgcttcttcatatagaatattgttttcttaagaggtcctctaagtaagagcgcacaacgttagaactaaggaccagggatctataacaaattatcaagtaaatgaagggtgtttttgcaaaatcaccaacgacgacacggacgtgcgagagctcacgaaaaccacccgccatccagcgcctcgctgacgcgtcagcacgcgcaggtggccacgccagctcaaaaatctccaggagccgcaaatctcggcaggtttgtatataagcgattatgcacttcttttgtgttctaacatcagatggtttccatatggatttcgtttaccttttcctccattgtgatgatacccggcacatgatccataatagagagggaatcatggtttagctactgatctagacctagttatgagcctatttcagaagtgctatgtatggtttgctcatcaacattagattctgtatcggtatacaaatcactatgttttgtatgtttattatgcacttttttgtgtttttacatcagatgcattccatatggatttttcgtttacctatctcaccgttgtgatgtacccggtacaaagatccataatagagagggaatcatgggtaaacctcgatgacggaccggatgcccaggacgtgcaggatcttgtagccgctgaagcccgcgtcatggaatatcttgcaaaactcccgctcgtcgcgctcggggctccccaccacccccatcatcatcacgtcccacagcagctgcgtctccgtgtccctcgcgccatctcccaagctcgacgacgatcccaccaccaggtccatcacgatcaccctcctgccgtcctccctcgccggcaccgcctccctgcaccgccgcagtatccgcacgcactcctcgtccccccacccatgcaggatccactgcaaaaatagatgtcatgcttagagtctcatcagttggcctaataaatcaaagtaaaagctaaaattaaatttttaatttgattttaagatattttaacgtattttttatagttggcttttaagttgataggaacaaatatataagaagttttacatattaattaatttctattttctgataaatcgtttttggtttattggaatataggcaagcaattgcgaggattataggagaaggcgcctgtgatggtgtgaccttgaggaggacggcgtcggccttggggacgtggtcgaacatgtccccggcgacgaactcgacgcctccgtcgcctggtgggacggtcgcgacgacttgcggtagttcgaggacggtgcacctgacgtgagggaacgcggcggcgctggccctggcggcgccgccggacccgccgccgacgtccaccagcgaagtgatcccccggaacagctgcgcgccgccgtggtggtggccgtgcaggagcacgtccatcacgaagcggccgtcgcacgccatggcgtcgttgaacgccgcgccgaaccccgggtcgtccttcgccaccgcccagagttcgcgcccgccgtggacggcggcgaacggcacgcgcggcgcgtccgctccttcgtcgtcgtcgtcggcggcggcggcgcggaaccacgaggccagagagatggacggcgacacgatgatggggtgcagcatggcgcgcgcgaacggcgagagcccctgccccgcgcccccgggcgcggagacgaggagacgcgagaccgcggtgagcccgtaggcgtcctccgcacccgcggccgcgtcgaagatgccaccgtgcgcgagcagccgcatgaggcggcgcaggaagggcttcctggagcgcggcagcgcgagctccgcgacgagctcgggaaccgtaacggcgccgccacggcggtggacggcgtcagggatgccgagctcgacggcgcagcggagggacatggacttggtgtacgcgaagatatggttccacagctcagcttgggcccggaggagctcgtcggcggcgaggtcggagttgcggctggcgtccattgctcagctgctcagtgtttggcccgagtgattaattagcttttggttccgtagtcaaacatgacaactttaggatactacgaaattatgaagaatcctatattcttgcctccttcaagttgttgggttttgtcttcattgtgaaatcgcatttcgcatgcatttacaaggagaaggtgctgccgaaatccataatgcttaacatgcaagtgctgataaaaaaatgttactagtagattagctctgagtgatcaagtcagaagtcaaaaagtagttacttaagttgtttttctttactaacatatcgtgcatgtataagtcgcagttaaaatttaaattttaaaacctaaacttcaagttgatttaaatgttttttttcatcatattttacttctagcctaaacttttaagttgctcaaaatcagtttgagtaaattttattttggttcaacttttattactgatgtttcattttgaatcatcgtatgagaaatctttttttaaaaaaactcgtatattaacttgagataattggactcctaattacagctcgtgattttctaacaaagtatatatccaaacaaatttaacacggtgaatttcacattaactaaattatatcaataataagattaaaatagtcttcacccgttacaacgcatgtgcattttttatagtttaagaaaataacatagccttacggtccagtaaaccttctttgggtaaaagtacattgggggacataagggtttaatctttcggttgggctatttgtatctgcggtggccgaaatattaaaattgtatgaattttttaatacaatttgatcaaatttaaaaaaaaaaccaaattcacgaaaaaataaaaaaaatgcggccgaaataatatggtatcggctggggcggtccgataggaccaacttcggaaatttcgttcggcaattttaaacccgtagtgttagagatccaaacaaccacaaaattaaattactggagtagtagagtgctagtagaccagaagaggggagtcaaactcaaaagtgtatcaaggataagcagccgaggaaaaggtatttgacggaagcctgcgatgtctgcggcgccggctgcgagcggctggttgcggccgtccgcgaccgcgcggctctgcgaggcggggttcttcaccgattacgccaaccccgccactacgcggatctgcatcggccggaggcggagcggtgcgccgagaaacatgtgagacccccttccttgtctctgaatctcagatttttgggggttgattgcttgaactcacgcctgatgtacgcgcgcggattcagtagtggtaaccccacaagttcgattttgttggggattattgctgttctcaaatgcccctttcaaatttcatcagttttgggagtaatttgttggctggatgggagaggtcgtacgtttagatgaggaaaattgaactatgcaggtaatacgtgcttggtcaaatacgcgcttaggtagatgctaaggaccgtatgatatttggtgaggcctatagaagtgaattttgtagcttgcaaatcaaatatcagttgttagtgcatattcagttagttgttctaaatcccaagttgcaacctccaggtattgaagctacttgctgaaattcgaggctagaagaaagatcattgataatatttgcatcatagatttttttcagttttcactataaaaaggaaacctgtgttttcttcagaatgtctaatatgttatcttcagtgcagggcttcaagttgcatcatccaatttgggccgatgcaaaattgctcatgttaaaagtggagatgctgatggttacccaacgactgaagatttgtcaattgacgaggaaaccctgcagcgtaatttacagacagccatccaggaagaagattattcccgggctgcaaagataagggatgatctgcgcatcctccatgaagataccaaagcttccctccttgcagcaaacacacggttttacaatgctttcaagaatggcgatcttgcagcgatgtactctttatgggctaagggtgaccatgtatatgttatccatcctgctgcgggtcggatatcaggttatgacgtggtcatgcaaagctgggagatggtatgtggcgcagattatgagttcccactaaacattgatctgaaaaatgtagaggttcatgtgcatggtgaccttggttacgtcacatgcttggaagtggttaagaccaaaggaagaacatgggggaagcaagtcgccacaaacgtcttcgagaaggttgatggcacatggcgcatgtgtgttcaccatgcatcacacatagaggaatgaaaaccttagttgatttggcatggaaattttgcagaaaagctagacaggcaatacatgatttcgagatttctatcttagcagctgcatcattagtctatgttttctcgagtcaattgtatcgatgcttaagttttcaaactgaattttttgtggtttcgtttgagattccatagtggttggcatattatgtcacttgagattatatatgactagctatttttccatttctttttggcggctaactgggaatggacttgatctgcaagtaactcgtaccaggctacttcactgaaacaaaacctgatttgtcaattgtcatgtactcatgcttcttgttgtaaactgagtcgtctggttttttatatgctttactttctacagtaaattattagcaatatattttaccagattcaggaattgacaacttatcattggacaatttcagcagtaactttgtataggacatctgcttgccctccggtctacatgttgccctttgttctgctgtttcctggttatatgggataacatgaagtttccacgctgacaaaatttgagataacaaaatcaaacaaagacacaaaaaaaaatacagaaaatacttcctccgtcctaaaataaaccaacgagtagagttcaggattcctctcactttctacgaagttgtttgatctttgatcttctctctttctgatttagggcgagattatcacaaaaaggaccagacgcgaccaccaacttggccaataagcctgaaactgaacgaccccccctcctcctgctcgcttccctctctccttcctctccaagaaagagccaactaggcgagcggagcgcaacaaactcgccaacccgcgccgcgtctcctcctcgtcgtcgcaacccgcagcgcgagcgcctcccaccgatcatacgaaccccaccgccacgtctactccctcgccgcagcgcgagcgcgcacggagaagaagcaagcagagagagagagagggagagggaggggtggcgctgcggcgagaagtgatggtgctgccattggtgaagctcgggtcgctcgcgttccggacgctgagcaagcccatcgcggcccgcctcaagcacaacgccgggatccaccccaagttccgcggcttcatcatcggcctcgcccaggtgacgtctcgtcttcatccctgatcatctctctctctccgcggctccgccctgttgatgcttggattcatagattgccgcgtcgcctgggtggattgaactgcttgagcggttttttttttccgtaagggcggtttggactttggagatttgaggatgttcctccgagactcttgggtttattttgttgggaactagcgacgtgtggggatgtgtatgatgaaatgcaaatacgaaagtacgacgagctagttctgaacttctgatgctttttggtaaattaatgggttgtttcattggtatatctttacattggacggttgcgtttatgcacagttctggtttggttgcagtattctgtcatggagctttcaggccatgatacaacagtgctttgtaatggatctctctgtttttgtagcgagttctggatttttttttattgagtcctacaaggatctgcataactcataattccgctttgatctcctacaaatgtacattcatctcgattgtttctgcaacatttatctgaggtcaattatttgatgtggataaatgtcagaaacacatgttagttattatggattttggtgttcatatcaagtggaataatctgcagcatttacctgaggtcaattctttgatgtcagaatcacatgctagtaattcatgattttgatgttcataataagcaaggacagtttagcttcaagctttgagccagattataatgattccttacgtctgttattcagtaatacatggcttctgcaacactgaggaaacaatagccatgatccttatctgttcagagcaccaccaataattcacattacttcacaaatctaacctttaaaatggattctgcatatactgatgatgggtatatttcaaataagattgatcagaaactatgaatacatatgcatatactgatgatgggtatcttccaaataagattgatctgaaactatgaatacatctgcatatactgatgatgggtatctttcaaataagattaatctgaaaccatgaatagataatgctgctgctcaatccttctgtagaacatcaaagaattttaggctgagattattggcgacctgagcacagtaaaatggatgaattcttcttatcctaactcatgcatgcctttgttttagtttgagcagaaaattttttttactactgtactgacaaggtgtatggcacattatgttcaggtaaaccatcgtttcactacaaacatgcagaggcggctttatggccgtgcaactgacattcacattcggcccctgaatgaggagaaggcaattcaagctgccgcagatcttcttggtgaactatttgttttctcggcaagtactttgatctcagttattctaaatgagtttttgtctgttaataccagaaaattctgaacattttactctgaaatgctataattgaagagcctgaaaactggttcttccagaattcttatttttctctaacttcctatgctcgagaagtacttgattatgtcaaaagattacagctgacatgaattgtcacatgatttttcaggtcgctggtactgcaatcatctacgaggtgcagagaagtgctagggcagaagccagaaaagaggagatccgtaagcaggaaatcgaggtaacatggtatcatgcgtagttttttactgtaatttttgcaatacgcaagcgttctgcagagattgttaaactgtctctgttcttgaaatggcaggcgagaaagcagaggatagaggagctagccagtgaggtgcagatgatgaagaagaggatcagtgagatcgagcggcagcaggacgagagacgggcccttccgaactcccgcggctccaccactgccactccgatgcaggcagcttcggcggcagcggcagcagcagcaaaggcaaagcatcagcagcccacggccgctgctgcttagcttctccagtggtactgtccaaagcccataggctgtctcccctgccctgcatttcggaaggactaacgcagattgattgcccctgttttcctcccatcccgtagctcgattcgattgtagttattcggcgaacggctggacttcttacttgttgcgctcgttctgagttctgaccttgtgaatagcatacgtgagaggtcggtgtttgctctgagctgaagctgttggtgggcggatcagtgaccatctggctcgaagttttgatactgttttcggatatgctatagtcaagtgtacattgcagtattcttgctttgcttactgatgtgcaagactaagtacctgccattaacatagctcaaaaggcaaaatagcctgcatcccctcattgttatttcaccaccatttgcattttctagcaaatgaagtctgctttatgtgatgtttcatattttcttaacactaggaaacaaatcccggacagcaggagttcagtgttgtattataggtgatttgactacttttccttgtcgacttaggcttttgctgaattagttaataaatctaacttaagtaattagggctaaattatcattcccaatttctttagtgcactagcgctaccgggatcgaatcatgcttttcacctttcatgtactcctaggagggaaagaactctcagcagagatatatgtgccagagtaaaagatgaaatgaaaatttctttcgggcctcacgttattgcttactgcatttccatgtatgacaaatgcatcttgacaggacgaccaaattttgtcaggccaacaaaccgatacatatttccaaaatagaggtaaagaaaaaggagaaagttcttacgatttacagacaggtgcggttcttctgttcctacaagagaagaatcttactaaaactagtcaaattctaaaaccaccttgccaggcaccagccttttctccttggcctcgtgagcttctcttactttgctgatgggaaatgtcttctccaccggtatctgcaatttcccagctccagacagcctctgtatctcatgaagtccttcagagtcagctctcatgtatgtccaccaataatctgatattaaatttgtaagaaacatgagaacgtcttgtataaacaatggaataggtcatatagataacttctgtaaagcaattcatccctaaattaaatacaaaggtagacatgaatacaattgtatatcataagatcgcatgatagacacacatatcctgatcatatctattaagaaacaaacaaattgaacccttgtagaattaagtcgttaaccaaacactgacaagcagttcacaagcaatcgacaccaatggtgaccaacttagtcattattaatcacttaagtgctggatctaaactttaaagagcaggcggcccactgctatcagcctcaactcgcatgtatgcagtcaagaattcaatgcatcactaaataaaaatgaaaatattttatattcactgtacatgtatagtttttctcttgagggttattttcaaagctactgatagtagttattaagttgttttctgcagttctgggaaatggttgggatgtttatgagcgaaatcgagtaaggttgcatagatttgcgtattgatctaaaaagctatctgagagaccaggccatgcttgttggattttggcaaaagcaagccctgctcttcgccagttagtcagatactgaccaagttctagttggtgcaagtccacataaataaaggccgtgtttagatttttttttttttgccaaaaacgtcacatcgaatgtttggacacatgcatagaacattaaatgtggacggaaaaaaaaccaattgcacagtttgcatgtaaattgcgagacgaatcttttgagcctaattacgccatgatttgacaatgtgatgctacagtaaacatttgctaatgacggattaattaggcttaatagattcgtctcgcagtttacaggcggaatatgtaatttgttttgttattagtctacgtttaatacttcaaatgtgtgcccgtatacgtcaaaaaaaatttggacagtgaactaaacacagccaaagttttttgccgggtaaacacagccaaagttttaaagtggaaacgtagatagtctattagtctatgaccagctactataattaaagcaaaatatatcccctcaagacacaataaattacccaacaaaaagaaaagattatatgaatagatacaaacctattccatgagaataacggtactgcatttgtttctttagtaaaacagcagtagcagcaggaagtcccacagctaatccatatctatctgctagggcagccgcctctccctatcacaaagaaggatgatacaataatgaacaaatgacaatcaaagcagaaacacagaaaaaattaaaaggggcaggttgacgacctgaagggtcatatagtgtccgcctctcctcagaacattaatgccaattctctcagtttcaggtactcctatggtatccaacacggcatcgaactttcctttaactgctgattcagtatcctgtaaggtaaaccataaaatatgaacattatggagacaatggtactcatctagggaaatttcttaaagagaaaaaaaaaaacaatctacaggacaattagtgagctaacaattttatccaatcgcagaaatgatctatatgccctgacacaaaattcactaatgttttctcactcatggagaataacggaaaacttcagtatcctctcctatatttaccaggcacaaagaattagacaatagctcaaagccacatataatactactgagcaataggactgttcgttccaggtttctcccaacccgtctaaactgtatcgtgttggccactgatgctgcagtcacaccaccagccacaagcggcaatgagttgcaagttttgaatgatgttgaaaaccggttcaaacactcttctgctgtgcagtagtactaatatcattccctgataatctataagtataaagtactatgttttgtattgatgcaagaagaaaagaaaatagtcacattagacctaagaaaaatgatatgtcaagtgtaacattgcatatgtgtagtcttgtaggagaaatgaaagattccacagctaagaagatgaaaaactgctagctgctatcagttctgtgcatagcttcacagtgcaaagtggatgaataagcgattcagagttcatatgtctgcatgtaagcatgagtttatcagataatgtggtaacagaacaacgaaccacaacgactaaacaacatctaaggcaccatggtaccattaaatatccattcctgctgtgtaacaatcctatcttagcaaagacaaataaatatatactccctccatttcatattataagtcgctatgactttttttctagccaaaattatttaagtttgaccaagtttatagaaaaatatagtagtagcattttcaacacgaaacaaacatattatcaaaatatattcaatattagatttaactaaactaatttggcattttagatattgatagctttttctataaatttgatcaaacttaaaaaatgtttgactagaaaaaagtcaaagcaatttataatatgatgaaacagatggaatagatagctagacatattaaggatatggtttgcctgcgttgataccgaaaatagtgcaagggcaaaagaattcactatatcatcatcatcgtaaagaaaatataagtacaagagtttggacttctgaaagcgtttacctcagcagtgtaatcgatagctttttcagcaccagcggccaacacttgttcaatacttttagttccacaggttgcagaaacgctacaccctgcagctactgcaagctgaacagcagctagcccaacagccccacctccaccaatcacaagtactctttgtctaaaacgaaaattaattgcattcagttcaaaaaggaaaggtgagcataacttcaatatgtaaccactcaaccagacatgaaataacattttactgataacgaaaagcttgtgctgtgaattggacctaaataatagggttggttttcggattgactacaagagattacaacttccctgcataatttatatttatataatagaacccgaagagagggaagtgtagtgcagatcaccattaaaattaagaatttacatatgtacctagatatatgtgaaaaaaatctgaaactttatgaaaggagatgaagtaacttttgtagtagtatgcttctagctgtctgccgcacaagcaaactacgaggagcacactttttaataccaaacccatttaaaagtcactaattacatacttacctaccatgctaacaatccaataaattaaaagtaaaggtagatgcaagttataggaaacagcaacaatggcaacaaaaagaacttgttgtctgtttcacaaacagtggcgtataaccagacatacccttcagaaattcgagccgtaccatgtaaagcacgccatgcagtcaaagcagcaaatggtatagcgctagcctcctgcaatataacaaaacttgattcgattagcttgcagtatggtatttttttcacatacaggtaacattggaaaccaagtcctgagctatctacttaagaagatagaaattgttctccccatcaataaacaataaacatgaactaaaaccttttagaactttcattaaaaagctttcaaaggatgggtttttgtttaaatctacacaaaggagttcctatcatcatccattagccacaatgcctgttaaatacaaaaatatgatgcactgttgtacattcctgaaatggaataaacatattgcatacatccagggaaaggaccaggtctgtccagttcatactatgtgaagattaatggtgaaagaaattgacgtgatcctgaaatgatattttgaaatatcaatgttacgacgagaagagttatctgatgaattcataccacatgactgagtgtagatggtttggaagtaagctcatcctgtgaaagaattgcataatcggtgtatgtccctcttatggctgttggatgcaaagcaccaaacacttcttgcccaatagtaaaggacgacacagaagtccctgtagctgcaacttcaccacttatatcccggccaatgatcagaggtaggactggctcaaatattgaacgcccataaccagaccgcatctgaggagagacatttttttatgagatgaattaaatttcaccaaaagaacaatatattccatttcataatttggaaagcacaagaatatatgcatatccgattgttcatgtcaactgcattttgcttaattccaggcttcaaacagagtataacttaactcaaagctgttgtagacctatttggtatctaattccatgaaaattgggactggggtcacctggccttttggttcctaaaagaaaatgagaacacaacatttctcatctggggatcacaaactataaacctactgctgattgcactccttcccttcctagttcatatagcattaaacaagaatccaccactctgttgcattagcagataccaccaactgatcagtgactactacctacagtgcaaagattgacccaaaacgtgcacccgtgccaatttttctacccgacatatcgaaaattataataaaaaaagttatcatttca

SEQ ID NO: 30879 - DNA, 1809 bp, Oryza sativa
gagaaggagacgggggaggagaaggggatgtgggctatgtacatggacggcttagtctatgacatgtggggacagaaggagtggggttcagcgtgtcctggagcgagcagacgtggcccgcccgagggggtgcgaggcgacctcgcggcgacggagcgacgagcgggcgaggtgggggcgatgtgtccggttcccagccacaggaggagggcacgagagattctgggccgtcgatcggacgtggcgtgagaggttattagggcagtcccaacctttaacatagacatgttttccataaactctacatcattaagaaactagtactagacactactcttctaatataaacaccactattccattaatttaatgctacttatctcacatgatgtcttagatgttgtgtagaaaccatgtctcatgcaagacatggtttccctctttttcttcatttattcacctgccacatcattttttcctagttggcaatttatttaatgctatgaatactattctatttattgggttgggaatgcccttacccgctgatccgattacacgcgtacaccttacttacgtgtagccacttggtatcactcccttgtttcagcgttaaaaaggttcaggtagtgagaggtagacacatgctttcatcgaggaaactgccgtaatcggcaaaaactggaggtggtgcttgctcagcttggctgcttggggcgtcgagtcgagatggatcggagcatgcaatcgttgagttagggttcaggttgaatctcgggctattactaaggctgtgttcggtaggaaggataggaactaatctcttctatacggaaaacagagcgattttttagtacgtgattaattaagtactagttatttttttttaaaaaaatagattaacatgattttttaaaacatttttttgtatggaaaaatttttcaacaaacatatcgtttaacagtttaaaaaacttgcgcgtgaaaaaagagtggagtggattcccaactgctcctgccgaacgcagcggcgaatccagcatggttgttggggggactcgagtccccctaactagctggatcatcattgatagatggagagatgaaagaggtaaagagggagaaaatgaagagtagggggactgaaaaagaaagaagaagataagtccccccgaatagggagtttggctaatctcgcggactttcattttgtacaggtgtaacgagaaagcggattgggtggtcaactttggttttcatggatatggagtttggtgcgtttttctttctttttttttttactcatgcaaagtgggcttttgcgatgcaagcgtgcaacatataaaagcgtcatttgatagttcattttctaacaagtaccgtagtttttttaaataactaaatttgtgataaatgggagaaaaacatacttgttcattttacttgcatcctagtgggtcttgcactatgtgagatagtatgtaaaggaggatggacgaatgaaactccagctttttacaaaaaaagttagaaccttggctggactgaataattcatccgacctttattttttcatgaaatctgatcttcctttggatatcacgagacacttacatgcacttgtatctcaaaagatttatctatggccagaatccagataccatgcatgtcctttttccgatcgcaatatccaaacgctccactcatagagaccgcgtatagtcgtatacccgcaccctaaaatacgactacaactacaagacgatctttccaaaggaagaccgaaatcagatgacgactttattcgag

SEQ ID NO: 30880 - DNA, 1251 bp, Oryza sativa
ggagatgttctccgggctccagtccgcgcgcaaggaggcccgctccaccgacgccgccgttctcgaggcgcagctccaccagatgctccgcgagtggcgcgccgagctcagcgtctcctcctccccggcctcctccctccaggcaagcgcatcacgcccctccccaccccccaccgtcctccatttctaggcttctcctcggctcacgctttcattgggggggcggatttcggttagcagcaggggaacaaccgggagctgtcggatccgccgtcggagacgctgcggctgctgcagctggcggcggccgagaaggaggaggacgacgccaccagcaagctcgtcgagcagcagcagcagcacccgccatcggctaaccaggcccacggccacccgcaggcgcagggcggccaggacatgaagccggagccaccggaggaagcggtggcctccccggctgatctgacggtgccgcagcagccgcagtcgccaggtcagggagttctggcgagtggtggagggatgctggcacctgccgctgccgcggtgttccatgatcaggtataagattttttaactttttattactagtctgtcaaacggaagctccaatctttatgcgaactatggtacaatggcaccctattagtagggtggatgtggatccttggaaacgtgagtgtttcttcagagatgtgagcggcttggcttttcggttcggtgtgattttgtgcctgtggtgtgcttttctggtttatcaattatatttgtctactttgttgtgtttgtagagatgttcaatgaagtccttgttgtgtgcgtttagttggatataatgtgatctgcaaaaacagacccgttaaatcatttagtgggagtttctgcttttcttgtgtagacaaacttcatgtgcacttgtgcttgccctctgttggtaatgcaataggcctcaccgtaaccacaacaggaaagctttggtttcgcattgtaatggagatttcaaatggacggcgctttgatctaggtgtattgactatttttagataaaattaagcttattatatgtgtgacataaggtagaaactgaacgttatatatgcgctgtaccattcaattcacttctttgaggcatgggctacttatggccttgtttcagccagcatctttttttttgggggggggggggctcctatagcttgttgatgtggcgtttattgctatcagtaggttattatgctccaatatagcaac

SEQ ID NO: 30881 - DNA, 755 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatccctgcggaaattgtaatcccattcaccagctctacatttaattaacaagagaactattgtatttatctaaacacctgattatctccacctttcatttgatccctatttataaaatacgctgcgttgctaacggggcgcaccttctattt

SEQ ID NO: 30882 - DNA, 7360 bp, Oryza sativa
catcattgggtgagggcgacgacttgaagctgaactgcggtagccactaggtgaaggagagcactgaatgggggagaatcaatctagaatattctcatgggagagagcaaagcacactcatctgtgcttaataaaattggatacaaactcatccttagatagatgggatgacttggcacttaataaataagctcctactcaaaccacaaaataaacctaagacataagaatccaaaccaccaaaatagcaaattaacctattccctaaaggaaaccaaatgtcatgtgaacagtgcaccgtgaataatactgtatgctacagtgcgccgtacgggtactgtttctctgggaggccctatcctctgtattagctctttccctgttattatgcgtcgtacagggcctcccaaaaaaagagactttacaaagtaatatttctttgaaatacacctgaaaaagttatcacactttgctataatgctattagaagcctcttgccattttattgtttttctccaattctagcaggtctattggacatgatacctctggaattatccaaacaaaacatctccttctgtcagctcagactttgtagtagctttttgaaagagccaataaatcaacatcatattggaatcgctagagatttccactacctagattgaacagatcacaatatggcaatgacaaactgcctattggatcctcacacaatgcatatcaataattatggctttttttattttaaatagaaattttattgtccttgaggtaccaaattttagaccagaaaatgtggaccgtaaaaccactctattctaaaagattcaacacattcacaactattgctttcaaattcttcatagcaatcatacatcaagaagtattgcaaatgtgagtgccaatttgcagtctattttttttttgtaagtaaatgaaatcatacatgttgtatcaaaattagagaagactatgtaacatgccaacataaatggacgcatataaaaaagccactaacctcccaagatccaattcttagaacagaaccagggaaattggaagccttcaatttctctgaggcactagcggttccactatgctggacatctttggccttaccagcctgcacaagcttcatttggatcaaatccaccagagaggggctcttcttcagccgcaagcccaatgggctaggctcatcaaggaaaccatgttgggatgactgttgattggacacactaccaccgtctgtgctccagtgctgcatgacaccatgagaaaacacaatatatgattaaacgcggaacattaaagcaaggtaaccaatagtatatctcatttctcacttttaaatttgaactatttgtactataagaactaatttacaatttcatagtacaacgttatgaactaatatataacatttacttttccaatcaagttttatgtactaagtggcaaaaaatggaaaaagtgtgtttctcagatagggaaaattacaatattcctgtaagatcaattaactaaacacaaaaaaaggattggttcatttgttagatggacagaggaatcagtaacagtaacggagaacagagctctataagtgaaaagctcagcatgccaattattaaatccaaatgatgaatgcatgtgattagaagtaacaatatcataggaagaacggaaaccagttccagtaatgcaccaagaaagatttgtgatttgatttgaagcagcacatcttcagatcttcttgtgtatttatgccatttacatgcagggaaagtatcaggtgcaacttctcaattgggcggaaacatgcaacctatttatatgcaaatagcccctatcttgcgatgttgttcagaatgtttgcatgacaacaagtgaaaaggaacaaacagatatagaaactataataaagagcaaatagatataggaacagtaatttctcccattgctaaaagaatattaggtgaagtacgcaaaaaaaaaaaaagattacaagcaaagaaaagcaaccaatgaaaatgatagatcagctttttaaaaccaaagcagcattaatttttctgaggtgaaatcaaatagtacagctactggtttcgcacaaacacacacaaaaaatgagaaaaggtccagcaagtgggctgctccccagaagattagacagatcaacattttaatgttagtaataagttttaattgacaggaaaaaatctaaggtaaatttgaattcacgaggagaaaagctaaagtaaagtttaatcactaccaatccaaatccaaaaaggactctgtagtatgaagtgaccgccgatggagacctgtatagtgagagacataatacccaaattggaagactccgcacgtcaatatctaagccaactatggatggataaattggtaatacaggtaaatatcttggctaggtacagaaatcgaatcttattcgaaggagtttgattggataaagtcacaaataccctttcacttggactcaccaagttcagaattatcatctaatataatgagcaaaaatgatgaacaagacaaattgcccacggaaaaaaaaagaaaaggatgtatcatgcgaatcaaactttgaactaataatcatttttgttttcggaacgaactgagccaataataaattaacagcacggcgagaaaatgttaattgatcgtcacttgctcgtacgaatttcttcaaaacaagctgcccctccggccgctgagtcacaaaataatactccgctccaataataaattactcatcaacagtagtactagaaatagtagcagagagaataaatcaaattcctcctgtatgcggaatttcctcctagagaaacgagaggaacaccgaagcaacaggaaggagagcgaacccacctgtagagcaaggcgggacctcttgtggaacggcgacgcctctgcctgtgccgccgcgtcgccgtcgtccagcgcctcctccttgacatcccgccgcagcttcccctggtgcggcagatgaaccatcgtctctccgccgccggcgtcgttacttgtttcccaaccagaagggcaaaagagaaggaacagaggagaaaatactctcttcttgttcagttgtggtggtttctggtttgtttgtaccgtacggagagcgagagtgcgagacaaaccagcgagagatgaagcaataaatatctcggagatggtaaagcactgatggattagattggtttttcgtttcgaagcgcgtgccaactggatctggattttactctagtgtgtgtggtactgtggtgctccaccgcgaatttaccagactgcccccaccttcggccctgctgctttggcggcttatccgccaccgtagtctattgatagttaatgctcctatatcagtagtcgtatttaggatctatttaagggagtttttagctgctgcagctttttttaaatctccaactcttctaaacagttttggttgtcacctaatatgtaattgtagaatctaaaaaatgaactagaacctcaaaactggaaaatctcaaaaaaaaaatgaactaggacccatatagattctcataagctagctaccaactagcaaattctcagaatgttaagctccccaaatagagcctttatctcatcccaggctactaaatttttggacgaagggaataaagggatgttcgattgtcgaccatactttgtcacatgttgccacgttaaaaaaaaaggcaagtttgaggctgtttggttataatgatagttgtgacaagttgtctttcaataaattgggtttcatatatcaatgactcaaaaaagatattaataacgtttataactttaactatcaataacttcaaaactatttagtttaaaggcactaaaacaacatatatagatttgtctacaaaatctctactattataaaaattgaagatgtttttgtcgttactttggtacatcatctgtgttttgagttggtttttaagtttattcgcttctagaaatacaaatccgtgtttgagtcgattttcaagtttgttcgcttttaaaaatacagaaggagccgcataagaaatctctttagaaaaactcgcatgctaacctgagacaaccggaccagggttcacgattccgatgaaaaccggtcgaattccgcgaaattttgatattttgacaaggctcggaattaaatttcgattggaatttcgaaggttaaaaagtaaatttggtcaaaattcagtcgaagtttatcgaaaatcgtgataccgatggggctcgaaatttagtggttaactggtaatataaaccctggaccggactcctaattgcagctcatgattttatataaaaaatccaagcaaattcccgcagtgaatttcaccttagctaagccgcacaataataataagattaaaataactttcacccattgccacgcacgagcatttttctagtactataataaaagtgaaagatatatttttttattatattataataaaaaagtaaagatatattttcaaaacgtgctattatccaaaacaccaagaattacaaaatcggaggaggaaataaggaaaattgtctatatgcatgcatacagactcaattttgcatagatataataatattgtccatcaaacaaacaaaagatcaagagatatatgatggttaattttttttaaaaaaaagaaatctgatttttggttataggagtactggggtatggagtgaaggaagcaagggcttgtttggtttgcaaccatgctaaactattggcaatgccaaatcatgggtaagtttttgccaatgccaatattttagcaacatttatgtggtattgacaagtattggtagcaaactaaacattgccaaaattactgtttaaaatgctaatattttggtatggcaacttttggcttcaaacaaatcagccctaagggtgtgtttggataatgggaaatgagaggtgggattgggattgggaaatgaatgaagggttaggattaaatgaaagggggagaatgaatggttagcatttaaagatgtcttttggtgggtgggaaatcatttccctatcccatttgccaaacatggcctaactttgtacctctaggggcaaaagcgtcagacgaccgactcggcaattcgcacgaggcaggagtgggcccgggggggctcgccttgcgaagttgcgccgccggccgcaccgtgagcagctggggcacaacacgtggacgctgcccgctcttgttgtgacgtggttggtggacgtgacatggacgctccgcttcggtactatccgttccgtttgagggagtatactactgctactagtaggtggcttggcttgtggataaggtcgtggccggctgctaccaccatccataaagcgacaaattattgggggagaaaggaaaccagacttgggagtagtcgtcgtttccttctttcctgcctttgaatttattcttttttctgttgtaaaatgtcaagattttttctattggaaatacagcacctacgataagtactcaaatttagtactagataattttatcacaggaaacctaatcagttaactaagctaattgaactatgctcactttattatggtataaattttaaatcccggaaatacttatggttcgaaacggagaaaatagttaattttaggacaggggagtagttggtaattatctatactatctatattctttaaaaaataatctcaaaatttcaaattataactaccccaccttaaaatataacaacctctagggttgaaaatttctcctaaaatagaatagtttctctaccaatcaaaaccttctccaatttaatttcacatactttggtaataatacatgtgtccaaccgtaaacatcgcttatattttgtaacagaggtagtaagaggctaaaaaatattactccgggatttaatacgtgaaaattatattaatagaatttatggggaaaaaattttatatatttacttttttaataaatttaaaaatatataattacaaaaggtagtgataaaaatatatccatggtttgagtaatacttttttttatgaaaaatatggtactcactccatacatacatacatacatacatatatatatatatatatatatatatatatatatatatatatatatatatatatatatatatatatatatatatataggtttttagtgagttcttgttgacggtcgttaagtacaaaactttaaccatcaattcatgcataaaagatatcaaatatattatcaaaacttagtggtacgagtttaactactaaccacttctgctaatattagtaaatagatatatgcatgttatttaagaagaaaaatgcacccgacatgtgacgaaaatgaacctccggccaaccaagcgcgagtacaaggagggccgacaagtcaatcgaaaccgacttaaaagtaagaccaaccagtcctaactgccataagggcctagctagaggagaggctaggaggtgggggccacaatttggctgaaccaaccaccatagtggcgccccatcctggccttccacatggagtgtcctgatgaagtcccaatgacggttgtaaggggaaaaatgtcatttaactattgttggcagttataaaggaggtcttcacatacttgaaacacacacaactttgagctcaagtacagtacaactcacttgtagtttcatattctctccgtcgcacaaaaaactaacctagtactgaatgtaacacatcctagtactacgaatctggatatacatatgtccagattcatggtactagaatatgtcacatccggtactagattcgttttttatgggactgagggagtatttagtaatgttagtttggtagaaagtgaggggaagctctggaaggagtgtcctgaaaaattggtgttcctccaagaattttatggagtgcatgagtgttggcattctttcaacggagttccagggaaatccaggattgtcggccttcttctctcgcttgtacctcagcggatagttatttattaaaataagtatttgagtttctgtatgttctttaattagtttatttaagtgagatatattctcatcagtgcagattcgtcgcttagtgtgcaactgagtgatctagtactaggactcttggataaataaggaagtacctacgcaaggctagagtaataattaataagttaggcatggtgtttaggttagaaattatcttcgttagttgtgtgctccaccgaaagtgaggtaggcggaaggtagtgatagccctgtccgttctttgtattcctccacatttgggtacatcatgcatagagctcaagg

SEQ ID NO: 30883 - DNA, 11449 bp, Oryza sativa
gttctttgtattcctccacatttgggtacatcatgcatagagctcaaggccggacttatcctggcagagcaggggagggccggtgcccgaagcattcattagagttttacttttaactttattaactaattaaaagacataggaatactctctagccaatttatgttaggttgttgtatccttggattgaatcctggtcatatataatacacatatgttgcttgtgttcgatacccttgaatactctaaggagaactgctacaatgttattccgcgcgcttgcgaatttacatgtgatcataaaaaatatcaacaattctacaattttaaagtcattagatggcaccaaactaaaaaaaaccgttgtaccaaatttgcagaaactctatatatagagggttcatctaataatttatgagttatgcagttaacttttgccaaatagaccaatatcggttatggagatgttttaatttttcagagaaaccaactattatcctaatattctattgcttatcagattttatttgtccccgtgactatgacatcagctgagagaagcttttcaaagctaaaattgttgaagaaccatttgagatctataatgtcccaagaatggtttaaacggtctgacaactttatatatgttgagaaggaatttctggatgagattaatattcataccaatatcaatgacttcatatctataaatgtctaaagaaaatttgaaggtaatatatgtaaagttttttcttcaaataaatattgcttttggttgcaggtaatcatgatcgagtctatgctggtgatgggttgcaggagttctgactgtttctcaaaattgtctcggattgttttttctttttttttgttgtggcaaagcccatcaggcagcggaagagtgatatttggaaggacgattccgacattaaatgtttaaaagtaaatgactggtgtgctggtttttgctgctaagaaaggggcaagtttgaagcaagacggaagataattcgaagcttagtcttctttttcgttttaattttatgttgttcctcagttgtgaagcctgtagtctacgtatccacgtgtagatatagagggcagatttgttacccattatggtaaaaacaatgttgatctcgctaaaatttggtattgtcaatatttagctttaccaacatggtctaccatatttgacagatccatcacttgaatcaatcctttgagtcagggtgtatttgagaagagaggaaaagagaagataggtaaagcgaggcgagtaatgagcgtataattaattaaatattaattattataaattaaaaaatggattaatataatttttaaagaaacttttgtatagattttttttaaaatacaccgtttagcagttcaggaaacgtgtgcacggagaatgaggaagtatttctccctaagtctattcttccaactaggaaacttttccaaccatatgggtactgtttatgtagaaaataaaaaaaatgacttcgttaccgattgttttcaactataaaatttagtttttctaatttctacgttttattgaagtttccatttaatagttaaatccatacatatgaaaattcctgaccgtatatatattgttatcatagaaggtaatactgtttttatcctacattcgacaaccaataatatttattattgataatataagtgttcccctctccagatgcatgcaccatttacgaagactcatgaggtcgtgttttgccaactctcttacgaatcatagttatcccacctccaagctttcatgacttaagcaccatacaaaacttgcgtgcgttgtgtctaccgtgtaattgtaaaaaaagtaaaataataaacttttttgaacatgtaggattacttactgttaagcagctagatttgtggattgggccatgcttgtgaaaaagggtaggaaaagttcaatttgactccctcaatatagctagaatttgattcatatcacttaaccataaaaccagatatatcggtttctccaactattaaaattgttcaatacgactcctttgcctgttttgtaagtggatttcactgacatggcgttcccgtggcaacttagtatgtaggaagatcaaaaatagacatgggacctaaatgtaagtgagatgaaaaaaaaaccgtggggcccatgtgtaagcccccactcttattctcccctcgctcgtcctttctttcacatggcataacaccctggcggtgggtggcgcatgcctgctcatcaccctcccactaggcgaacagtggcgatgacgaaggaagtcgacgaggcaaccgccgttgcacaaggcacatgcgccgggagccgatgttgctcctcgtcattgtgccgaggggtccaccatggagacacggagggcgcgcaggggtttggctatggcgacatcacgataggctaatgacgtttgtgaagggcaccggtgggttggggttcggcgataggcgacgtgacgctctcgcacaacatcgtgatgcaccactcctcctcatcccgccgccaccgctcattcttgctccccaccatgttcatcgccgaccaggcccgccagaagcccaggttgaagccttcctcctccacgtgcaatctacacatcgtcattggcggacacgttcttcaagccctcgtcatgcaggatcttgcgccgcgtcaccatctccggctcctctctcgtcggctactgcccctagtcttgagcgggatctcgctccgccgccacctttgacgaggaggtggctgaagcagggtggagcagctggcgagcaggatggcaccgctgctctcgactcttcttcttgcaccccctcctccttgccgctcgccgccaccggggatggggagaagccaaaaaaatctaattgttgtattatgttgttttctgatctattagatcgaccctctcatagagtatatacactggtggagaaaccatctttcgtcagtcgggctaattccacaatagtcccggttgcaacaaaaactgggactaaagatgatctttagtcctggttaaaaagggtaacaggcatatttgatctttaatcccggttggtaataccaaccggttcagatgttgtcagggcttgtcaggcccccccgggatctttagccccggttcataacaccaaccgggactaaagtcccacccctatatatatgtcttcttcctcctccagcccgagcaagcttcaaaatttcttcaaaaaagaggggaggccatgctaaaatttctagtgaatttattttggtgattatatacaaatcggaggtgcctaaaaggttagcaacttcatcctccaatgttttttttttcatattacatttggaactatgttttgcccactttttgtctccaaaattttgttgttagttgatgagagagaaaatttgtgtggagaagaaagaatatatagaaatttagtttatttgctaaagaaggttttataaaatagttgagaaggaaaatatagtgaaagttaatcttgaataatagaaaccaaagtaaaatgaaaaattaaaataagtacagcacattaatattaatattagtttaaaactttataaatagtaaatatataattattcggtgtaatatttcataatttttgtatgaataatgatatgtcattattgtgtgactgttgaaagagttcgtaattattttataattattgtatgactgtcattattgtacgaataattatgtgtgtacgatttttttcatgtcatgtagatggatcggcaatggatgtacactgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataaatgttggacatcccacggagagcaaggtgttgaaatggaagaagatgaagtggaagacgacaatattccggactttgctcagtacgctggatttgaaggaaatcaaacgggcgaggaggaaagggatgctgatggtaacgacgttgcggatgatcttggtcagatgttgcaggacgccaaggaggactgcgaaagtgaaaaggggcccataaattggacaagatgttagaggaccatagaacatcgttgtacccaggttgtgagcagaggcacaaaaagttggataccactctagagttcttgcaatggaaggcaaaaaatggggttagtgacaaggcatttggcgatttattgaaactcgtcaagaacattcttccggagggaaacaaattgcccgagacaacgtacgaggctaagaagatagtttgccctctaggactggaagttcagaagattcacgcatgtccgaatgattgtatcctatatcgcggtgaggagtatgagaacctagaagcatgccctgtttgcaaagcactatgatacaagattagacgagacgatccaggagaagttgacgggcagctaacaaagaagagaattcctgctaaggtgatgtggtatttccctataataccatggctaaggcgtttgttcaggaacaaggggaatgctagaatgatgcgatggcacactgaagagcgtcaacaggacgggatgctgagacaccccgccgatggttcgcagtggcgaaacatcgacagaaaatttgaagactttggaaaggacgcacgaaacatacggtttggtttaagtacggatggcatgaatccttttggagagatgagcaggggccatagcacttggcccgttacgatgtgtatctacaacctccccccgtggctatgcatgaagaggaagtacataatgatgccgattataattcaaggccccaagcaacctggtaacgacatcgatgtgtacctaagaccactggtcgaagatcttaaactgttgtggaagaaggaaggtgtccccgtgtgggatgaggacaaataggaggagtttaacctacgagcgctgctgttcgtaaccatcaacgattggcctgcacttagcaacctatccaggcagtccaacaaggggtacaaggcttgcactcactgtatggatgatacagaaagtacgtatcttaagcactgtaggaaggttgtgtacatgggtcatcgtcgattccttgcagcaaaccacccggtacggaagaaaggcaagcactttgaacataaggcggaccaccgtacgaagcctaaacatcgcggcgggaaaacagtgtttgctatggttaaagatcttaaagtagtgtttggaaaggggcctggcagccagcctatagagagcgaagatagtcacgtggcgatgtggaaaaagaactctatattttgggagttaccctattgggaattcttggacgtcctccacgcaatcgacgtgatgcacctcactaagaatctttgcgtaaaccttcttggcttcctaggtgtatatggaaagtcgaaagatacacgggaagcacgtaatgatctgaagcatatggaacaacgcggtgaccttcacccggaaccaaaggagaaaggaagccattacttgagtccagccagctacactcttagcaaggcagagaaggaaagtatgtttgaatgcttggagagcatcaaggtaccgtctggatactccacgaatataaagcgaataataagcacgaaggagaagaagttcacaaatctaaagtctcatgactatcacgtgctgatgacacaactgctaccagttgtaataaggggtatcctcccagataatgtccgggcaacaataacaaagctatgtgctttcatgaacgcaatttcgcagaaggtcatcgatcctgatagattagaagccctgcagaatgatgtggtgcaatgtcttgtcaactttgagttgatatttccaccttcatttttcaatataatgacacatctgctttgtcaccttgtcaaagagatcggtattctcggtcctgtgtacctacatgtcacatcctgatttttgtttcaggatttataaattatttaataaattaataatagaatttatattaaatgttctttaatttacaagtgaagttaaaagtgggaaataaaatttcctaaatataaaacatggatggatttaatttttattaaattctccatgattaagtcaactctctgaaattttctcgaatttttcagagctcaatttctaaatgatacaaagaacagttcagtaattatttgatcattaatgatctaattataattgttaagagcttttcttgtttaaaaatccttaaattataaattgttgtttaaaaggaattattagaaatgattttaaaagcctaaaagaaaagatctaattttaatttgttaaatctcaatataaaatttggctagataaaattttattaaatactttgcttaattctataattcctagatttttttgggatttatttgagctaagaaagtatttttaataaatggaattgcatttcatgaataatttaaattgaaaaaggtttttaaaagtctcttttggctttgggccgaaagtcggcccaaaaccctctctctctctttccctcggcccagtccggcccagtccgccgagccgccgctctcttctctctctctgtcgctgacaggtggggcccgcctgtcggagtcgtcgtcttcgtcgcgccgccgccgcccgaaaccctagcgcaagccgccgccgtctccttccaaattcggccgcgtcttttcttctccggtgaaatcaatagaggggaaatgatcctctcgatctcctcttccttttctcttttggaatcttcggctaaaatcgtttggaaattcgtggattcgagttcaattcggatcggcctctttcctccgaaccccgacctttccttctcgtccccggcagccgtgggccttcgccgtcgcctccttgcccctttaaaagcacccccggtgtctccgctacccgccgcctctctcgccttcgcccgccgtcgtgtgtagcgccctagcctcgtgagcttttgcgccgccgtcgccgccgttcgtctagccgtgcgccgccgtcgctacggtcgtcgtcgtcactcgggaaggccaccgtcgggatcgccaagtcgccgccgtcctcgtccgcctcttcgccgccgccgaagactgccggagcaccgccgtcaccgtcgacccgatctccgccgccgtttcttcctcgtcgccggcgccgtccgttgcttttccgccgccgttttggtcaccggtgagttcgccgcgccgcgctctacgtcctggtgccctccgttctcgtcgtcgcgccgtcgttcgccggcgagcttgcgctcccgagccgccgccggtgctgacgtcatcgctgccgtcatcgctgacgtcatcgttgctgtccccgtgagccggtcgtggaccgttcgatctcggccgtccgttttggatagggttgatctcggccgtccgatcccgtgaaccgttgccgtgtgcccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattataatctacatgtttgtttactttttatgtattatttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcaactagatattagatatgattgcttagccatgcttagaaacattagcacactattgggataacttatgactcattatttaatgatggtttaatgatagttcacgatggttaatcgtgattggttaattaattacttgccaactaaaatttaataatggtgggttgtgagcacatggttttgagagtcgtgctcatgacaattaaggaccggttcgcgagcttctattgtgaaacattaaccgtgccaaccacaagccagcgtgggcaacggctttaccttttgtataacatgattcattgcggagcaccagactgagaagtggcggagataagcacacgggggtcgctggggagtccatgcctctggtttttgagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctagccagagtaaaactattcgaatagccgtgcccgcggttatgggcgagttgagcaatgtttttcgtgattagtctcacacctcccacaataattatggatgttataactggtaataatttgcttagctcctggtttggagttagatctgtacagccgggtatggttgttcagaatggttgggcctgtgcagcatgggtgtgctgttcagtgttgattaaaacttctgattaattactccactgttttattactcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgttttctttatggtgaggactaagtgcctcttaagtaagtatttatcgttttagttaatttgatgaatctgtatattaaattgtcagtttgtgtacctcggctgattcctggacgaggattttatgcacaaataagttcggtaattacttgtgaatttccgggcgtgacactacacaacatgtttcctttcgagaggtacatgggcgttctgagggaaaagtatgttcataaccgtgctcgtccagaggcaagcatcgccaaggggtatggaacaaaggaggtcattgaattctgcgtagaatttatcgaagaccttcacccaatcggggtacctgaatcacgccatgaagggagactacggggaaaggggactctcagaaggaaagcaataatgacggtagacaacaatttattccgtaaagcccatttcacggttttgcaacaatcttcattggtggctccctacatcgaggagcacttggctctagttcgcgccagaaacatcggtaagtccgatgcatggattacaaggcatcacattgatattttctccacgtggctgcgacaacatctcatgggtaacgagacgattaaccaacaactggccttcctggcgaggggaccatctggctcgatcgcgacattccaaggatatgaaatcaatgggtacacattctacacgagggcccaagacatgaagagcacgaaccagaacagtgctgttcgtatcgatgccatgggacacgatagtacaactggcacgtattacggtgccatcgaggacatatgggaacttgactatggacctctcaaggtcgctctgttccggtgccaatgggttaggttgactggtggaggcgtaacgattgatgatagtgggatgacaacggttcaacaaggttggatactcggacgaaccttttgtccttgccaatgatgtaacccaagttttttacgtcaaggacatgtctagcaaaggaaaaaaggccaaagggcttgacgagccgaagcgccacgtggttctcccaggaaaaagaaaaatcgtcggagtagaggacaagactgacgaggattatgatcagtttgatgggcaaccccctttcacagtgacgattgaccctagcatcctcctatcaaatgaagacaccccttactcacgtagcgatcacaaggaaggaacaatagtgaggagaaagtacgtgcggtcaaccgtcaccgccgatgtattgccgtaattgttctgtacacgatgtaaactatgttggatgtattgaatatccatacaaatcaattgttgtatggtatatgttaaatatgtatgattattagaatttttatcaaattgaaatcatccatatgctagttatatatgattattatattttttattaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtaattacatatgttaattagaattttcaacaatttaatatcatgatatgctaattatatatgattattatattttgtattaattttaaatcatgcatgtgctatttacatatgttaattagaatttttgacaatttaatatcatgcatatgctaattatatatgattattagaatttgtaacaattttaaatcattcatgtgcttattatatataatccacgtattctagtacatacaacaataatttttcgaaggttttatcattaattgttcgactttaaataattgtaatgcattatttactattttagaaacacatatgcaatgaaattcaagacacagctgctattatctttagtcccggttcctaaccctaaccgggtttaaaaagaatttggaaatagcgggaaaagatctttagtcccggttgttgttacgaaccgggagtaaagatatttttactcccggttgttctcaccaaccgggactaaagatccgggggtatatatattgccggtgcgccctcgtcttctccaccaacacttagacatttttcgatctcggatcgatctctttcgccaccaccgtgcctagggcaaccccgcaccgacaccgccgt

SEQ ID NO: 30884 - DNA, 8629 bp, Oryza sativa
aacgttaacgaacacgaacgagcgtaacgaaatgcgaacgaacgcgaacgaacgtaacgaaacgttaatgaacgcgaacgaacgtgcacgaaacgttaacgaacgcgaacgaacgtgaacgaaacgattacggaacgcgaacgaacgtgcacgaaacgcttacgaacatgaatgcacttgtactaaaagtgaaagtgtgagaacgaacgcgtttatactaatacgatttactggtaatacatatataattatatatgtaacttggcccgtttagactaatacattttcctggtaatgttgcagagaagacatcgtcgtcgtccctcaagccgaagtggtagctagccatcgaaggaattcgcgcaggcaagtgatgtaaagaagtgattgttagatatttaatataagactgttagacttagcatacatgattattacaattttaatataagattgttatcgatttaatataatattgttagacttagcatatatgattgttagagatttaatataatattgttagacttagcatatatatatgactattacaattttaatataagattagtagcgatttaatataagattgttatacttagcatatatatatatgattattacaattttaatatgagattagtagccatttaatataagattgttagacttagcatatatatatatatatatatatatatatgattattacaattttaatataagattagccgcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttatagatttaatataagattgttagacttagcatatatatatgattattacaattttaatatgagattagtagccatttaatataagattattagagatttaatataagattagcatagttttaatattacggtacgcaaatacatcctatatacctaacaaatattttttgtatgcacagatggctgatcgcgatgaggaacagatactatacgatacaatcgcagagggaagcagccagtactagaacgaaggagaggggaacgaggatccaaaccagtacttgaacgaggaagggaacgtggagaggaatgcggagggaaacgaggaggggaacgatgaggaggaggctagtggaagtcatccctccgttggatagaagagggcacacggacaacgaggtgccgcgaagaagatagagggtcggcacatcataactgaggtggacgaagacggccgacctagtgccccggcagaagcagccaagaattttgtacgccacagcggttgggttgtgagggacaacgtgcctgtcagcacagtgtactggcgcagaacaagggcatacggggataatgacagctttgtcccggactcagagaaagagatgctgtggaccacaatgctcgagacgttcacgctacccgcgggtacggagaacatagtgaaacagtggactctgaagaaaatggcagaacagttccagagcttcaagggatcattgggacgagttcgttgcttacaagacagggcaacaagggcaagcaatgatggccagaaacaaagacaatgccgccaagaagaagtaccatcaccacttggggtcaggcggatatagcgtcgcaatgccgaagtgggaggagatggaggcaagtttgattgagaggggtatcgaaccggccaccactaaatggccggatagatcgaagttttggtactatgctcatggtgaaacgcttaacctagttgatggctcccttgtcttcagcgatcagatacgcgaggctgccagtcgactaacgtacgcagtggtagcctcttctcagggcacattccgacccgacagagagaaggatgagctgtcactcgccctacagactcccgagcatccaggacaaacacgagggaaaggcgtgattccctggaagattggatttaaggaggacatccacacgtacaggagtcggatgaggagcaagagagatactgaggcgaagattgcagatcttgagtacagggtatcgagctacgagctcaacatgcaagaggaggtggcaaggaaggtggatgaacgtatggccgcacatcggtcccaggatccccagccgtacattcatcctgcaatggtcagcccatcaggcaattgtagcagctgcgcctcaacggggcaggtcggatcacagagcatggacgccatgcaaacccatgacgaaaccacctgccccgttgatgagatcacgcaacggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcatcgggaatggccatcccaacggacccttccgggacttaccactgcaggccgattccagcaggatactcgagggtcgaagttgagctggtggaagccgcgtacgaggacctcgagttggactacccaggaggagacggtgagacgcatctacgagacacaagccacaccatcatactatggcgcaagcggtacatcatccttcctgggcgacaagcggcgtctcgtgcaccatctcctacggctccgccatctcctcctgcaccatctcctccggttcctccgccacgtcctcctgcaccatctcctccggctattccgccacctcctgctgcaccatctcctccggctcctccgcctcctccgcctccaccgtgtccgcctgcacctcccaagacaaggtctcgccaagctccaccgcctgcccgcacaagggcaacgaagaaggcgaaagttgacgccaccaaaaacaaggagccaccgtacgattgcagtcaagaggagcttgatgctaatgtggcaggagaggtgaagaggcaactcaagcctcggagtcctaaaaagaagatacctattgacccgagcgtgaagaacttcttcaagggaatgtccacaacaaacaaggaggcattacagatatcggactatgaccgaacacttcagagagcctatcacaagaagtccaaaccagtccctcagtttggagaacaaccaaaccaagaggtcgagccgttggtgaccggcgaagattttggcataatggaattcatttcagacaccggtctaactgtggatcagttggttggaggcgcaccaatcccgaaggcggaagtggcatacaagtttgaactcggtaaaccgcttgtcaaacctgaacagctgtagtccctaccgacacagatgtacaaattccatgaacggtacatggaaatgagcgccaagggtagagagatgttcggagcgaggatcagaaaccccgacttcttgcaaggagaagatgttctctagatccatttcaaggatctcttcgatctgtaccagttggacaccctcgacgtctctcttctgagcgcatggattttgtgagtatctttgagttcgatttgtttcgttcaataattaactcttggcatatatgtaagcaataatactttcctttcatcgttgtagaatggagattcaaagggcccgacggcggaggttctacgatactgggttcatcgaccctcggaaaatcaacaccgaaatgattgacaagtacaagaaagacacagaggacaatctcgtacatctcctaacgcagcagcatttcaagacgtacatactactgccgtacaacacagagtgagtttttattgtcgttcgaacaaatttcgttcccatacatatagcatgtacattttcgatcatatatatctcatctcacgcatattccagattccactgggtcctgttattcttcaacttggacgcatgcagagtcactgtgtacgactcaatgaataaagaggagaagatttttgacaaggtcttcaaactgatagacaggtaatataatgtcatctattccaaagtcacggggaatctattgctattatgttgatctcaggtaataattaattaatcatagcttgcaactgcatatgtagggcttgggataggttccgtcaattggtccgcaggacttggaaagaaaaacttggatggaggtttcattttccagtgagtacatgcatgatccaaaattatattgaattgaatctctaattgcagttaatataaatagtatattaaatctctcattgtttctcatgtagtgtgcaaagcaggaccagggaactaacttatgcgactactacgtatgcgagtatgcccactgcctatcaaaccaaatatgcacaacacgagagctcgatgtacgtatacataaaccattcaaaatttcattgctcgatttgttaagttgtttattaatttcatatattgatacgtcattatttttcgaacgatagcgtattcacatgagggataatctcccacacaaggattttatcacggctgttcaagaacaactgatgggattcatcaacgaagaagtccttaatcccgacggtgaattctactacgacggatcgacaattcataacgtcggtccttcctcttctgacataacgccggtgtcgaagtcgtagctatagctaccgagcaaataaattgtactatatatgcatgtatatatatatttatatatgtacacatttacttttgtgttaatatataatttggtaacatatatatatatgcacataaaatgttaagtgctttaaattatacatatgtgtgtgtaatatatgatttatacacacacacacacacacacatatatatatatatatatgcctatatattatgcatatatatgtattgtaacatatgtatgtatgtgtgtgtgtgtctatatatatatatatatataatcaaccatgcagcaaacagggccatgcaaataaaaaaaatggtgcaccgatctttagtcccggttggtaacacaaaccgggactaaagatggtttggccggccatgtggctgatcgatctttagtcccggttggtaacacgaaccgggactaaagatcgatctttagtcccggttatttcacccaggactaaagatagctatctttagtcctagattcgtagtcccggttggacaaccgggactaaagaggggttaccaaccgagactacaaacagtttctcccccagtgatataggagtacctaagagatagagacttgtagtacaatacaaataagagtagatttatctcgattctatctctaggatatatcttatctctatatttgtatttgactcttatccctaactaccatatttgtacttctaacattccccctcagtcgtaacgggagcaaagcgaatgattgcgactggatttgaaatctatttcttcatctccttcgagtcaccatcatcaattgcatctctgatggacggcccttcacctagtgcctacgcccccttctatgttgtcccttgactctcctctgttccctcccgcagtcatagtgggagtttcatggacgatagcgatgacacagacgctttgactggagttgccacagatgattcttgttgtagatgttcgtcaatgtagccgatcatgaagtagccgtggttgtaggtgtagccgcatatagccgaaggcgaaaaaaaaattacgccatggtgtgaagacgatactacaattagtagcatcttgcaccttgtagatgtcagaggatgccattaggaacgtcttgcatatgtcagaggacgtcgttggcgatgaggccaccactttggttggtccttctgcgtcgtgtagtggtcatcacaatagtgatgccgtgttgatgcagtcgttgttgttgtagatgatgtgatcgatgccctcgttggtgacgcggtcgttgccatcgtagaggatgcagtcgatgtcatcgatgaagcgtcttgcagattaatttgtcagagcacgcgaggtgtccatctatgtgtacgagtcagcagcggcaagttgatgaagaccactggtgatgtagaatcggcgaagacgatcacatagtcatacaggttattgacacagcagttagtatgttgatggagattgaaggcagcagcactgctccaggtagagatgataattgggttttatttggctgtggctaatgaaggaattgatctaatgctaatattggtaaaatctaatctatggattatttatggcagctaatgatgcagagcccctcctaacagtgtttttcgcatcaacagccccagggagaatatggtgatcatctcatctccccagggcgatgcgagcggaaggtaggaacggatcaaacgacgttggtcttcggctatgataccatgtggaaaaaaaatctaattgttgtattctgttgttttttgatctattagatcgaccctctcgtagggtatatataggagtacataggagatagagacttggagtacaatataaaagtagatttatctctaggatatatcttatctctaggattctatctctaggatatatcttatcgctatatttgtatgtgactcttatccctaactaacatatttatacttctaacaccctcctcccttcctcggttgatttgccttcgacttgctagccattgggcacatcgcactccgctgagcttggaccgccgccgcccccacgttcttcacacgttacgtcaccccaaacactcggtgggagcatagaggggaagatatgagagagatagtggcacggcatgtgggtcccatgtctaaatttttatttgcttttaagactagttgccacgtagatgccacatcagccaaatccaatgaggaagtcattttacaccgattttaataattcgaggagtcgttatacccaattgtaccattgagtgagtcgaattagattcgtcctatattttaggagtcatattggactgtttccaaaaggcattgaattgacatctaaaagacattttcctaacaaaatattattgtagggataatatacctatttgaactttgaagaaataaggttcataagatctattttatcaagaattatcaagaaaaaaaatacatctaatgttaagtaataagccattgaattgaagaagatactagagtcataaaaaaagcatgagtcaattttctaagaaaataatattctagtatatatactgaattttgaacttagagatattagatgtactagcatattacgtgtgtattgcaacataattttaataaaaaaatatcattaacccattataactattgctttttattatatatcatcttttaatttctatatatatttgttattgacaagtgagcctctagtctcatacgtcccttttcattaaaaaaggtaggggttagtaataaaggtggttaatatgtgggttctctgatccataccgtcactttttcattctttgaaaagtaaagagttgtgggtgtggataattcatttttagaaagtaaagagttggtggtcctcgttatgccaaaatcaccgcttaccaccatcaccactttttaaagaagtacagataaaaggtagagagttggtaattagaatagtgacatactcatttatcactactccctgttttataaagaagcgtaggtaattatgagagtgccctcttattatatgtataatttaaagtaagacattaaacggaagatggtgagaagttatcgcacttctatagaatgccacctgcgccactagccaacccaataaaggaagtgtcacgtacattacatgcaaagcataggaacatgaccatgttacgcctccactaagctccatcttaaaaaaaaaattgttcggttaatttaactgtataagaagccaattattcagactacaaaaagatctcctttgaacaacttacaaaccttacgtgctatggtactattggcatatttcaccttaatataaaattgaagatgtttttatcggtactttggtacatcctccatatataaatcggtttttaagtttgctcgcttttagaaatacatatatgtatttgagttgagttttaaattcgctcgtttttggaaatacaggagtcatataaaaaatctcttaaaaaaatacatgctaacttaaaatgattggactctaattacaacttatgattttctataaatatatatatccaagcaaattctcacagtgactttcaccttaactaaaccgtataaaataaaataaaatagccttcacccattacatgcacgggtattttttctagtaaagtaaatagggaaatatattacaatatgttgataatggtaccaacaaatgccaaaaatataccacaccttgaaatgccatacgatatatgaacgaatacgataatatcgatcaccaacttccgttcctcaggcaaattagtcagcaaacgtctaccaaatatctgcgacccgaacctgaaggaaataagacagtaacaaaagctaggaaaatagctagtacaaactaagcagttgag

SEQ ID NO: 30885 - DNA, 659 bp, Oryza sativa
ttttaccctaaatacagagtaacgatgatttaaacttttctccccgtgcaatctgtagacaatgcccagtgctccagtaattggatttgggaaagcatagaagatacgtttgaatctttgatgtacaagtgccatcgcacaccttcgataagaacaagaaatatgtgagcaactgaacagaaagcaaaagcatgatgccatacttcagtaataacttacattgagcaaggttcccagactaggtaaatgtcaaatcctgtacaaaggtatggtctggtttctgacaagtcatcgcagattgcttcatgtgcaatttttttgtcgtcctgaagttcaattctgactttagccaaaacgaggagaaacaatactgataaaggcaacattgaaaaggtagaaaataggagtaacaaagctcacatttctatccaccgttagtcgttttgctgattcattaacagaataatactccatatttccatctgaatttggtttggttgatgatataattgaagggaacatcactttatccctctccgcagcattttcaatcgcaactatggcagcatgtctcagagggtgccatggaaaaccaccttcacagggcaatgacttctgctcagacggccttggtttcatccatccccaagggtttaaac

SEQ ID NO: 30886 - DNA, 14528 bp, Oryza sativa
tcacaatctcgatcaactctttcacttcatccacttccctcctcgagtctaccacgataagagggatggtatgcaagatgttaaggaactgcctcagggcttctgggaacttaccttctgtggtggccttgtaggcagccttgagtctgtcttccatttgtgagaaggtgaaaacaagtgcaggagggcctctcacattaggacttgcagactcactccaacctttctcaacagcaaccggaataatgggggcagttgcaagtgcacgaagatatgagtggctgcccatgtgcagatcgagaaataggggcttgagaggagcaaagtttttgatgcccaattgacggctaagcaatctcattgcagtgtcaaagtttcctgctgctgcgtgctccccagcaagagaagatttctgagtccaaatctggctgacaggcatgcctggaggaggagcaacaaagaccactgagagtgcattaccggcgtttttaggggtctctgcttcaggcggaagttccaggtcttctaggtcccagccaccttcctcaccatcctcctcatttgcttcaccctcctcagcatcaaaaccatcaccaccattcgccatcgcttcgcttgcatcaaccatatccaggtcctcatcaccccagtcagcaccagcagcttcatcgtcttcctcaagttcagccttcccagtagcatccagtccaccctcaaagataccacgcatcaccctaagcaatggccaatcaccactggctgtgagaggtgcaggggggatcaaaagagagcgagtttttccttcaggtagagaaggaatattttcacccaattcagcagcaagcctatcagcaatttctgtgagtccatgggtggcagcagtaatataagcaagaggtagctgtccagcattctctaggatctcaactctcttcatagcatcaccaagatacagagcattgtggaattgacccatcaggttattgttctgtccagcaattttgcacatgaaccccaccttgtccatgtaaccagtaataagatataggaaagcaagcctctcaaaattctttgtacgttggtacgcatattccacaataccaacgtttccctgcctcagggcctcgattcccaaccggtaccagtgatctttgtcatcaatctctttggcagaagcaactgcaatttggatgttaccactctcaagagctaggttaaatcttgtcttctcatctttcacaaagtggagggcaacttctggaaagcctttctgttgcaaataagaaatcacagcctgcccacacagctgggaattcttaatcatactcatcacatgatcgtatcgtttccgtagaagggccagcttgaaaatgtattcagaagcatcaactgtgatcagcttgttctttccatcacgatctaggcagaaaatattattcccaatagcccttgttatgtaaataggaacgtcaagggttttaatgatcccactatctccattgggaagacaatacttgatatggttcaaagtagtgtaaataaacacaccattctcatcccaggcaccacttttcacacggatggtttcatggagcgtacaacgatggacaagcttcttgtttgctataaccaccgcatgcttgctcagcaatgcaatagattccatatcactcgaccaaacaacatatttaacagcaggtgcctggagctcgccaagaattaacctttgctgcagatcaaagatggtcactcggtcttcagctttgcacagcaagttaccagtcccagcataataaattgcatccatcgcaataggaagagggcttttctttacaatttcattcttaagattcttcaccagaacttgattgctactcttctcgagcactgcaaacctgttgcgtgcaacaaaaacagctgacccaccagctcccttctttgcctcctgcaaataatcagtcctgccagcagaatccttcggaactatatagagttcataggagcctccatccacatcagagcaaatcaggacggcattttcagttggactatacgacagtgtcctgggtgactgattcaagctgaccgatccaggtcttcttattggagccaactgaacctccttctgtgtggagtattcaaagaaccgaagaaaacggtccttcacatagaagacagtatcaccactcacagagaaagctggacgttccctctctaatttaaacacaatcataccattgtcatgaccagcggcaagaagattcatctcagggtgggcagcaagaatccagaaacgatcatgttcccgcctgaatgtttgaataccagttcgcttggtggcatcccagacacgaatgcttttgtcctctgagttggacacaatgatgtcttgctttgcatggaacatcacgcaggacacattattcatgtgcccccgcaaagtatcaacttcccaagccttggtgtctgtccaaaaatagcacacttagattgcatcatttcaaatacctcaatagtggtatgcatataatagcgtttggccagtctaccaatgtgcagtagaataaagtgctacgcaacaagagtgaccacctttagtcccagctaaagtgatatactctaggtcgggagctagttactaattgagtaattgtgaaacatgtttcttgcattcagcttgtttggtgacaagttagttacttcttctgtatgataaattgaacaaaacaaatgaatttatcatttaaccaaatccattgttttgtagtactgttatatggaaggatgaatggataaaaacataaatatgtaagtgtttatcgatggaaaatgataatcaaaaagttcagggcgtagtagcagtattaccattcattctccatagcttcacttgccggtcatctgccccagaaacaatgagcggcaatgtggggtgaaatgacgcccagttcaccccacggtcatgcccttccaacacatattttacaactgcatcaacacctccaaacagatcagtgttcatctgggtgaggcgcaggatgtcatccgcaggtgacaccgtcttcttcctcaaagcaccaatatcccatacacggacagtctgatccagtgatgcggacacaaccagatcctccttgggatggaatgatgcgcacatgacatagtggttatgtccagtcagcacagccacacatgtgcgtgactgccagttccatatccggattgtctggtcatcactagcacttactatccatgggtactcgtggtggaattgcacggtgcgaatgtagtcaaggtgcccatgaagtgtgaagaggcagcggtgtgtcttgtaattccacaccttaatcttgtaatcatcacctgcaatgcatcacagaaatcttagaatctacgattcaacaattccatatcccaatcgtattagcccacagctatcccagaaatacaaccaggcggaacaccagtgtgacttaggccctgtttctttcagcttgggattattataatccagattattgggagtaagttgaaagaaacagacaacttattgaagtagcttattataatctggagcccagcttattataatctgataagctcatttaggtgagctttttccagattattgggtgaaaaattacccaccatgccaccccactcctctttagacttgcaaacccaataatctaggctctaataatctaggaaagaaacaactaaccgtttattctactacagattacaacaatctagcttatagtaatctgactcaataatctagattataataatcccaagctgaaagaaacagggccttagtttcaagtttcaacagatcccgaaattgaggtttcaacaaattccaaagttccatgatggcacctcgccattgctaacttgctatggtatcagattcacaactataaaagctgcttctctctagttaaggcctacacgtcgactcatatcttacctcttgtttgaaaggattgcggaaatcaatggagatctcggtcataaatagaaacaaaatgtcacctgaaggtcttaaaactaacaacaattcaccaaacagttggtcttaagctagcatgatagaagaagcaacaccagatccgaccaacaaaatggcacttgcacaaccaaagcagacctaatcgtagacctcgggtgttgccattgcagcatgcagaaatctaacgccctcaataccgacgtggatccaaccaaacgcgcgaaaggcaaataaaagagcacagcaaatgggcgagatctaggaggaatgaatgattgactgacctccggagacgaagagcggctgggtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgctagccgtcccccagcggcggcggcggcggcagcggcaggcgaaacccctagccgctgaggcgagcggaggagagagagagagagagagagagagagagagagagagagggcggtggatctgatctggcgcgggaaggaggttgggggagaggacgatggtatggccttggcccttgggcgttgggtgcccaggacggagacggacgaaggtggggaggtctgggtttcggacgcggtcggtggtccctgccctcatgaggaggtgggagcgcgtgtccgccgttggatctggagaagggaagatctggaccgttggttcggtgtgaccgggttgtcagcgggagagagataccttgccgtaatgcccgactaaatattagtcatctcacatcaaatcaaatgtttagatactggttaaaagtattaaacgtaaactaatgacaaaactcattccataaccgtggattaattcgtgatataaatcggataatgcttattatccgtcgcccagtgcgggggagccggatcgggcgctccccccgcgcgcccctccccgcacgtgcagatctgggccccaccacatctctgctactatatgtcattgcaacaaattactcacatattttggaacccctctattaagagaattcggtttatttttttgttccaccaaaaatgtttcacctagtgttctcacaatgtttcactatatatagatctaatttgcagtgaactgaaatactccattacaacaaaaataaccacatattttgaaaccccctattaagggaattcgttttattttttgttccactgaaaaatatttcacctagtgtacttataatgtttcactatgtatagatcaaatgttgcagtgaactgaaatattctttcgctatttgctaaaacattgtttttatataaggtgaaacaacacccgatttaaacgagtgaaacattttcaatctactcagtgaaacaattccaatatacctagtggaacatcgtgcaacatttaaaaataattcaataataagctaattttttttcatcggaatatatccatgtgtggtcttgttttgaagatttaattgcaacgaatttaatggtgtaatcgaatcatgatttggataagtaatctgagagaaaaaccagtttaaagtagtttcgcacataaatcgagcgcccgatttttgaagattttgatcgggcgaccgatccctagtcatccccatataaatctattgagtctaattaatccatgattagcatatatgatgctacagtaaatataacctaattatagattaattaggcttaaaaaatttgtttcgcgaattagctcttatttatgcaattaattttttattagtctacgtttaatacttctaattagttccaaacatccaatgtgacagagactaaaatttagtccatgatataaacaccacctcagtgtttggggtatttatatatatacaagaaaaataccattgcatttgtaacgggcggcatacaacaatgatgaaaagtgcagccaatttactcactaaattggtacattgatcatccagccaatttacactttcatccttggaaattgcgtcttcgactgtaaaaattaggggctattgcattcttacccctacttttaaatttaattgtgattttacccttgtttttttagtgtttgtgtttttgcccctcttttttcaaatgaaggagagttttacccccggttttggatggacagtttaatggtgttaagttggacgtgaaaatgcatatatatccttgcttaccagtacttttacccctattttgtatatgaaacttacaattattttgaactgagattttgtgaaataacttaaatctgagccgaactagaacaaatattttggcaaaattttgaccacctcaaccatgcaggcctagcttgtttaattcatgcaggattgcgcaagcatgaactacatgcgtcaccacggactcatcgagcacaatccaggagtatcaccgttcggagctggccacgcggtgaccacggcctgcccgacgacatcctcagttcctcaccatcgaactcctccgccgactcctttcattcccgatgccatcgcggtgtccgggaggccatcgatgtgcaggacacgatgactctcccaccttcatgctcgcatcgagccagcgccgccgcgcgtcctggtgctcgcgtacccatggcgaggagcttctgctgcctggtgctcatgttgagaagccgccgtctccgcctcgcgtcgtcgtgccgacgagccgccgatgctgcttgctactcgcgtagccgcgccgcctgaggagttgtcgccaccgccgccgcttgctcgcatagccgcgtggcgcgagctaggagtcgccgccgccgcttggtggtcgtgtcccgcgctgagtagctgttgcctgttgccaccgcgtagcactcgtcgccacgccggctcgtcggagccaccgccgccgccggctgctctaaccccccttgggtttggggatgggaacggtgggtaagatgagagcgaataggtgtacataatagtcaggggtagaatggtaatccaatcacttatggagaaggggtttttactccggttcgtaaccccctgtagtcccggttggggaatccatcaccaaccaggactaaagataaagataaagcatttttattcccagataaagcatttttattccccagttagtgttaccaaccgggacgaaagatgctagatccggttgctctttattcttttcttttcttcattgtttttaatatatattgatttcaccccattccgtcccggcgtccccaaaatcccaaatcaatcatcctcaaattacctccaaatccacaatcgatcatctcaaatactcaaatacatcacaaaatcttaaaaaaaaaattacatcacaacttctacaaaattacatattcacatcacacacaaatcaaatacatcacacaacaatctcagatccaatcaaatacatcacacaacaatctcaaattctccaaaaaaaaaaaaaagaaaaaaaccaccggctcgccgcaccagccgggcggccctccgcgccccgccgccctcgcgccggccgccgcctctccgcgcctggccgccctcgcgccggcctggccttcacgcctcgccgccctcgcaccggccgccgccgccgcgccggcctgttagagaggagaggagaggaatagataaggttgaggagagaagttaaaaggagaggagataaggttgaggagaggaggagagacgagttaaaggagaggaggagatacctcgatccgatcgcgcacgcctcaccgatctcagcgtcgatattttttcccggttgggactataaatagatctttagtccgggagtaaagcgtatgacgatcttttttcccggttggtgttatcaaccgggactacaaatagatcgttagtcccggttggtaacaccaaccggtactaaagattaaaaagtaccctggagcttttaaaccgggactaaagatgtttttagtcccaattttttatacaactgggactattgtgaaatctggtcgaccgaccaaagatggtttctccaccagtgaatgtcttgtagattatttttcccttctcatttatgtttctttaattcaatatattgtgggacccacctaatgccatccatagtaggggcaaactgtaacttcgtttcaagaaagcaggggtaaattcgcaaaccctaaaaaataagggcaaaatcacagttgcagttaaaagttggggtataaacacaattatccccgatggctttgcggaggacggaaaaaaaattaggtgtggtggtgtggcccatgggctatcgcgagaattaggccatagcaagaagaaagggaaaaaaaacaatctcaatgcacgatattatatgaacaatatcctatcatgatgcaatctaaaacatgccaacaagcactagtcataagctcacaattcatcatccatttaccaaaagtttaaatagaagaggcactcagaaatacctcaagattttagctgtcaacaatacatcacatgaaagaactagtgtggatagatagacatgtagtgatgtagaaactgcaaaacaaatggaaaagattgattagtatactatataattgagaattgagattaataagataaagagtaattgagattgactctgcctgctccctgctgcccctgcctgcgggcagctctacctgattgctagctagccgcctgcctcccgcggccgccacgcagctgcctgcctggccggctggccgccgcctgcctccccacgccggcacatcgccgcgccgctgcctggccgccgcggcgccgcctgcctccccgcgcggcctcaccctgccggcttccacgcccctcctcgagcagtgcccccaccgaccaccgcagcgccgccgctagcccccgtcggccgtcgcttgccctcagtcagattgaggatttggggggattgggaaattttggagttagggtttcatggtcaacaaatcaaaagccccatttaacacaaaaaaaaaaaggcccaatgggcctaattaggtggccagtggcctgttcgcacgcacgcaggcacgcggcttccgtcttgcatttgcaggcagcgatgccgccatcgccatgccggagttgtcgccgtcatgccgcctgggaggctgggattcgccgcgggggggaggggcggggggtccggcgggagagcaaggtatggcaaacgccacacctcggcctaccgagccctccgcccctgattatccctaaaaatcatataaaatctatagtttttgccgttgcaaccacagccgtccgacattgtacgctactgttttactggttcactgttgcattatgccaggaactgttcgattgtttgcttgactagatccggccgttcgttttttccttctttgcagccgctaccagcttccagatattcctctggtcgttcgcatgtacgccgccgccgcggcttgcccttgattccccatccgctcctgcgagttccttcgcatctccgccatcgacgctccaccgtgctcgcctccatctctaccacgccacctcgaccttgctcctcgatgacctctaccacaccattgctcatcctactgaggaagcggtggcagggccgcgccgccgccaacacccggcgcccatgggtgcacgccgcgccgtcacgaacgcgggacgtcgttcctcgcatcgcctcaacacctcgcggggagccagcgatggtggccggctctctccgctctctggccgggcggccggcggcagtccggctctccgcgactccgcctgtccgccattcggacgaggcggcaactccgtgttgacggtcgttgttatcgattcgaccatcaatattaccaaaatagaggagaactagtgatgcttgcaatgcataaatatgttagaataataatattccactagtagtaggtatactaatcttttgcagagaatgacactaaagtggaggagaatcgacatcaacatagaaaataaatcaatcggacgatgttgagaatcagacttatgaatgaatgggccaaggacgcagaattgacacgatgaattaggccaaaattcacaagtctacgaagtgaagcagcggaggaggccaccagccaaaatgtgggctggttgggccggcccctggttcggcctctgccagcgccgatagatgcagggttttgagggaacggtggagattcactccctatggcggttggagggtattatcgacctttctaaccgccataaccgtcattaccggcctatttaaggagttcactctcttcacttcaacacacacctcaagcaatagctctctcatttctctcaagtttagtttagtagtatctagctggtggaataggaatagagtagaaatcaggagtctggaagccttcggaagagttcgggtatggctcaagtagcttttctcttctcttttgtaagctttgtacttttattagaatactcttctaaatatatttatggtattgaaatacttttcgagtatatgaatacctattttacattatgttcatgttatactgaatatacggctagcctatctaggagatgctttggtgcgggtataatgtttgcttatgcaattactccatatcatgacgatgatattagagtagtatctggtagtttaggcgtggtgtctagattacaggatatcattatttggggttatatattgcggatgagaggtgaaccgctgatggtgacagcgcagtactggtattcctccgcgccggtatataatcctaagttaattccctagggagggtattcctccgtatttagcctcggttgtatggtcatgacgggctgtcgtaaggaactcggtagtcagaggtggcttctcgaagtcccaggagggcatcagatagagggtattagctaatgcatatatactatgtatattagaagtataggaatatattttctttctcttttctttccactgagcttagatgatttattatgagaatgaatagttactgcttgtgtgtcactctacccttgaataatcttaacccctgcttagaatatgattatcacaagtaatatataaattattagttgacttctctctacatgatcttcccacgggataaaataaatacaatacccttggaatactctcaggtgaaatgctacaatggtatatccgtgcacttgcggatgaactctgtaaccataatataccagaagtatttcagcggcattgctgagaattatatttctagtaatgtcgttaaaaaataccaacaagcatttctagcaccgttgccggggaagattcataatagagattacttgaactaatactttatatttacctttgtgtaatcattttcctttgcagactaaccttggttgttttcactttttgttgtggaaacagggtagtgcatgactggtttcaatatgccggaaaacttcaaagaaaatccaaaagctttcttccggagcatcagaccgcgagtcgttgctctgcagaaaactctaccgacagagaaaccagccgtaccagcgccaccgaccttcaagactatggccagcaagactgttcgcgagttcgctgctccctatgctgacaatgtggccattgggccgcaggtcaacataggggacgtggatttcgacttaaagtccagccttatcacaatggcgcaggctagcccgttctgtggcaagcctaatgaggatgccaatgctcatctgcaacagttcctggagatctatagtacgtacaccatcaagggcgttagtcccaacgccgtcaggctgcggctgtttccgttctcacttttggagagagcgaagcagtggttttatgccaaccgtgctgctgtcatgatgaggacatcaacaccatcgatacatccacgtccacccatatacagcatgatggtcctattacccgcgctcgtgcacgtcaactaaattatcaggtgagttctttcttgagttcatattcctcatctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctactttcaaatggatccagccacatgtccatatctgttctggagcggccgcaattgtcattttattcccgactattttctgtccatggtgctgcgtcacctcttttggcccaatgggctgtgtatccatattgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagtgcttatcctacttgttcttgcttgttcttcgattgcttgcaggatgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggtggtatcagagcgtggttcatcggtgagtgaatttacccttcccttcgtcattaatttttttttcctatagtccagaaaagaccaacaaaaaaatagtagattagtttttccatgatcctatagaccattgtgccttttcactagtactgcttagttaaggcttgttgagttttcgattgcatcggttgtgttaatttgctggtcttagtgttaggcgattagagtttcgagttcttgccaccaccgcacatcgccaccttcatcaattttgccgtcatcaccaccgtcaccaccgtcgcagtcacccaccaaatcactttatatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacgggcatctacaaaaaaagttacatccgattctccccagctttggcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctggttgtgaaaaaaatatcaaaaaaaaaaataaaaaaaaagttgtaactcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagggaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggcctgttctgaattattctacttatgataaggaattgtatgctcttgtgcgaactttagaaacatggcagcattttttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaa

SEQ ID NO: 30887 - DNA, 1289 bp, Oryza sativa
taaaatggcacatttcataccatgtcataaaactgatgatgcttctcatatcgctgatttgttctttcgagaaattgttctcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttaggcctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctagtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagatttcggggttagtcccacatttaacgttgcagatttgcagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctgttctggagcggccgcaattgtcattttactcccgactattttctgtccatggtgctgcgtcacctcttttggcccaatgggctgtgtatccatgttgggcccattaggggcgcgtcctagggttggagcacgaccctatg

SEQ ID NO: 30888 - DNA, 7241 bp, Oryza sativa
atctttatctagcaatctcagtgcttgtcctacttgatcttgcttgttcttcgattgcttgcaggatgagtgccctcatggccgggttgacgcgtaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgtcaacacctgggacaaatgctctacggcattcctctcgaaattcttcctgatgggcaaaaccaatgcccttcgtggaaggatttccagttgccagcagacaagggacgagtccattctagaagcatgggaatgactacaggagtacgtggccacctatcctcatcatgggatggataactggttgatcctgcagaatttttacaatggactcaccccaatctcccgcgatcacctggacacggtagctggaggagccttcttctctaaaacggttcaaggagccgttgaactaatatagaagatggtttccaatatgggttggagagagaaacgactccagacccgacagcgaggcatgcacaccatcaaggagacggaattacttgctgccaagctggacctcctcatgaaacgcttggacgaccacaagaaaaggtcacaaggcaccgtcaaggccttggactctcatgtcacgtgtgaggtctgcagcaacacggatcattctgggaatgactgccagaaaacccgtgaggaggcgatgtacatgggcaacaacaacgggtactgtccacaaggaggtcaggggtggaaccaaccacgcccatattatcaaggaggtaacaataactgtaacttttctaaccagccctccttgaaggatctcgtttttgcgcaagctaaaactactgatgcattaagcaaaaagcttgctgctaatgaaaaggtcctagaaaacatcaatgtcaaactagatggctttgcttctgcttttcaaaatcagctgagctttaataaaatgatagagacccagttagctcaggttgcatccttagtccctgcaaatgaaactaggaggatcccggggcaacccgacccctcaggtgaaaatgttaaggtgatcacgacgaggggaggtaagtccctcgtgatccgccatatcctaaccctgcaggaaccaatgggatgtcaaaagaagcgtcatctaatgactcggctgacaaagaggttcagccagaaaagactctgccgcaggagtactacgacacacggttgctgccgtttcctcaacggcttaggaaaccgtcagtagacgagcaattcgctcgttttgttgaagtaatccagaagatccacatcaacgtgccgttgttggaggccatgcaagtgccaacatacgcccgttatctcaaggacatactcaacaacaagagaccgctcccaacaatggaggtggtcaagctgacggagcactgcagtaacctgatactccacaagctcccgaaaaagaagaaagatccggggtgtcctacgatcacctactcaatcgtggcacaacaattcgaccaggccttgtgcgacctgggagccagtgtcagcatcatgccaaaagatgtcttcgacaggctcaacttcacggtgttggcaccaacaccgatgtgcctccaactggctgattcatcagtccgttacccggcggggatagcggaggatgtgccagtcaagatacgggatttcttcaccccagttgacttcgtggtgctggatatggacacgggaaaagagacgccgctcatcctggggcgtccgttccttagcaccgcgagagccaacattgatgtgggaactgggagtatccgtttccacatcaacgggaaggaggaaaagtttgagtttcaaccgaggacggaacagtgctctatggtcagaatgaagtacgggccgaacccacagaatattcaaatggtcgaggtggagccacccaagacggacagcctggtgaagttcatgcagaatttcctagagaaggaaacaacgattcccaggaaccgttattggaagacgccggtaaaatgcccaataccggccaaaaagctagagcagccgactcagaaaaagccgccgtccgcaccaaaaccaaagaaagtgtggagggagaagcaaaagacgctcactccatcacctccggagatgggtagaaaatccgtgaactaaatcagaaggaggtacggtcttgcacattggactttaaatgacgcgaccttcaccaacaggtaaattggtatgtatccgcatatttgctttcaacaatttgaatttttgcatcaccgcatgtttgaatttcaaatttgcatttaggatttttgaattatgaggaaattcttcaaatgaattttttttgttagagaacaaaccaaaataaaattttcagtgaaaattcgctgtgctacgaccacactgaccgttggattccaacggccgaaagtgggggcgattgggcccaccaggggttcggccgaacaccctggttcggccgaaccggccaggccaacggtcggctgcctcttcctttgaggcaacggctagtgggccccatgggtcagttgtgaccgttgtgggtgcgctacttaagccaaccggctgggagaggggacttcaccccatttcaacacattttcattccctctccaaagtttgctctcaagttcattcaagctttgatagtttccctcaaattcaaatatttagttgcatatatacaagttgctttggtaaaactaaccggcggatgaaattcttgtcattcctaacccccgccgggttagtccgttcttgctccattgtgtagaatgaggaggcgactgtctcgtctgttcaaagggtctggctcttcactaagtcatcatgacgagtctagtactcgttcatcagccgatgtctcaatggaaggcgccgaagctccgcgacgactcctgaacgacaccgacctcgaccttgtcagtgatcaggagagacaagcctactacatgctgagcgaccgggagtatgctcacacacgagaatactcatcagagctgctgaaaaagataggtatggatgttgaatttcgttctatttggaaagctgttggttggcagagatttgctgtggtagatgagcccggttctcgtttgcttactttgcaattcctgtgcactttgaaagaaatagaagatggaattttctttcgctttttccataaggagtacacacttacatggaaaggcttaagtacacttcttggttttcacgattcctataagatcgatatgcagaaaggaatttctgggttcgagaaaaataggttttgggaacacatttctggtgctccaatttgcaagaaacataggacgaatgacattcataatcctacacttaggctcatgcacaaatggattgctatgactttgtttcctagaggtgatctgagacccattaggggagataaattgattatcatgtttgccatggttagaaagatcaaaattgaattgtatgataaggcaatggttagaaagtataatgttctctgctcctgttgagtgcacttctctgattactcggatagcaaaagggctaggggtcgttagcgaccaaattgcttttatctcagccgctcgtccgcatattgatgcttatctagtgcaaggcatattctgaaacatggagtagatggatctttgatatactttttccccagttgtacaaatgaaatcccgttgccaaatgcagggtatcatttgtacaactgccatgaactaaccattcccctgcaaaccatagaagaatctcgtgcaggtggaacatacagggagacgtgcaacatgacaagaaacgaactagaaagttcatcatcctcgacacccgtgcagatgtatgaggcaggttgggcaccaactggggatgcacccggatggacccaagctccacgccatagcatcggagtctcaacctgggcaagtgccagtgaggaccggtggcatgcgcctcatgatatccaatggggggggacaatcaacctcctaggtcaagtggtgtgcctccatctccaagtgaatggcgctcgagttcctctcgttgggacttgggtgaaatcactaggagaatggacacccttgatatgcagacaggggagatccagtacaacctcacggaacacatagcttaaatgcaagaatggcaacaatctgctaatgcttagttcgccaacatcaacaacatgatgcagcaacagcataatgaccttcaggcgtactttcgtttttaggggttcaatccttatcaaggaccctgagcgaaagccaagcttggggggggggggagacatcgttccccctactaaggtaacttgtatcacattacatatttcccgttcaattgcatatttgctttccaaatgcatcttataaaaatgaaaacaacataaaagtttgcaaaatagaaaataccaaaaagataggatatgtttgagtcatgctaggtaagataagctagttctctttgttgaaatgatgaatagtttctctgttatatatctctgatatatgggttcttggtaaatactttctcaaaagttaaatataagtagccaacaattatccaggaacctgaggtaaatgggctgcacttgcttatctaagtctaggttgttgtaagatatgagatagtaaataagagttactatgatcctgatcctagttcgacttgaattccagatgttttgtttttcaaaataataagtttgaaagttcctcatttgatataaattcctaccagagccaaaaatgtgctatcataattaaaccatatacattttggttacttgccattccattgaattttgtcaaactcttgtgatttgtgtagatacttctcatgctctatgatcaaaatcatacacccacatttatgcacatgctaaactcctacactgggagctaagcactatttcattccattcccattttaccaccaaaataaattctccatgctttcatgtgctttcttctcctacaaagagaagtccttttgaaaaaaaaaggagggaaaggcatggttatgaaaaaaaagttatgctccgtcaagcatgagcatgatgttgaaaaaaaaaagaaaaaaaaagagaatggtagccatgctctctcctaatcaataaaagaaggattttgggagaaggaagtaagcacaaaggagaaacatttttttttctttttcctcatataccacacacacattttgcatgatcttgatcttgagtatgtttagttatctgctctagtctaagtttttgacttagtgataaatgtgaatgcaagtatgccatgtttgatccctaccaagctccacatatcaaaccttagagtacgaataaaataggcaacaatttggtgaggaattcaaattgatacacttggagagactgagtgaatcatttgaggaacttggttttcttttgcaaaatcgtttgaaaacttccagaataagagttgaagaaagatggagtgattggtactcgaaattgctgttctgtctttcaaccgcccaaggcaaggagaagcagtgtctcgtgggtaagggtaagccaccgtgccaaagattatttaatctgagagagagtacatatacctcgcacctgtatctttgagatatgcagcatagtagcaactcctgatcaacaaccaagtctttgttccctttcgtccttcactcaggacgagcaaaggttcatggttggggggttttgtagacggtcgttatcgatcagtttcgaccatcactattaccaaaatagaggagaactagtgatacttgcaatgcataaatatgttagaataataatattccactagtagtaggtatactaatcttttgcagagaatgacactaaagtggaggagaatcgacatcaacatagaagataaatcaatcggacgatgtcgagaatcagacttatgaatgaatggaccaaggacgcagaattgacacgatgaattaggccaaaattcacacgatgaattaggccaaaattcacaagtctacgaagtgaagcagtggaggaggccaccagccaaaatgtgggctggttgggccggtccctggttcagcctctgccagcgccaatggatgcagggttttgagggaatggtggagattcactccctatggcggttggagggtattaccgacctttccaaccgccataaccgtcattacctgcctatttaaggagttcactctcttcacttcaacacacacctcaagcaatagctctctcatttctctcaagtttcgtttagtagtatcctgctggtggaataggaatagagtagaaatcaggagtctggaagccttcggaagagttcgggtatggctctagtagcttttctcttctcttttgtaagctttgtacttttattagaatactcttctaaatatatttatggtattgaaatactttccgagtatatgaatacctattttacattatgttcatgttatactgaatatacggctagcctatctgggagatgctttggtgtgggtataatgtttgcttatgcaattactctatgtcatgacgatgatattagagtagtatctggtagtttaggcgtggtgtctagattacgggatatcattatttagggttatatattgcggatgagaggtgggccgctgatggtgacagctcagtacgggtattcctctgcgctggtatataatcctacgttaattccctggggagggtattcctccgtatttagccccggttgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagtagcagcggaaaaaggcgatcctagcggggcttcagctccactccacaggcaaaactcaactgtggtctgagccttggtcctctaacttcatcttcagctcagaagcactacacttctgaaaagggggaataatagcaaggctgagtacaaccaccgtactcagcaagccacaccaacgatgcagacatgcaaggggatacaaggatggtttgtggctattt

SEQ ID NO: 30889 - DNA, 30295 bp, Oryza sativa
aaggacctggggaggatgggggagaggttaggagggggagagagggctcccagcggcatgaatcgctggtcggaggggagaacgggcggcggatgctcaccggcgcgaggggaaccgtgttccggcgggatcccggccgtgaaaagcggcggccgaggtgctcctcggcgctgcgaagcgagcggcggcgacagcgcgacttggggtggctaggagcggcgccaagcggcggatggagtcggcggcggcggtggaaggaggtggtgcgcgtggcgacggtgcttcggaggcggggaggggaaatggagctgacgccggggtgcggcacgacgcggcgaagccgctggtggcggtcgcgtggaacgacggtggtgggagcggctgtggcgaccggctggagggtcgtcggcgagcggtggcgggaggtgcgacggtggcggggtggtttttgtgcacgggagggctcgggagaaaggggaaaatggagagggaggtgcggggaatgtttttataggggaggggaggcgggatcgagcccgagagaggtagaaaccggccggcaacgtgggaggagagagagatgcgggaggcggcgacgtggccggattttgcggggagagtggggggaaacggcgcggacgtgggcgacgaccgcgtccacgcacgcgcgggagagggagtcgcgcgggagaggcggcgacgtgggacgatttggcggccatggcggcggttggggatggagctggaggtaggagatgacatgtggggcccacctgtcggaaagagggggaggggaaaacgggctagggaggaaatgtagacttgagagagagagagagccgagcgggccgaggaagggaagcccggcctaggaaggaggaggggaggaatttgggccgagcccgaaaggaaggaaggggaagattattttcttttctttttattctaattggttcaatgaactttgtgctattgaaaattatttcttgagctccgaaaattcacgggaaatttcagagagtattttagggcacaaagaatattgcaaaatattcccggccaatgatttttaaggaaaaatttaattctcccattaattcactcgaataaattgcttaactttttatttaatttctaggtaatgcattattaaatgatttttaatcccgaacgaaaatcggggcgttacaaatctaccccccttacaggaatctcgtcccgagattctgggatggctagaaagaaagctggtgtaggctagcggtctgactgatctgcacattgaactgccacattctgcttcgaactaattgattgactggttgatcaaacctgcacaattgaaatggctggattcgacctttctgttcctttgctttgccaaaactggaccgactggttctgcttgaactgacccaaccagaactgtggctgctcatgaaacttacttatcttgatctgaactgttgatactagcagtttgataacctgacaattcaccaagctggctagagaagggtgaagttgttcctaagacttgcatctggcatttgtaactcattgatcctacgtccgcttgaacgggtcctggctcgaatgacacgtaattccaggaaacctgcttgacctgtctttcgtctgaactgcaaccgtccctaatgctgcttctcaaagctgagctattgacctggcctcaccggtgtacctcagaattcaatcagataacttaagatcggtgtaactctgctgacaccttgcaactggcttcctcaagtactacccggattgttgcactgggttgaaccttcaactaaaacagcgatgaggtgagccaaaactcatctccgagacctacccccctcataaggagtagtcttacttttgcctgactgggaacaattggactattgtccttgaaaaaaataaccgacacttctctgacttacaaagaccctcacttcgaaaactgaaacttcgtcgattcatcaaaatagagcaatgacgacgcactttcatcccagcaagatttggaacttaaccctcagttgctaataggaaattccacataaagaaattctcatttagctcctgatcttactaactcttgactacttccccaaacagttctaactgctggtacaactgtcttgcttctgacttgatttttggtgtcatatgcctaaacagattgcatagttgacattccttgaaacaagcactgatcacttaacaaatccaactcaaggggtccttcccacggcatgacatttcacttcttcgaccatcctttgctgactcttcctgggttgacggactatagatcctacaacagttttccggaaaatactgcaatctgaacaactattggaaactgactttgatgctaccaagagtttctgctctttgatcataacaacttcgcttccataccttcggtaaagatgatctgttgaatagggattctgtgccatataccttgctgactacacatttctatttctggacccgactcatgtatcttcctgactcgggtatggaacaatttctttttcaacttctgggaaacattgagatggtatttagaacttatattggttgccttgaactaagcaaacacctactgaattcatgatcgcaccactagggtataattgctgattacaatcctctaacaccttccacggttagagagtttccaagattctttatatgatgtcactttcaattattccatcactcctttcatctgagtgccactgatgctgactttagagagatctcatcatgtcgagtgttgagggtctaaccattttcactccgttggtaaaccattcctctattggctcgcaaatcggttttgggagctcaacaaaattgcgatgagttagaagagaaactcttggtttcttgtagcactgacagatacacaagttaacttgctttggcatgatcaagatggaccatataagtggagaacaaaactaattgactcatactttattcaatattcccttttcattagataactgccataaacttctatgtacaagatgaaatgcgacaaagataaacacttgaaggctactgctgggatggaaaagtaaagggcttgactagagctgcaattgcttccattattcgaacatgaccgacttgttctttaactcctactagctgaagtctcaccgggaacgttgccctgcttgctgatctttgatggtggagtggcaactgtcttgacagctgtaacaggtaggatcttctttcccgtggggttaccaagcggtgatttgccgatggacctccgaattggagcaatacgaggtgcattgctagaactgacaacagtcgggcgacctggtgctggcgacacttgctgcgggtgctgacgaaggagcatacttcctctttgtaactgtagcgagctattgttctcctggcattgcttaccctgctggcgctggtgctgtaggcttgaaacgatggccggtggaacaatgcggcctctgacggtgcccttgacgatgattcgttgaggcggaggttgcacattcaggtgtcgattggtgtcgtgggcagtgctggtaacttgcgaataacgacgaactgcctttgctgctcttggaagaggacaatcactgaaacaatgtcctggcttacgacagttgcgacataattgacttgcttggtctcggggtgcaggcttctgattatgcactttggcagctgaaactggaacaagcagtgatttatgaacatccctagcgatgttgcttcttccatggttggcttgcactggggctggaattggaggaagagcagaaggattgtgactgatgtcgtctactgccatttgttgacgaatgggttgcacggttctcccttgttctttcttggtcaaagctaggaccgagttccgctgacaatccttaggcacatgatctgctccctcacacaggaaacatgtgaccttcctcaaagggcattcatctgagtaatgggtgtattcaccacagcggcatgtggggaggcataaactagcagtgtgtccgactaccccacatctagtacatgctttgaacttcaactctctttccctgaaactgtcaagggtcgcgtcatcatcgtcatcattatcatcatcatcgtcatcagcagaaaaccactatcctgattcatcatcttcgggtctgggcggaccgtactttatgagatgtcgggttagctgacgtgctccacggaagttatttcttcctctctgacgcttgggtatccttgctgcgtcttcaggtgtaaattctgaaccggtgatgatcatggtcctgccattatccatcttccatatcactgtcctgttcgctccagagttgggctgcaaagtaccatccttcttgtcggtagactgacttggagcttggttacttccggggtgctgcttctcgtcttcttcaggtgacctggcgaacaccttccatggacagttccttacataatgaccttgctcaccacagtcataacaggtagcacttactttcctttggtctgacgatgacttggctgtcgttatcttcagggatctggacagcattttgacaggggtcttcggtgccgatattgggaactcctgactctgactctgattcgggtttcgggctggcatctggactcgcacctgcggttggtgacattgacgcgactcctgacattgccgttgcatctgttgcatctggtatatttggtaccgacgtcgcatctgttgtaataactcttccactgtcttagtttgattagccatgacttggggttgaggctgatcttcaagaggctgatgtggaatactattagaattgcactgagttgccccatgaaactgacagggtcctgattcgatgaaattgtccctcatgctgaccatctgctgcaggcaccagagagagggggaaatgggaggggttactagagatgaggtactaaaccacttgcctagtgatatgttgtgagtagatttttatggtttaagttgcttaagcaaacaacctagtatggtcgcatccccaccaatgatgcaagccatacccctacacacaagcaaacaacacacgatctagaagctaacgaaactactcttcatggaaagattgggtttaggtcatctccgggaaaactcctattgatcttcgcggaacgacgagtctggacagatcttctcgctctttgcacgaagcttgaggcttagcttgacttgacttccaaacatgcacaaagctgatggcttgtccttcaggtttgacagctgtcacgcccggaatttctatccaaaattccaaacgcttacatgtgtgtgaaccctcgtccaggaatcagccgaggcacacaataacaaattgataatagagtacaattattactccaattaataggcgaataaaatgtcattacagaggtagatagttcctcacaatcaataaagatctaagcagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgaaactaatcacaaaagacattgttagacctgcccataactgcgggcgcggctattcgaatagttttactctgatcagaggtgtaccactgtacccacaagacacaaccccacatcatgtcaccatgtgcctcaataccaccacggtacctcggaaaggagttgtgacaataccccttgcataacacaatccactacagcgcacctttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcacattcattaattaaccaatcacgattggccatcgtgaactatcattaagccatcattaaataatagtgagtcataagttatcccaatagtgtgctaatgtttctaagcatggctaagcaatcacatctaatatctagctgaaccaatatgtaaagctcaactagtcaagttataataacccaaggtatcaaggaataaagtaatcaagaacaaaagggctataacaaacaataggttaattccacccaatgacattcgaaaataaatgcaatatttgaatagaaacagtagctttaaacgggatcaacatgctcaaagggttgtttgggatctgtgtgacttgccttgctggccttggaactcttcaaactcttctcctgcgaaaacgggctctccggaaacgacggaatctaagcaaaaaagagcaaaatcaccaaaaaagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggttcacgcgaacggacggccgagatcgatccatccaaaacggacggccgagatcgatcggtctacgaccggctcacggaagagggcgacgatgacgtcagcgatgacgtcaccaccggcggcggcggctcagcggctcgggcttgcatgctcgccggcgaacggcggcgcttcggcacgaacggagagcaccaacgggtagagcgcgacgcggcgaactcaccggtgaccaaaggagcggcggaagaccaacggacggcaacggcgacgacgaagaaacgacggcggtcttcgggtcgacggcggcgatggtgctccggcgatcttcggcgacggcgaaggggcggacgaggacggcgacgggacggcgaccacgacggcggtcttcccgagcgacggcgacgtctggaacggcggcggcgcacggctggagcgacggcggcgctagggcacacggcgctagggcgctacggacgacgagaggcgaaggcgaaggtggcggcgggtagagaagagctcgggggtccttttaaaggggctaggaggtgacggcgaaggcccacggcggctggcgacgagaaggaaagatcggggtttgaaggaaagagaccgatccgattcgaactcgaatcaaacacattccaaaccgatttagccgatgtttccaaaggagaaaaggtagaagagatcccaaagattgtttcccctcaatcaatttcaccggaaacgaaaacgaacggccggattttggaaaggaacggcggcggcgcgaaactagggtttcgggcggcggcggccggaggttgacgacgaccctgacaggtgggccccacctgtcagcgggcggacgcgcgcgcgcgcggcggcggactgggccgacatgggccgaggagagagagagcggttttgggccgactttcggcccaaagccaaaagaagactttttaaaacctttttcaatttaaattattcatgaaatgcaattccatttattaaaaatacttccttagctcaaataaatcccagaaaaatctaggaattatataattaagcaaagtatttaatgaaattttatctggccccattttatattggaatttattaattaaaattagatcttctcttcaagacttttaaaattatttctaaaaattccaattaaacaacaatttatatattttgaattttcagggtgtgacaacagctaaaagaattggagggacagggaggagaattttaaaaaccgtttcacaaggaaatgccgaagggcgagaggagacattatgcaaatagggttttcagaaagtttgtccttaggttttgaccgtttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagtagcagcggaaaaaggcgatcctagcggggcttcagctccactccacaggcaaaactcaactgtggtctgagccttggtcctctaacttcatcttcagctcagaagcactacacttctgaaaagggggaataatagcaaggctgagtacaaccaccgtactcagcaagccacaccaacgatgcagacatgcaaggggatacaaggatggtttgtggctatttgcataaaggcggttgtaaaacattttattgagcaaaacagtaaaactgttgagtaattagagtaacattaaatctccactgatcaacgctacaccacgttgaacaggcccaaccaacccacataaactacagtgtattgggtcgatttattaagtgtgagactaatcacggtgaatctggtcgaccgcccataaccgcgggcacggttattcgaatagttttactctgatcagaggtgtacaactgtacccacaagacacagccccatgacacgttaccgtgcgccgacatgccaccacgacataccggaaagaggccgtgacaggacccttcgcataaccccctctagccaagcacaccacacctcaggtttcacccccgtccccagcgggcgacgggtagtcccctctcgtgcctaggtgaatccggaagtgacagaggccgtcgcagggcccgccccgctccatcacgcccacccttgcctggatgcgtcagctagaggaaagctacactacaagcccaaccgttgcccacgctggcttgtggtaagtacgataagttcttcctgggcatcccgcgaaccggtccttaattgccatgggtgcgactagcaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacataagctaggcgatttattacccatggttgacaaaggacatatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgattttccgaactcttttcctcgcgaccgcggacttccgaaacgacggattctacacgctggcatgcaaaacgaggaaaaactataataaaaaccaagaaaacagtacataaaaactaaacaaacatgtagagctcaattttagatgaattttgcaagttgaatggctcaattcggagttcgaatgaattaggtatgaattttagaagttttgagccatttaaatgaatttctagaattaaactcgatttattgtgcaattattatttattttctcaaaggaaaaagcttaagcgctgacgtcatcaaagaggccggcgccgacaggcgggccccacacgtcagcgggtcaagggaatcggtccaccgtggaccgggaccacggggtggcgcggctgagcacgggcacggctcaggctggcccggccgagcgacggctcgcggcggcgcggcctcctgcggcgacggccggtgcacgcgagaaagcggcggtgaggcgcggcaaggggatccgggcggcccaggcgagcggggcggtggcaagccggccggccgacctaacggcagcggcgcacggcccggtgggcgccggcggcggccaccggcgcggcagcgcgcacgggagacagaggagggaggcaaggagggagaggaggagctcaccaaggacgcggcgacgaggggcggggaaaggcgggggggggggggggtggagcttggcgtcggtgctcctcgggatgaaggcggaacggcggcccggcggcgttccgcaagcgggaaccggcggacggcggccggaaggacctgggaggatgggggagaggttaggagggggagagagggctcccagcggcatgaatcgctggtcggaggggagaacgggcggcggatgctcaccggcgcgaggggaaccgtgttccggcgggatcccggccgtgaaaagcggcggccgaggtgctcctcggcgctgcgaagcgagcagcggcgatagcgcgacttggggtggctagaagcggcgccaagcggcggctggagtcggcggcggcggtggatggaggcggtgcttcggaggcggggaggggaaatggagcggacgccggggtgcggcacgacgcggcgaagccgctggtggcggtcgtgcggaacgacggtggtgggagcggctgtggcgaccggctggagggtcgtcggccagcggcggtgggaggtgcgatggtggcggggttgttttcgtgcacgggagggctcgggagagaggggaaaatggagagggaggtgcggggaatgtttttataggggaggggaggcgggatcgagctcgagagaggtagaaaccggccggagacctgggaggagagagagatgctggaggcggcgacgtggccggattttgcgggagagcggggggaaaccgagcggacgtgggcgacaaccgcgtccacgcacgcgcgggagagggagtcccgcaagagaagccgcgacgtgggaggattggcggccatggcggcggttggggattgagctagaggtaggagatgacaggtggggcccacctatcggagagagggggagaggaaaacgggctagggaggatatgtagacttgagggagagagagagccgattgtgccgaggaagggaagcccggcctaggaaggaggaggggaggaatttgggccgagcccgaaaggaaggaaggggaagattattttcttttctttttattcttattggttaaatgaactttgtgctatttaaaattatttcttgagctccgaaaattcacgggaaatttcagagagtattttagggcacaaagaatattgcaaaatattcccggccaatgatttttaaggaaaaattttaattctcccattaattcacttgaataaattgcttaactttttatttaatttctaggaaatgcattattaaatgatttttaatcccgaacgaaaatcggggcgttacaggttgtatggtcatgatgggctgtcgtaaggaactcgacagtcagggatggcttctcaaagtaccaggagggcatcggatagagggtattagctagtatatcagctaactagaatgtatgtatactatgtatattagaagtataggaatatattttctttctcttttctttccacttagcttagatgatttattatgagaatgagtagttattgcttgtgtgtcactctacccttgaattatcttaacccctacttagaatatgattatcacaagtaatatataaattattagttgagttgtctctacatgatcttcccacgggataaaataaatacgatacccttggaatactctcaggtgaaatgctacaatgatatatctgtgcgcttgcggatgaactctgtaaccataatattccaaacatatttctgcgccattgctgagaattatatttctagtaatgttgttaagaaataccaacactccgcctctcctcgcgtgttgtgcctcgcgggtcacagccgtctctgctcccactctgcctctgctcgcccgcataaatctctgctccaactcctgctatccatcacaccgctgccgcctagccagccaccggccgctgataccgggagctagggaggccgtggcgtgtagcacagcaggcagtagcagtgcgctggtgccaccttcggccttcgcccttcgattccggccttcccctgcaggtactttacaggtctgctcctttacctaatttgctctatactgatttttgattgaaacttgctctatgctatcaatttgttatttttgattgtcgatttgtgatcgtctattagactactatcataatgtcattgccgatttgtgattagtgaatatgcattttttgtggtccattccacagtcatgaatatgtggttacaacatatgtttgcttatttacacggcaagtttattatatcgtgtgccccagtgccaggaaaaattagtgcgctgtgtttcttccatcatgttggtcgcaccagtaagatgggaagtgttttacctagcctatagtgcttctttaatcagtagattgggagtttaggactttgcttttctgaatgctcaaattgtattctcagattgcatttcagtgcattcacaatcttttatggcaatatgtcatggttaattacacattctgcatgtagcatccaacctgaaaatcatttgattactgcagcatttattcccagcaatagagcatctgtgcgagcagacgatgacatatttgtgctgtaaactatttctgtagaagtatttgtcttaaaagtaatactatttggtaatgtttctaaatctatccattttcaaccttgagttcaggtttctgcagtacacgatcccttcaaacaaaattaaatagttaataatttaattaccagtattcagagggcactttgtgtcgtaggctcttcagaccttccgttatatttgagagatgaagtgaataattcaagtcatcaaacaaacataatgaaacatccgacacctcgcgagagaaatattggagacattgctgagcccttagcctgccagtcaacttcagcctgagatgtgcccgtcaaaccactcgaaggcggcgaccagatatgttacacattcagaagacttgacaaaaatggctaaagatctacaacctctcaaatatttctaactcatactcatgtgaatatagtttccaggatgtgcactagattcacactttcatcttaagcatgattatacatagcaaacacaactaagatgaaagaaacttaagacttacaacaacttaataattacataggccgaccggccaaatagacttattagagaacagcggaagcttgactacccaatcacaagcacaccgactaggggtttaccccattaagttctcatcctagaagaagcaatcaaaacccgcatcacttaaagactaagtctaaacctgcaaacaaaaggttatatcaacaacaagagtcagtacattaaattgtttaatggcaagtacaagtcaatcctactatactacatgtaaggcatatattcaaaggaaggcaatatgtagttcaatttcagtataaagcaagttttgtttcgcaattcttttgtaaaggagttgatgcttcaattaacaaaacaaattttaagtttcaatattaagttcatcataattccatcataatcaatctcttgttgtcatccttcgacaacaagtcataatatatcaccacacacacacaactcaacacatttatcatttcaaaccaaggtcatatgttcacattttaaaacatagtctatactcatgacacttcaccaaagcgctcttgaccgtgaacacggctaatcaattagtttaaagaactctgcaaaatttgtacacctttatccacatgatgtgatagaagcccagaggctacactctagttggttcagtgccggccaagcaccccacactctacattatgagtgcggactagaggtcacaacgaagcctttacactacttagaatctagccttgcaccagcacgatacgtgttcctccatcctaggcatacttgaaaatatgtctagaaccgttaagtggcgggcccacgccttaaacttaatgccgtggtggcggacacaacgggaacccacccacgtggcacaataccgttgtattggacagacttagtcccctaaactaccacgtcagggcaaataggaagttcctctgaatcatcgactaattcctcagaattatcgactaactcatacacaccagcctaccagaatgcaaggctagttctaaatagattaatcagcttaggccatcccatactagcacatgtggatgtacgaataactttaagttggtgacacaagttcggtccttacggacttggccaaacactccccctatcggcatgcacctaacaccatatgcacatcacttgccgcccaagtctaaaatcacattttacacattttagttcgcaaatacccatcatattcattttattccagcaaaggttcatgtgtcaaaaatcacattttaattatagatggaatgaacatttgcatatttctaagcatggctaagcaagtagttgcatatagagcatatataaacccatttgagcacaaagagtgtgctctaaccatttctaggggttcaaacagcaagaggatcaattattcaaggtagggaatgcagcaaataggtcataactaccttatcccaatttcaaataccgaaatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctgaaaatctaaaatgctctaaaattcatgatttatgcacagtgattaggtactggtcttataatgaatttaggtgaaagaatttttattttatcttattccatttgggagttatgaattttagaggttttatcggtttatagtaatatagtcttaggtagtgttacaaaatacttttgtaaagtgatttttattagattagacttcacaggggtgtggagatgtgttttctaagactaacacatttggtttcacaaattttggatttataatgaattctttatgcattttacaagttataacgtgttagagttgttggttcagaacatgctacctactgtttaagttgaataaaagaagtaatttggttaactaaaacatttttagttcacatgtttatggtttttactactatggttcatactttataaactaggggtgctctgatctagactagcaatacattatattaacctagaaattattatatgagctaagttcttttaagttttagtggatgggaaaggaactatgctccactgttctaacaagttttatttaggtttattcatagctagagtgcattataaatacttctacacatatattttgcttaaccattactaagtaattaactcctaggttatctatttaaagattagagctatcatttgtacaaaaggtgtcttattttattttactatgttgaagctaaccatttgctggttctatagaaacttggttcatttcatttggactaaaaatgaattttctacaaatcttacaaattaaaggcttctctatgttggtaaatccttacatgattagagacttttactacacagtaagtatataattttatttcataacctgggaatacacattttgatgattctacagaacttaagtttactaaaattgaagctaagttgaattttatatgaatttctaaaatttagcttatctaaaactagtcattttaaagataatagttttagaggcttttgatgcaaagtaagtaattacttttatttcacctaatcagagagtgcatgatgatgaatttgtagaatttgagtttgtttcaaaatgagtttagatgaattttctatgtgttttataaatttgtatatgctttatgtatgacttatcttagataaatgttagaggcaaagtttgtacagtgagtgtcaagttttatattcctggaataaagttcataaccttaagaatctacagcaactggaaacacttcaaaataagctatatttgatttcttatggattttacaagtttgtgcatttttctgttaaacatatatttgtttggcattgccttaattattctccagattttaaaggatggggtccacatggctgtgagggaccaatatgcaaaaaggcccttgaggtttctaggaatcaacccgcagtcctaggcccatatgtcagtgtgtttctacaattgtaaacggatccctgcacttaatctaattcacgggagtcatccctctgctctagacagagcagagctagccatggctgagctcgatctcgagctcgccagcggcaaacgttggctcgtttgaggttgaggtcaaaagataaaatgaagagcaagctctcgcgattccattcctctagttttcttggtttggggacatcggagtagcgccgatggctagtgtgagcggaaggtgttttcgggtgatggtgcatgtgcatctacagtcatgtattggttaagtgggtgcatgcatgtgagtatttgaggttcatgggtatataccatggtgttggccagagttgatgaggtccagacgatggcggcagcacacgaaaatggcttggcgacggcgcttcactccgggatgacgtcgacggcttgatctaccaatccatctggcatgaatgaggtcatacgttgttagcgaggtctcagggatgcttcatgtgcaaagaatcagacaatggctcaccggagaaggcggaatcgaccatggcgacggcggcggattcaaattggcgccggggaagaaaagatgcgttctccgtgttctagatgtcttgggctggggttcttgaggcgttttgaagagtaggtcgaggtgagattcttggcgcagcggcttgctccgagatggtcgaggatggctagacgacgacgatgattgaagcggcggtgctccagtgcgtgctccagggcgccgtcggcgtggtcgcgttccgatggctgtgatgcacaaaacgggaggtggtcaaaagagaaatggttcggcattgtgtggagataagggaacgcgaaaaacatagagatgacctcgacccaatcggcgttggcgaaggtcgtcgccactacgaccggcggcgaggttgaggatgacggagaggctgaggacctctccctcggcttcttcagctctagagtgatgtgcggagttgggcgactcggtctggaggagatggaggcatgactcagtgacttgaaggcgtcgacacgtcgtcaccacgcgtcgacgcgtccaggactcggtcggctctcgatctctccctctctgtgtttcttggtcggctgaggatgagggacagaggaagggcaagctagagaggctgccaggtgggtccaggtcgtggcaaactaggctagggtgagagggttgggtaagattctgggtaaacttgattttcagatcatttttcggaattattttcttctctaactttgtagcttcgtaaattaatgtgtagaccagattatctagtgttgattttactggaggtagatgattacacctagattccattttctttggttgcacttaaaaataatgggtagactgctcacagaaattaaacaaagatgggctattagaaagctagattgaatttttaggaggcttaacagaggaggaaaattctagaaaagttatatttattcatgataaataatttagtatttgaataaattattttccatgttcacttatgtgcagttaaatgtacttttggatgaaatatggttttagccgattaaaatttaatttgatttcttttagttgtctgctttgactgattagttcgaggtatcaacttgaatgttaacatgttaacaaaattacagaggataagtttgtgctaatcactgttcacataaatttttccatgattttatcttgcacaaaatattttagagaattaggatgacctttgtttgtatatgtgttcccacttcataattgcatctaatattattatagggattacattaaacttcttttagactgagaagatgatatttgagtttaatattaagtccacatgctattacccaagattaactataggtttgtttagtgaaataattcttttagattatgctcatgggaccaattatggaatgcaagaccaaaactccaaatgcacaaagaactcgagcctaggcatacattatgtacatgtatgctcatatgcttggtgacatttcttgtataacgttgggaatgaaaagattttattttgctctcaaattttaatcatgcaatggtttaagttggtcatcacctaagtttaaaacggaaatttttgcctctcaaaattggagaagttaacctctaattattttgataagaaatttctgagtcctagaatttcgggtatgttacactttgacttttgtacttatcactgatggaaaattgagaacacttccctttttctagatagaaaaatctctgctttgacctgataactttattataacatgttaaggtatagtattacatatacacattgaaaaatattcccgagataaccaaacatggttactaatgaaaagttcgggaatttacaacctgtctatggctattccctacatgtcttgctaaaaaaaatcgaccatccaattcaatatgtttgtcaagttgtggcacttcctagctttaagaatttttttggtgtctactttacatggtccgctgctgattaaccacggcatatatattatatagtaattgcttttttttatctggcttattattctcttttcctgaaccattcattatgcagttttactgccataaatcaagctggaatcatgtttgcctgcaccaaccatgctctgtagaatgcttttaacaggcatacaacacaccattagggaataatctacaaggtttgggccatataacttcccttttatatactttcttttgcacttattttccaaatttatctgttgtatgtacatgatagataatactgtcccagcattgactaatgtttgaagttcaattgtaacaggtccaatgcttgctttgagtacaaaaatgttttatgttttgtcggtgctttttttcaccagctaaagatcaataggaactacaattatatttcattttgtcattcacaccttagcttccagttcactaaatgaagatgaaggctgaagtcaacagagatatgaactgtagggaaaatgtaccttttgttgctttgattaggaagattgaatgttaatttcaagatgcaaatggagatcgattttcagtctttcatatgtcagcttaagtttgttctgttaaaaatgaaatgaaacttaatttcaatgcaaatgctgaggagggaatgcttgatctcaaaataaaatgctatctttgcttgctccatatgcgcttagcccccatgagcgatgatcttcatgtaccatattactcacattacctgtatttttttcgaatatctactgtagttttagagcatatgtgacagtgcaattataattgttcattcttgacatgcactatgcaggaatattgcttcaaggcaaaagaaccaaacaacatattaggttatcccattatgaacagttaggttaagctgcaccttacatggtgagatcactatccatattttattatacacatgtaatctatttatttaaactaccctgtcaatccaatctactttatatccttattttggtgttagctataaattcaaatagctttgcaatatggatctatgctgattaccacttatcaacgaattgacagaatggacatatgttgacaaggtgacatcacaacatgtatatacaacgtagaatctatgtacatcaactgtgtcttgtgcttcacaactatgtgtggagctttccaagtccacaaaacatttaagttttcttttaccaatcagcatatgctatattattctaatatgtgcatagatatatcttactccgttacaatgtctctttgaaatttcaaatttatttttgtatagttcaaataactaatatggttacaagcattatacccgcagcaacgcgcggggccactgactagttatatagaactatcgagtggccgtgtacattgcagagaacgttggacggcaatgcacaggcctataaaaagttttgtggttccgttgtaactcagacctaccataaaacccacacatctgcctcatacctcgtgaaggtctcacagcccccgcgcacgtataagaaccatagccacatccgcgcgtgggtcggttcgcgacacacgaagccacatccgtaggaggctgacacccgtgggatcggactgacggacggacgaaccaaaaaatcatcgtgcaatgctttttggtatataacggactcataagtgagtacataatcatctttaattttttactagtaaaaggcacctgcgttgcaccgggtaacattgaggtggataaaatttaactaaacgctttttaagcaatttagtatgacaataataatcacaaatgtattttttttgacatttagtatgacaataataatcacaaatgtattttttttgacagttatatcatgtgtacgtgtataatatgaatgttgtacttgatgcgttagcgtaatgattgtactacgagaggaacgagcggtgagtttttgtcactttcatgcaagaggcgatgtaaataaaattgtgtgattaacaaaaaaaattcatttgaaataggtgactttatcataatactaatgatgatcagaacggttcaaaaatacgtttgcatatttactcataatcttgtagtggtcacgcgtgctaattataaaatgtgtacctaaatttgtttgcgagctgttggtatttcttaacgacattactagaaatatgaattttcagcaatgatgcagaaatagccctgatatatttatggttacagaagtaatccgcaagtgcacggatatatcattgtaacatttcactcggaagtatttgaaggtatcgtatttatttaatcctaagggaagatttataaaagagagaactctaccaatagcttatatatgttacatatgacttagattctctcacttaaataattcaagactaatgtggaagaaaaaatagaaaagcaatcattcctatacttttaatatacactcaactttagtttagatttgctagtatacagctgtaacgaccattaccccctaacagtgccctcctggtgctttgagagaccaccccggattgtcgagtttcttacgacaacctgtcatggccgtccaaccagagctaaatatggaggagtactctccccagaaaattgtcttaggaatatatactaacatggaggaatgcacgtactgagttgccgccatcagcggcccacctctattgtcccgtagcatatatacccaattaatgatatttaataatctaagcaccattcttacattatcaaatattactctatatcctctagaataacatagagcaatcatttgcatgaacattaaacccacaccactgcacctatctggtaggctagtcatacaactatatcagcacaaatataaagtaaatccagtgttcggacaaagcaaagtaccaaaggtatataaagaaaaatattctcttaattccaaaagtcttacaaaagaagatagaaaagctactagagccataccgaaatcttccgaagatccgatgactccgataactatcttattctactccacttagcactagagcactaacaaaacttgagagagagatcaaagcttcttgcttgagtgtgtgttgaagtgaccccttacatagcctctcaatgatggttatggcagttggaattgtcagaaatgccccgcaaccatcattgggagtgaaggtgcacttaaacctcctagtgggtttcggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaataccgaaggtgattagactaggtttttcactttcgaaattgagtttaggaaaaaccgtactattaagaggggattcaagtgtgattctagggtatacaaagtgctcttagtcatatccatgagtcaaaatatttttggaatcatttttgaaaaatgattttctccccgggacagagagggctacccggaggttctggccagaactttcgggcaccgtttctttgcaaaaaatttcctaagtgctgcccggaagctcctggcacttttgcccggaacctcctggcaggcttccagttcaaacttgtgagtaacggctagatgacgtcacctagccgttatatatatggatttcatccccaggtcaccctttggccattccacttcagctctttcatgttctagggttttctagccactcccaagcgtcctttgcttcctccactcaaatctagagcctatcttgtgagattgagagattatatgagagtgtaggagtgttttggagatggattgaagattaggtttgtttgagcactttggatacctcgtgggctgtcacttggtcttattactcttggagatcttctcctagacggttaggtgtcgcccgtgagcttccaaagatcttgtggatgtcccgggaaagtttgtgaaggttttcctcacctccgcaaggaaacgaggtaaataagtaaagattcttgtgctgagttttcagaggttgtcctaggtagagcaacttgcacttgtggtcttttctagaaggaattgtgagttggatcttggtggtcactcaattctagaaaacgacctagaagtgttgagttgaaggctgtggacttcttctgggatctttgcataagtgaggcaaggggttaattgagacccggctctttgagcacctcaacggagagtaggatccgtgtgatccgaacttcggaaaaaaatcgcctttgtctctcttgtgtatgatctatgtttgaattggctggtatcttgtgtttttcatcttgtgcaatcttgtgcctgtttttccctagctaggacctgtttttcttctcatattttcgttatctctgttgcccggaagttcctggctcaagaactccggaagttccgggctgctcatcactgccaagaagttccagtgttcatcaccaggaggttcggggccctgtcaatttaaccgctgcgtttgttgagaaaatttcaggaaagcctattcaccccccccccctctaggctacatctcttcacgttcagggagtgcatttggagcgtctacgtggagggccaagctgagccggcgctgccagggttcggccaaaccccctggttctgccgaacctgggccggcccagcaggcctccaaatttggtcagggggctgacaggtgagtcctcatggcggttgtggcagttatgatggtttccaggacggttacacctgacatgtgggcccctctatccttaagcttgcttaggagtgaagtttttcttcatttttttctttatttatgtgctaatctctgcaaacaaataatactccatgtacaagtagaaatatattattctaaaataaatatgcattgcaatcataactagttctcctttattttaagtatattgacgtcgaaattggtctataacgaccgtcaacatgagccatccttgatattgttccccttatatatccttgtttcctgagtctattacttatgcgtggtcaattatcgacactgcttagctttgcctatatagacatttgcaccctccatactcatgctatatggatgtgattgtgatcactagatgggagtgaatgtcgggagtcgggtggagacatgagtgccacccgtatcacgaaaatcttgtgaaaagcaaaaacctaataaaacaaatgttttcgattgggacagcatggatagaatatgggtggttctatgaaacaactacttgccgaccctagtcaaccaaggactgagtcaggaagctatacagggaatgaaccaagtatgatcgcatttctcgaatgggtagacccgatggactaggaaattctcgtgggggcggcaccccagacatggtaggttctagacgatgatgattgtgttgatgcagtgttgtgattggataatgacgtctaaaacctaaaatgcaccctataagtataagtattatgtaacccttaatcccgggagtgccaggactcccctcactttcggttcgaggtagggattgtgtgtcggggtgcaatggaggctcatagtccttggagcgggtgccgcaacgcgagagtgactgaaaagttgggaagtgacaagtctcatgtgttgggtgcatcatggagtgcgggattaaaagcgtacatccactgcagtgtgagtaaactaatctattcgaatagccgtgctcacggttaatgagcactgagacttgtactactcttgattagactcatacatctttaatattgtttagaacagggctggacaagattgtgtgaccttgcccaatgggcgggaaggtcaaatatggtaaacaatatgaatctggatgtgagggtaaacctgaccaagcgaggctcgggctaggtcgatgaaccctcactgttcaacttaacgacgttttcagttaaaactgctaggtttacaaaacaatttgtgaaatctatctttattcaaatgacccaaacccttcttgtatcctcgtattcattacatttattctagtggtgacttgctgagtacggttggtattcacccttgctccatcaccctctcttagacttagatgatgtggaagtgccgctcgagactactcccgaggaaggagaacccgaggagatgccctagggactgatccccagttgtgcctatggagtttagtagtcccgccgtaccttcgctaccgctaccttatcttatcatttggttcttggtattgtatctgaccacacatggtctatttggggacccactcgggctttcattgtaataatgcgtaccgtaagactatgcgatgcagactatgtcataccaaatgtgtaatgtgtgtataccaacctactgatgcagggatttagtattgtgaacacatgtggtttcctgtgtcttaaaaccgggggccgactttcaactccatcacgcccaccctcacctgggaacatcggaaagggaagagccatactacaagtccagcagttaagcactgttagtcttccagggtttcccgtgaatcggtccttaattaccatgagtgcagccaacaataccatgcacccacagcccacctttgagccatattttagttggataattacgaccaataaaatatggccaaatgtatcgagcgcgcagcacatcaagatactaaatgtaaaatagtgtgattatcccattatgtgagctagtggtaattaaacatggctaagtatatgtaattttagctaagtcaacataagcgacacaagctagtcaaattattacccaaggttcgacaaagaatggatcacaagtggtagctgtagcttacttaactgatcaaactaataatctagttttccttttcaaagttacttactatatagatacattttggtgacaatgtttctaatgatgttaactggttagaaatatttaacgtttaaatactcacttcgtttaaaatcatttgtcgttttagtttgttctaaacattataaatctttaaccatgaacttctttagacatatttgactttagacaaatttaaaataacaaacaatttgaaacggatcactagtgcaaaactgattttaacaccgattgggaacctttttggtactggttgtagcaaatcaagactaaagatctcgactttagtaccggtactcaaaacaattgtgtaggatgtgggatttgaacactactagaaaaagcatttttgccgacgtgggggtcctatttttgcaggcggacatgacccttagagccaaatgaccgcctacaaaaatataagtcggggtgaaatttgatgtctgcctacgaaaatctattttcgtaggtagaccacataagcggctcctgtgaaaatcaggcgccacttaattggtccgcctgcgaaaatagacttgaatataaatagacttgcgtgccctaatttttttctaagtcctcacacctctcccctttcccctcccctcacctttcctcaccggcctctcatcccctcccctcacctctcctactctcccctcccctcacttctactcttcccggcggcggcggcgggcggtggcggcgacgaggaggcgaggcggcaatggagaagggcggcgcggccaaggagcgcaatggagaagggcggtgcggcccggcccgtccctcccagatctggaggggggcggggggagtgcagcgacgactgcgggcggtggcggcagagggcgaggcggcgtggctcccctccccccttcctcccagatctggccggaggagggaggggggaggtcggcggcggcaattacggcgtggagcagcgacagcgcgggccgggcggcggcggcggctcccggcgcgggccggcgatttttttttgttcgtttcctccattctcgcaggcgggccgttcgttgtggtgcaagcggacctctctcccgcctgggaaaattagttttggccacctgcaaaaatgccttttctagtagtggaactcgagatctctcaccttatctctcatgcttactaccctacctatcacacacatctaaatagagatgctttctttttaaactaaccatataggcatatttagtacctgttggtactaaaaatagtactgcctcctcggttctacgaagatctcttcgtacttgtctagtctaggataactgggatcttccggtctccgtgcgcggaagtagttgaaacaaagaagagtctgttccgctcttcatttaggcatggcccgcccatctgctgctaggtccaagaatgagttggtaacacaaacaagttcttccgtctttagtcttggttggcagaggatctattggtgttactaactggaactaaagatgttttggggacttggacttttaaaactggtagtaaaaatatcgtaccggttctaattctaaccgagatattagtatttttggtatcacgataaaaaatcagttctacactcgtggatagtataagatttgatcaacttttaaaactttgacaatcaattctataaaagaataattttataaaacttaataagtttgtaatattatgatattactccctccggttccatattaattgttgttggttgaggtaaaacttttataacttcgaccactaataacttcaaaaatatttagttcaaaggaactagaacaacatatataaatttgtctttcaaagcactataataaaagtaaacatacatttatttattatatatattataataaaaaaataagatcaaagatatatttatattttgtagaccatgtcattgtccaaaacgtcaattaaaatgaaaccaaccagaggaagtacttgttaaattaaatatgcacgtacctttcttttttaactaatcatttgagagaagttattaatgctcaaagttccaaagtatctaaaagtcaatatttatgaacggaggaagtattacttttatttttcggcaaaaagtttatccatttccctgtttctgaaataaacgtatactttttctaagagtaagaaatgtataaattagaaaggactatatcgacgagaatatgtaccggatgcatttgccctatcgaactaaagaagcttactatacaatctacagttatcctatctatttatgtacaaaaaaaagtaagaagaaaaggggtcaagacatttcccggcaaaaatttctacaagcaagagttctcaagccaatatgtaccccaatagaataacactccaactccagagttgctccgtcagatcactcacaagaagtgaggaaatgatgagatgcgaggcaggtgcgtcaggagatccccaaacgattcttgcctcggcggcaatgaggtgttgcttccactgtctgctgacaccggaagcgcataaggttggggcttcctttcttgcatctcattgtcaccatgaatgctgctgctggggtttgtctggcctgaacctgaatctctctgaatcaggctgcagagggagttgacccttgacatgagcatcctttcatcagctgcgttggttatctgggaatcattgaggagttgtctggtaagctcatcaaatgtcagtttacccattgagccatcgccatccccatcgccgatgatctgggtgctgcccaagaggaatcgggttattccatctaatgttactttacttgacgtggaatccccacgatgaactgcaggtaggttccctgaatacatctgtctgtagatatgattcccaatgtgatttgcaatctcacttttggacatggagcgccttatccccggtaccttgataccgttccaattatagatgctttcttgccgttcacaatcaccagaagcagcatcttgtttaatcacttgagtaccactaactggaatggcgaaagacacattattagtaaaattattcccactagaaatacggaagtctaatattcttaatattatgtagcaaatatactggcgaagcaatttgtgaaatagatcaaacaaattaaatttgacgaatattaacagacttgtctggtcctaagcagtgacctccagtgagtgagaaaagaagtcattgatagctaacaccattatagaaatatagcctaatttgaaaggcatgattttcatatttcattgacacatctggatgttttcatatttcaatggaatataagatacaagtatggattttgaagttcacctgaacaagggaaatgttgaagtaacttgtccggtgttcctgagagctgtctggcttcagtatctatcctacctgatgcagaatgaggcggtaacagttctgtaaatctttggggagctaactgatcgccatcatctttatgctcaaaatcttggccttttatgccctctgcatcttcaaatatagaagactttgattcaaagtacggattatccaaattgatgtcgttctgctggcttagtgaatatagacgtgggtcacaatgaacaagcttctcaacatgcttattcatcattcctggcgggcactgaagaaaatgcctccttacataaatgatagtcaaaagtcaactcaccactcggcagtattaggaaattagtcagcataaacaactgtgagagactaattcgttgtgataattgtctgatttttttttcacaattgttcctcatgattatggggtaaattccaaaatgctatcaaaatttccctagttagacaaaagggaaaaataagcaccatatttgcgaacataggggtatacattttaaaattaagcacgcatgttaccaacgtgtcattcatttttactacctgtgaatgcttgcttgtccaccagtgaaatcagatgttgcctgccataaagtgtgtttccttggctgtggattagtttctcgaaagaaaagtggctgccgggacaactgaacagagcacaaaagagagaattagcagaagcaatgatatgccaaaaaaaaaacactcataaaggccaaactacacagaaattttagatcaacgattagcat

SEQ ID NO: 30890 - DNA, 1514 bp, Oryza sativa
attgcacacaagaaaatgatatttgcagattgttttggagcatactgtatttttcaatatatcataactttcatttgcagatgtccaaacattccttgtgactggggggattacctaaagatcaaatgctatatctttatctattattactactatgatccatacattccttagatgttgatggattcaggaggattaaatatcacttcacattgcctgtaggtcacacaaagaaacatgtaaggatttaacacggaacaatcactatcttggtggataatttccatataagtaaaactagagaccaataattttgatcttaatgaatgtatgacatgattaagttagtaaataagtccaatatgcctacaaaaacaacagagaactcaaatttccgaactcccaaggttaacaaaagtacttacttttgcaatgaaagtattcaattcgtaggtacctacaatcttttttacatcttgaggaaacatttcgctacaatgttcaggcccagttgcaaggcataagatgattgataactcagatttttctgtcaaggaaaagataatcaaattataaaagtaaacagaaaagtgttcaacataattacccaggaactaacttaaaacatttgtaggctggtcagttttatgtccatattctagcaatggatcagcatgtactagcctactcttgcacttcttcttaagcagaatcaacggaaaacactatgagcttctagattttagttcccagttctgctgcttttttaggtaagactaagtttcttgaaaataaggttcagcatctcacatgacaatatcagcattaaagattgaagagtatcgttgaatgaggaatcaaattatatatttaacttgttgaagagaaagcctgctgataaattccaccaaggttataatcatttatagggttggaaatccacatttaagatagttttgttacacttacactcatatactataattctgggggcaataccacccccaaccccctggtattcacaatgacagaccaaattaagctcaatctgaaaaggtggagctttgcatgttgaattgatgatttggcttcatataaactgccgtgcacatgcatgcacaagtttttacaacagtagacccaaagctgctacaaaccatctattttgtttgggtgttggatgtgtggccagtattacagtgtatggatgaatggtgaagctggaccaacttataaagtagatggacatatcatggaatcgattgagaaaagaaaaaagaacatttaccaccatattcacagcaccgacgcacccgttttacatgccgaagattctccaatgggcatgcttgactcaattgcctgaaacccagtcacattgataacatcactgctctaaatatagcccacttgttaattatagtcaaaccgtaacaaaagaaaaataacagcacatgaaaagaagagacaaacatgtcaaataaataagtgaaatacatggccggtccttaaac

SEQ ID NO: 30891 - DNA, 10972 bp, Oryza sativa
gccatttagacatcggaaattaagcaactgtgacacataattcaaacttcctatttgaagaaactatcaacaaaacaattaaaattccaatttcatgccaacatacgaattgtaatcaatatatgtacattctttacaattaaatcattatataagcttctgttaaattagttggggtttagattctgaatcccaatgattcctgaaatgaattaaacaaatatgtattcagtctttttgacaagaaatattcaaattaagatttttatttaactcttagacgatgacataaagaaaaagtcctatcaagagaaattaaattcgaaatgtaacattataaaattcataatacagcgtaacctaaaacaatgccatctctctgtttttttatcgactaaattgcgcagaacagagtaaacaatccattcaagttcttggtaaattcagttctaaattcctgaattgaaatttgtaaatgagaatgctataattagcattaaaaagggagaaaatgtggagttccagtcctttaccgaatgagactgttggctaacttgggctcaatcttggcagcaatcacttcaactgcccaagaaaataaataagaaataacactatgaaactagcatagggaaaaaataactagattgaataaaacagaaacctgtagagccacggagggagggagttgggttgcctgggacctcagtgagttcccatgccatgaagaccaattcgcaaggtaaactggagtcgagaacaagagatcttaggcagaggttctaaggtagatacgccatcaaaaatgaaaaaaagcaaggatgcacacattttgcctcagtaatgctaaatcgtagatcaaagaatcaactgccccctgcatgtttatcaagtgcatcagctctgttccaatttctccgaccacccttaacaaaattactacttccccattcctattcatgtcttgcccaataggccaataccaaaacatacaatgacagcagcgacttacttgcatccagtcattcacaaatctagtattggcatgtggcctgtgggcggcaggatagcagtgggattttttgtgaacaagggatcctctacacatgaaattcacttattttggctggcagtttttgttctatgtgggaactaataagaagataagatcttttgtgcagaataatgtgtgacaccatatgtttttagtgttttactgactataagagtatgttatatttgatgatatatataatattttcactaaaaatatatatatatatatatggggcgagtccccgaatccttttttttttcagcttgccaagtcggacactcgagtccgagtcggactccgacacctgtgtccgtgtcccggtaacactgcgttgagtaggagcctcggatgtggaggcatgtgccggagcggggagtagccaggattttttggttgggtagtcctacttcaaaggttcacatcacatataaaaaatttccgaacaccgcaaatcccatatacaagtacaaatttaattaaaatgtgataaaaataaatcaataatatcttttaacatcaataatcgactaattttaaaaagcacgttcaaaatgtgcaagttcaaacgatgcaatatccacattactcttcatcagaatctacaaatcctacaaactacaatggcagcaaatcagcagcatatcgctgactcatcatagatgagcaggcccaggattttaaagttgtgtattcaaaacgtaaaagggtaggaatttttttttagagcaaaagactaatgtttggcatgtataatatcacacaattctaaactattagttgtgtatattctatagcggatataacacaaacttgagcataattttgtatattcatagaattttcatataaaatcctccacatatagaattacaacatttaatttacaatttttcaacatatcaatatctagaacatggcaaatgataataaataaatcttacaatttagaggacaatttgccaatgcttttttttaaaaaaaaaatgaatgatgctgtcctcatccttaacttgagaagaaatccctttcaataaatgtaaccaagcaaccattcaagtttttttgcccttgcttcttaaattgtttttatatagttcattgaagaaaatcccttaatgactctagttctattgatgcatgcaaacttacaaaatgtaaagtcgcagcacatacagaattggagccgtggaacaaacctgagacaagatagtgaggacttgaaacagtcaaacgctaagatagatagacaaacagacagagtcagtgagggcgttgggcggctgctggcctccaggggcgggcccaggattttcaacttgggtattcgaaattagaagggataaaatatttttttccaacccacaaagtctaatagttgtatatttataacggtataaagtgttcatagaatcgaccaaaaattgaatgtgttaagcatattaaagtacagtactaaactattaattgacagaacatatcaaatttatagagcatagaaaatggaaaaatgataagaaatcttacaattcagaaaagaacattccgcttcttgatattttgaaaatatgtgcactgataaatactacaatatggtcttccaatttaagtactgaccatgctaactctgctaaatatgtgcactgataaatactaactctgctacaaagcttcagaaatcagtgaatcacaagtttcaaagttcaattgttcaaccatgaaccatgaaccatccctggatggctggattcaaatcctaaataaaaaaaatgttcaaccatgaaccattcctgattcctggattcaaataaactaatcctaaatcctaaatcaaatgaaccatcctagattcaactgtgaacaattcctaacccaaaatgtttctaaccaaagtaaccatcctggatttaggcagtacagagctgagaaaaaggacaatatgccactccattcggtgggtttagataaaatgccacccaatacattgcaaatgataaaatgccactcaatatattactttcaggatattttgccactttgagggattttaagaccaaaataccgctggctgtggatagagaggaagagggaggagcggaaggttgacccggacgacgctcatgctcgccggcggcgggtggcgagcgcactggggcgggctgcgacgggcggacagggggaggaagacggcgacggcgatggggaaggaagacgccggcgatgggggaggaagacgccggcgaagagggaggaagacggcggcggcgatgggggaggagggcttaccggcgtcttcttcctctcctcgtcgccgctagcgggagcacagacggcgctcgttcttccctcgttgccgcccgccgccggcgactacagccgacgccgttcgactcccctctccggctctctcccccttcctctctctctccatggtaggggcatatttgtcttaaaccttcttaaagtggcaaaatatcccaaaaataacctattaagtagtattttatccttcgcaatgtattaggtggcattttgttaaaaaccctccgtatcatatgagtggcatatggagtggcaggggaagaattaccttcgtgtggagctccgggaggcgtcgcggtgcggggagtggagggtggcggcgcgggccgcgggacgccgggacagcgtggggaggcgccgagtcgacgacggcgcatcggcggtcgcccggtcgctctcctggctgtggcggctggatgggttaattagattttgggatgttcttttgggccaatgggcctgaaatagtgaggagagaaggaataagttcatctgaagtcccttgacttgtaaaggaatccgatttaagtccttcaaccagaaaaccaaatacgacgggtacctcaactatcaaaaccgatgtaatataggtcccatggcagtttggatgatgattttagctgatgtggcgcctacattgctaatttaactcgtttttcatctaacgtggtattcacgtggtacatgaagcaaaatttaatctttattattataaaaattgaagatatttttaccggaactttggtacgtcatccgtgtttgagttgattttttaattttatgttatctctatcaacatttccgttgtctgttaataaagaaaaaaaaagtcctactcaaagaggtaaaaacgaaaaaacaaagtccgactcaaaagcaataataaaaaaaacttctgtcgacagtaaaataaaaaaaaaagcatcttgcgtccgactcccataaaaaaaaggaaaaaaaagtctcgccaataaaaagaacaaaaaagaagtccgtttggtttctttggcacgggtatttttttcaatttttttttacgcgaaagagttttttttcgcacgcgcctaggctcttggttttttcatctttttttaatcccatcgcgcctcccggcagcttttggtttttttatcaatttttttgtcgccggttttttctcctatgtgcttttggtttttctcatctggttttttaatccgatctttttgccgcacgcctcccgagttgaaccctgtagccgcgccgccgctatattgattgtgcgttttctcctcaaaataaaatcgattccccactcctccctcatcatttcctccattattttccctttcgattcggatttaatttgtcatatttaatatccgtttaacatttgccgatgataatagctatcttccccggtatttttatcttgagttttacactctgattttagaaaaaaaaatataaagaggagatcgagtggatgaaacaccctcaactaatttattttgggttatcgagaaagattcgactgatttgacgaggaacaaagagttttacgctctgattttggaaaaaacggaaagaaaagattgagtggataaaaaatcctcaaccaattttaagtgatcgagaaaaattcgaccagatttaatgggggaattttgcttcggtaaccatccagccacggactatcttcgaggggttgaagatggtagtagactatgctagctgagcttacggctacttggctacaggccaaacagagggacgtagcagactggcctagggcaaaaatgaaaggaaggctatctaccctagacccaggaaagattttcattaactttttcaattaaaatgtatatagcgatcccaatatttcaatttattgctcagcttttaatatataagtgaaaaaacgtctttacaagttgcaacgcacgagtcgttgcaacgcacaagcattttttctagtaacttaaaaaataaaacaaaatatgtgggccaacatgtcagtcaaataataaattttaaaatattaggacccacatgtcagtggcccacttcctccacctcatcccctctcttctctctctttcccttctccttctcccctcttccctttcttcttctccatatgcggccggtagcgcacggctgaggtggtgggcggcggaagagaggcttttaatggacctagtgcggcaggtccaccagtcgatggtgaacccgacgacgctatccatggctacgccgccgtagagggaagggagcaacggtagatggccttgagagccatggatccacgtcaggtggacaccttgtgccctcgtccgtcgttgctcccgtggtggcggcgtcggcaggcacggtgttgacgcccttggtgccgtggctgagcatggagagggccttgaggtcagtgaggctcagttgcggtgacacaaccccattcttaaggagtggtaccgatctgaatcccctgaactcatctcaccggtgtgtggctactgtgggcaaccggcgaagaggggccttcggtggacttgatggccgacgagctgctctaggagatcctgatacgcctgctgccccgcagcatcatcagtatttaagctaatctacaccatcgccgagatctagaggcccgcggcggctcgtctccgtcgccaacatgcgccgcccgtcggctgtattgctgcatcctgccttctaccattttcaaaaaaaaaaattgcaatttggtcctcggcgccaatgtcgttagcgccgtcccccttcacatttctaaattaactttcatcggggggctagggggacggcgccaacgtcattggcgccgtcatattggaccacggcgccaaagacattggcgccacgaaaaggatcattctagaataaggttttttaagggtctatttgtaggataagtttttcaaaaggattaaaatgtgaaaaatccagccttgcatgacacgctcacagtgttcatggaagttgactcaaattatcatggggtgcgcaatatctcagcaccccaaagcaccatagcccttgcacactctagaagcaattgatatctatacttctatatctacggcctgtttggcacagctccagctccacccctcctggagttggagctcagccaaacagtttcagcttcaccaaaagtatgagtggagctggatggagctctctcacaaaatgaactagagttgtggagctgagtttaggcagctccacaactctactccagactcaacttctgaaactaaatttaggagttggagctgtaccaaacaggcccctatactagtataaaaaggaggagttttaccctccaatcctacagccaaatcacacagataacgcggtatccggcatctccatcatgttcaatccatcgctaatcctcgccgcgttccccgcctccgccctcgcacccaaatcccacggcattcaatccatcgcgcaatctcgccgccgcgacaaatcctcaaaaccgctgcgctcaccccgccaccgcgcatccatccatccatcgccatgtcgcgcatcctccccatccctcaccggtgagagagaggaagaatgtacacgccctctctcccgcatctcgcggtcagcctcgcgctcaccacctgcccttgattgccatgccagtccgggctccagcgccacggccggcttctgtcaccagatccgcctcgcctaaagcagccgacgcctgattctctcttgtgcaacttccatgcttgtatggatccaggcaggctttcagccgccagcggcggccgctggatgtggcttatcatctctgccctcgctgctggatcgaggatgccgctcaccaccatagccgttcaagcaggggaagctggtcacttctgtggtagcaccggtaatcatcgtggtaaagtatatgcacgattggtagattgattgatcaatcagaagatacgctcgcttggtctgatggtcttgttcagtgttcactgttggctgagatagattgattggttgttttctcgggaatttgcaacagaggggaattttcatgaagctcatccataggtggacgatggacagcaatgccacggaaggcgaaagagcacgccgcgacaagaaagctcatgaaccagcagatggacccttttaatcagacattgctttcttttatcaggttttacagcttgcttacacacatacagtgcttgctttaacaagtagtatatgtttatcgtgtttaacctacagctttacaagtccaggtgttagattagttgattcgaaggtaatcatttagtttctcagggatggtaatttgaagattgtaaaaccttctatatttaggcctattatatcagagttaataaaatgggactggaagagggatttgtgttctaatatgaatgtcgacaagaaggcaaaacttttggaaaggaataatgagtagaaagaagagcaacatctggtatgaaagatttctgtaacatacacctaatttatatgaaaccaacctgaaacaacaaattgtgcttatcaaattgataagagtacttgcattagcctatggcttgtgttttttttttttggctatgaaaagctttggtatacattatattatttgtattcttccacggtttcagcttattttggtaccatatttgaaggatggattaattcccccgagcaccccaattgatgttgcacaacataagcaccagctgttaaactatgtcacgtaaatggagatcttggcctcactgtctgcttgagtacccctacaggtgaatcctctttcaatattatataatctatcaacaagttcaagtgaatgattgagctattagaggatggcacatatctagccttgagcttaatcgatatcgtgaggcaaaggggttcatacaagtatacactagaggttcagtcgatatgatctttatatatgcccggtgggtcaatatgttctgctaggggccgccgttgacgcgtggaccgaaaaggagttttcgggtttcaaccgagtgtacatgaacctacagggtcgcacgcttaatgggccggaataaggggtttggatggagatccaatatgagcttaattcggatagggatctgaataggattcctacgggccttggaggcccgagtgatggatcctatatattcgtgaggggtgcgaccggcggaggcattgcatcacgtaagaaaccctagccgtcacttccctccccgagcaaaaccctagccgcgggcgggtgctagcacatctgcgcgtggtgttccgtccctgtacgtgtggataccggtagaggcgccgctagtttgcggtgctgatcggcgtgggagtacggcgagaagaacgcacgaggaggagaaggtcgagccggtgcgatcgactactttctctacatcgccgcgcgctacttcgcaagaattccttcgacttattagcgcctttttccgttgcgcagcgcgtcgagtggtaatgatctatgatctaatacttgcatggttcctggtttacgcgatagaaaattttgatttatgctgtcgtagcctacgcgtatcccaacagcttgtgctctactttggcacctaccgtcctgggatcccttcgccggggtgttatctggtgctcaacacctgggccaactcggtcgccatcatcccgcctctgcacaccacctgcgttaccagcatgtcgcactgcggcattgggaccggggtcaccatcctacgccacaacgactactacgactacgtcctcgtcgagctcttctcacatcaggacacccgaacccatctcgcctccaataaggtcactctcttcttgtggtggtctcctagctctggcccgcggtcagtggatacagaaagaggtgctactccccatccctgcttccaatcaagaaaaggacgacgtgacatggccacccacctactccttccgtgcagacatggtgtttgctgttttgactacctcgctttgctgggttgatcttaggacagggatcttggtctgcgatcacattgacaagctcagcaccggcactgacgacgatgatgatcacctgcttttgttcttcatctcattgcctgaggaatgcgtcatgaagcctagccttctatcttggaagaggttggcagaagagcaccgcaccatgatctgtagggacccggagaccatcctgttcatctccatggacaactacatccaaggcctccccattggcgatacagtgctcacgacatggactctcaagttcccactcacgaaccattggacttgggagaagcactctgctccatccttgttcgtgggagaccttctaaatgaccttccagtcttgaaattaaagaatccaaggatgataggaaggcgctgcacattgccaactgcccggtcagtagcattgacagtcaaaaccatcttatcactagcctcactattaccgagtatgagaggaagcatgagcaagggcattggggagtcacgggattctgtacgagatcagcattgacatggatggtagaacggtcttggagtggtcttctcttgaaagtcgccactcaaagatatttgcagctgagtttaactgctgcttacaacaggtacactactccctcttttgtccatttaaagtgtatataattttgatacggcaaactcttggaaagttaatttaaagggtgaactccatttcatcgtcacatctgcggtttgctcctttcccatttttccccttctttttttagattgccctaacttccttctcttttgtgaactttgtttcttcgaaacaatggaatgggaaagtttgcagcggagttggtcatcaacatttaagtcgttgagcgacgaagaagtggttgatgaggatgatgaaaattggaagtgggtgttcccggatgaagtgggtaatgagtgacttgtttaagcattttacaaaactagtaatgtgcccgtgctaacgctacggcggtattttataatgcaagtgttgtatattcacattgttggaaaatgctattgacaattcttagtacaaaatgtaatagcaatgaaccgatgttataatcgattgatgcatatccttgttgcgttgttccgacccaccatttcaatctcaaaagattattgacataatcataaaaaaacaaatttccccaattgtacactggcaagaaacctaggaagacagtgtcaagcacatatatagtcgaagacactggcaagatccctgtggttgaagcacataaacaggtatgcagcctagctaaggaagaaggaacgtttgagaagtgggagtagctactacataagtgggatcgagctgcatagatctcagctacttcttgttggcttcttccccaaccatgcaaagaattgtatatagagccaccatacgcgctgcaacatggccaactgataatataggatttagtacagctaggcaattgaagagactgagcacatacactttggctgttttaaataaaacattttcttttgtattgtctctgcaagtgctcaatcagaaaaggttaatcagaattgtcaccaggtgacaatctcacaaaccaagtaggcagtttctttttt

SEQ ID NO: 30892 - DNA, 1097 bp, Oryza sativa
ccgcacatcctcaaatacaaagcacttccctagttagatgtaggttagacttcccgttcgagaaattttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaagatggccaaat

SEQ ID NO: 30893 - DNA, 746 bp, Oryza sativa
  unsure (1)..(746): unsure at all n locations
tcactgatcagaggtgtaccactgtacccacaagacacagaccccacatcatgtcaccatgtgcctgaataccaccacggtacctcggaaaggagttgtgacataccccttgcataacacaatccactacagccgcactctttcctggatcataatcacccccttaaaaacaaggcatggactccccagcgacccccgtgggcttatctccgccacttctcagtctggtgccccgcaatgaaccatgctatnacaaaaanaaagggcgcactaaagccgttgcccacgctggcttgtggttggcacggttaatgtttcacaaccgaaactcgtgaaccggtccttaattgtcatgagcacgactctcaaaaccatgtgatcacaacccaccattatcaagttttagttggcacattcatttaaaatttttttttcaccaatcacgattggccatcgtgaactatcattaagccatcattaaataatagtgagtcataagttatcccaatagtgtgctaatgtttctaagcatggctaagcaatcacatctaatatctaagcctgggaaaaaaacccccccccccccaaaaaaaaaaaaattttttttaggtaaagctcaactagtcaagttataataacccaaggtatcaaggaataaagtaatcaagaacaaaagggctataacaaacaataggttaattccacccaatgacattcggaaataaatgcaatatttgaatagaaac

SEQ ID NO: 30894 - DNA, 1159 bp, Oryza sativa
caattctgactttagccaaaacgaggagaaacaatactgataaaggcaacattgaaaaggtagaaaataggagtaacaaagctcacatttctatccacctttagtcgttttgctgattcattaacagaataatactccatatttccatctgaatttggtttggttgatgatataattgaagggaacatcactttatccctctccgcagcattttcaatcgcaactatgcagcatgtctcagagggtccatggggggggaaaaccaccttcacagggcaatgacttctgctcagacggccttggtttcatccatccccaagggtttaaacatgaggcttccatattcaggctgttgcatttagaaacattggagtttgacaggaacaacctgctccctttcttctcagttacttcaagtgatgagaaggggctgtctgaattcaattcagcacatttgttactttttaaactatcatgttggagcgtttggtctgtagcctttgcaataatctgcatggttatggattaacaacaacagcagcattgcccacctggtacaagcaaggaacccatgttgaattaaacataattatttgatctacactgaagtaaacagcagagcatgacagacatcatatgcatgtccagcagtttcgtgttaaaggaagcacatatatggacatcgtgcttaataacaaggatttaaatcttctccaatagaggataaatacttgctctcaagcatatgtacctcgcaatttattaaacttgttaggttcgcacagataggttgccacgcaatactacaagaatgtcttattactagctccttaaattatcacaggtaataactatattgaggaaggaatgacatcaggcctgaattggagggctttaggagagaaaccctagggtggggtgatatttaaaacagagaaactacttcactgatttgcttgattcacaatgataactggctcatgtagtggaaatggcatctaaaggacacaagatttgaaagaaattccaaaagataagaactagatacaggtagcaagttggatacaacttatattgcttatcatattttcttcccacatcatagccggccatgatcctgtctgcctgagtctttccctagtccctactccctacacaa

SEQ ID NO: 30895 - DNA, 1478 bp, Oryza sativa
attaattattttaaacttcaaaaatggattaatatgattatttaaagcaactttcatatagaaattttttgcaaaaaaacacatcgtttagtagttcgggaagcatgcacgcggaaaacaaaactatctttctctttttctcctgcgcttgaacgcagcctaagtgatgaaaaggaacaaaagggggactacatctctttgaaataaaacaacaacaatctatttgccgaaaactatcaactttatttgtaataacacactcgtccatatccatggacaaacgtttgtgctgaacttccattattcagctcataaactaagaagcccggaagctggtggaaggcttagccaagtggtgaaaaaaaacatcgatcttgcagagtgcacacacttttcatgatccaaagtactaaaagcacaaataactggccaattctgctttgtaataggcacagataatcgcttatggtaaacagatgaaaacttttgtctcctcaatcagaaaggtcgtgtagatggttggcattatcagtcccgatcaaacgattgtacatgcacaatcacttgcccgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcttgaggatcatgcacaaggcatcggaatacagataaaaaatttgaaaatggtgtttaaatgtgattttaagttctttacacttagcttctcacaacataatatcctgaattgcctcaattcaaccatttatgacggttttcagtcatactttatgcttgtcaaaggtggtcttctggaacatctcttttaggacaccacatactgacatacatttatgaaaaagaagtgctgcatcaaaattgacatcggaaacctctacttttggcctaaattagcgtgcctttgagttccttacagttaaaaagggcaggtctagtatatcttcatagtctagacgtaaataagattcaacaaattaacttagtagtatagactatataattgtactgtttaatattagagtatatggtagttagagtcatattaggatatgattgatttatgtggattttttccatatctgtaatccttccttatctcatgtatctatatactggcccctgaggctctaataccatgttaaatataatacttccttatctctaccctatttatttcctatatatgcgggctcctaaggctcaatagaatgtgtccaatattcgcagtaatctcctcttcctatactattcaacatttatttacctgatcatttttgctgaaccaaatccaagactgtcatgaaataggcttgtcatgtacttcttctgtgcaaggcacaaaagctctgagctgt

SEQ ID NO: 30896 - DNA, 3864 bp, Oryza sativa
catgtggttgccattatcttagcaaacgcaaaacaacttaaccacccaaaaagaaaaactatctttttgtcacataaaaaaaaaagaggacatttgtggaccaggtaaaagtacacactttcatttactattattagccaataaatccatacataccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaaccagtgtggagatctccatgaagaagagcctgtgctctctcaataaacctgcatatgcaaatcatgtccatcatctccaatatgaaaagaaaagaaaagcgctggtttaatctggaaagatagttacattgatttcaattcagcaatctccaatttaagctcagcatcctctcgaaccgctgcagcatcattatctaggaagggtgatgtgcaacgattgtatttggcgagcatgtatgggtctgagaacacgacttgctctgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagatgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtacatgtgtggcggcggcggcgcgtggaggagatagggacctgcttgatgacgacggagccggcgtcggagaggacgatgtagacgaagttgaggttgccgtcgccgacctccttgatggtgagggcgtcgaggctgcctcctaggcgcgcggcgagggcgggcgtggccttgatgtaggccaccagggacgcctcgtcgagcgggcggaagccctgctgctgctgctgctgctgctgctccgccgccgcggccatggccggtgcgtgtgtgcccgtggcgtcgagttgaccgatgcgagcgccggcggcgaagtggccgcgacccgcgagaggagtggggaatcgagtgcgcgtgtgtggaagattgcgctgcccgaaggtgtgtgggttttgtaacagctgctgctttcgcggaagggggcggttctctgaacctggacttgttattggtacaaggcggattcttcagttgagtcgtgtcatcagtgtgagctaatcttgaggagttcatgctatctttgagttttcaatccaggccgtgtttagattcaaaattttttaaattttttttaactttttcatcacatcaaatatttagacacatatatagaggattaaatatgatgaaaaaaaacaattgcacagtttgtatgtaaatcgcgagacgaatcttttgagcctaattacaccatgatttgacaatgggatgctacagtaaatatttgctaataacggattaattaggcttaataaatttgtctcgcagtttacaggcggaatctgtaatttgttttgttattagtctacgtttaatacttcaaatatgtgtctgtatccttaaaaaaattggcacacaaactaaacacatcctagtatactgctaattttgaactgaatgtggcttctggtcattggatttggtgaattttcctctctgttccaaaatataccatcatttatgttatctctatattaccactccatctgtttcatattgtaaaaattttctacaattgaccattgttaatgaatctagacataacatccatataaatatgggtaatgctagaaaattttataatatgaaacggagaaagtattaaagttgagtcatcctccgttcatctccttctcccaccgctcgtgcagtctatttgtccgctccttctcaaatcatgtacacaacctccgtatgatacggtactttatcctcaattaccttcctagccctttcttactcgtctcaattgtatgttcgatctgttataatgcatgaatatatgttgctaataaatctgaataagtgtttgttcacttatagcagtattttaggacggatgaaataaataaaattgttttctcgaaaaaataaaaaaaaactaatgaatctttcactcatgcttcaggctaccaatggtggtgtgccttcggttgaagttggaattttctagcaaatcaaccataatcgaaatgttctcatatagatatatagaaacatgccatgcctacataatttttctgaaaaaacagctctaagataaggaccatatattcatttgatagaatgaaacggttactatgttcgtttgtgtgtttattagaaaaagaaatttattgtgatattttagaggattacaattcacaattattgtgtcccttcaatgaactctgcgagttgataaggtagcatccgaacgattaatcagttggtacgcatgttccacgctgttcttttcaacaaacagggagaatatatcgactgtgtttggccccatacttcggcttgatgtcgccgtcaatgctagcatcatgtatcttcaaaatgacatcatatccaaataaaagcagcatgaaagtgccagtcctccatattaaacggcatgaaactagctcacaagacaaaaatcattatagtattctcatgaccaagcgaaccatagtgagaaagttgacaaactctattatattcaccggatgaactagaatgttcaaagtatagataggtcttttggagaacttctagcatgtacagtttcttccaaaatctccaattccctaaataatcatattatgagattttatagctatagaatccagaaaaaaatgtgtaaagtacacgggcggtccttaaacttatagcggtgtgtcatctaggtcattaaactctcaaaatgcatatccaagtcacagaacttgtcatagtgtgtcatctaggtcccagatcaccacaaatccttcaggatcctacgtggtgcggatgtggcatgtcacacgaacatgatgtggcataattttgactgacaaataggacccatttaaaaattttatttctttcttttttttcttctcttgcattttcctttcttctcctttgtctgtgacccgagcaaaagagaggggaaaaaaacaagaataagaagaaaacagaaaagaaaaagaaaagaagaaaaaaaaggacatgtcacgtccatgtggcaggtcacatcagcgccacgtaggatccaagaggggatgtgtcgatttgggacctagatgatacactttgataagttctagggcctggatatgcattttgagagtttgggggatctagatgacataccgctacaagtttaagtaccgctcgtacactttactcgaaaaaaaatctacgaggaagctaaggaaaacctactttgtagattaaattctgagaaatggaaatctagttgtgagagcataaaaaagcagggaaaaccagttttttag

SEQ ID NO: 30897 - DNA, 10292 bp, Oryza sativa
atctgtatggactactttggctatatacattgttgttgcccagcccacatataaccggccaattctgctttataataggcacagataatcgctgatggtaaacagatgaaaacttttgtctcctcaatcagaaaggttgtgtagatggttagccttatcagtcccgatcaaacgattgtacatgcacaatcacttgctcgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcgtgaggatcatgcacaaggcatcggaacacagataaaaaatttgaaaatggcgtttaaatgtgattttaagttctttacacttagcttctcacaacataatatcctgaatagcctccaatttaaccatttatgacggttttcagtcatacttataatcgtcaaaggtggtcttctggaacatctcttttaggatagcacatactgatatacatttatgaaaaagaagtgctgcatcaaaattggcatcggaaacctctactttggactaacttactgtgcctttgagcttcttacatttaaaaagggcaggtctagtatatcttcatagtctagacgtaaataagattcagcaaattgacttagtagtacagactctacataattgtactgtttaattacctgatcatttttgctgaaccaaatccaagactgtcatgaaataggcttgtcatgtacttcttctgtacaaggctcaaaagctctgagctgttgtatatagggggcaggtatgcttccccattcccatctttgtgtttattccataattcgacaaacttcttgtggaaaaaattccatgaatcttcaattgtcttcaagatccatttcttgtaagcctgcaaaatatgtacagacatagaacttattttatgcctggcgaaacatcatgaaaataccttctagaatctagatgttgcaattgcactttgccatatcataacttgtcatttctgcagttcccattaagtactccctccatttcatattataagtcgtttgacttttttcttagtcaaagttctttaggtttgaccagatttatagaaaaaaattagcaacatttacaacagcaaattagtttaattaaatttaacatagaatatattttgataatatgtttgttttgtattgaaaatgttattctatttttctacagatttggttaaacttaaaaaaaattgactaagaaaaaaatcaaacaacttataatatgaaacggagggagtaatactcagggacattcatcgtctgctgagcaccctcctccctctgttacatacggcatatatcaacaatatcaattgctagttattctataggatacaagtatcatgttccaaacttctatcctatcgaaattagtacacaggaagacatgtggttgccattatcttagcaaacgcaaaacaacttaaccacccaggtaagattacgcactttcatttactattattagccaataaatccatacacaccttacgatcatttgcttgatcagcatgtccatcttgtgaaaaatatgccaaaatcaagttccccaggaaggccccaatatcgtaacccattgggccatagaaagcaaattctggatcaatcacttgagtagaatctggtgtcaccatgatggaactagtgtggagatctccatgaagaaaagcttgtgctctctcaataaacctgcatatgcaaatcatgtccatcatctccaatgaaaaggaaagagaaacgctggtttaatcaggagagctagttacattgattttaattcagcaatctccaacttaagctcagcatcctctcgaaccgctgcagcatcattatcaaggaagggtgatgtgcaacgattgtatttggcgagcatgtatgggtctgagaacacgacttgctctgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtacatgtgtggcgcggcggcggcgcgtggaggagatagggacctgcttgatgacgacggagccggcgtcggagaggacgatgtagacgaagttgaggttgccgtcgccgacctccttgatggtgagggcgtcgaggctgccgccgaggcgcgcggcgagggcgggcgtggccttgatgtaggccaccagggacgcctcgtcgagcgggcggaagccctgctgctgctgctgctgctgctgctccgccgccgcggccatggccggtgcgtgtgtgggcgtcgagttgacttgaccgatgcgagcgccggcggcgaagcgggaaatcgggtgagcgtgtgtgttgaaagtggctgctgctcgggtgggatttgtaacagctgccgtttccgcggaagggggcggttctctgaacctggacttgtttttggtacaaggccaggattcttcagttgagtcatgtcatcatcgtgtgagctaatcttgaggagttcaggctatttttgagttttgaatatattgcttcaaatcttgaactgaatgcggcttctagctattggatttggtgcttttcgtgccataccttctccattttaaaatgtaatagcatttctgatataattttggataagtgtttgttcacttaaagtatgatgagataagagttaaaaagatcagaaaaattaaaaattaaaaattggatcacttcaggctagctgccaatggcggtgtactggcgtaccgtcagttggagttggaattttctaggatatccaccagactcaatatggtgtactgaacaaaatgttcttctatagataaaagacgatatttggattccaaacacatttttaaaaaaaattgtaagcgcgttagatattgaacacggggtctcaaaattgaaatcacacattccattctataagtgcatcttgttcttctatatatagatacatgccatgactatatagttttgctgaaaaaacaggtctcaggtaaggaccgtatattcatttaatatgaaacggttactgttcaggttcgtttgtgtgtttattataaaaatagaaatttactgtgatattttagaggatcacaattattgtctcccttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaacgtatttatggccatgatatatttaagagaaaaaaatcattctaaacagtatatatttactgaatgtactagaaggtccaagcacataattactccatcaattttaaaatataaggattgttacaataaataatttatttttttcacttcagttgttagcatttgaatttcgaattacttgtatttcttttgggaaattttgtaaaaatacactcgttatgatcaaaattacacaaaactacaaggattttgacacatagcacatgacccataggtactatggatataaagttccacaaaaccacattgtaaccaatttgacatactcatatatcaaatttttaaaaggccatggatgtaacatttatatgatggataaataactcataaattcgagatgcgattgtataacttaaaattatggtaattcaaagttagaatgataaatattgtgttttttgaaatgaccataatacatatgtttatgtgctaaaaaatcgtatgtttttttaatttactcaatttgttctaaaatttagtactagataggacacatcatagtactataaatctcgacagaaattcgttgggtattatatgctctatgttcaaattcgtagtactataatgtatcccatctagttataggttattattatttgtgattaagaggtagatcataatacgggtggttaaatgaaatttacttattctctctttccaagcatttgattagctttaaaattattgaaatgatgggaatcacaaaaatcagtgaaaaataagaatattatggtgtaaaatttaaatcttaaaagtatagaaatggaaggagttattccaacaccatcgggcatcacttgcccgcaaaattgcaataactcaccataatatttcaaaataattcgacggaattcattcgctcgcgccgtctccgaaaccgaatccatttcctgatccagcaaaggacacagagagagatcccatctcgtcctcgtcgcctccgcctcgtgagctccactcacctaccccacttcctctcctcgcttcggccgcggccccaaaccctaaccctcccgcggcgatcccgatggccaccacctcccgccgatccctccacgccctcctcggcggcggcgcaggtacgcacgcgcattcccggcgctctccgatccgggtcgagaatttgggttcggttttctcctcactcgtgttctctcgtctcgcagtcgccgacttggtgctgtggcggcggaggaacgtgtccgcggcggccgtggcgggcgccacggcggtgtggttcctcttcgagcgcgcggggtacagcttcccgtcagtcatggccaacgccctgctcctcctcgtcgccatcctcttcttctgggccaagtccgcctcgctgctcaacaggtgggtttttgccctggctctacagcaccgcgtgtttctgatctcatgtagagtcgcgccgcgccctgcggccctgattcgctgtagttgtaactgcggtgttcactgtaatgtgtatgaggttttgctgaataatgtggactttcttttccccaaccgtttggttgttgcatctttttggcttcaagaagctcactgccaaactgtttcatacactaacttgcttagcatttttgaattacgggttgcagtaagaaactaaacttcaggccagagcagtttgtaattggaagtgatccgatgatctcctaagattagagattgttcaaaggtttgaactctgcatatgtcggggtttcctaattatcccttttcctgaaacctgcatatttcgtttttattacattaccaataatgcatctatccgatcccttatctacaaagtaaagaggctgctttactttaaagctaagccgcgatagcagttcgataagttaattctgctagcatgtgtcattttctctagagcttgtaactgtgctatatggtctcttctgcaagcaatccacaaggtttttttcctagatttacattacatggtcaatcaccgcgcttgccattccttatcggctcatttatgagtttgtgttccccatctgacttgattgttgcctagaattgatatgcatttatgcagtgtctctgcgattgtatcgctaaaccgaaaaagaaagagctgtttttggcactttggttgttttatgttgttctctgtgactggcattgtacttccattgcccatatcatctatccaagtttgacacaaagttgtgatttttgcaggcctcttccaccactccctaaactagaggtctcagatgtggttgttgagaaagctgcagatcgggctcttgtatggatcaacaaggtgttggctgttggccatgatattgccatcaagagagataggagtgtttttataaaggtctctctcttatacacacacatccatgcccactagtacacacacaactgtacgtctatatggctgtacctgcctttgtatgctttcttcttatgccccttattttgtttggtcatataggttatattgattttatgggtggtttcatacattggaatgctcttcaacttccttacgctcatttacattggtgagtactactgaatttgttactctttaacttcctggacctattcatgtatggatcaatcgttcttttatgatagctcatatgtaataattgtatcattctggcttttctctaggtgtaatgttttctctgttagttccaccattgtatgagaagtaccaggaccaagtcgatgaaaagattggtatggcgcacagtgtactatcaaggcacttagataccatcattagcaagactggagaatcaaccaagcaaaagaagactgagtaaccggtgtttttgctacattgggtgagcttctaagacggtttgaatcttttttactagttcatggtatactctaaatccaacaaaccactaatagcttttgtgtttcacatatttagtatgctacacatttcgttaacatgatagcatggacaacatttttgtttaactcttgcaatctcaagtttacataatgttgcaatagttcaaaaaacctttaagatgctataacggcaatgccagtggatctttgttactcgaaaagtcccacaaaaacctaagggctaagggcagcaaagatgagataaattctcgttgaacaaatggatagagttacttctcaccgtattctgtatttctgttgtatttttctaaggcaaaaatggtctttcttagaaaggcgaggcagtgatgtcctccctttgttaataaaaagagaaaccaccagcccaggaatggcattcaaggcactctaaatacaaccaagtaatcactttcagaagtttgtttttctggagttgaactgttaccacacatgaaatttacaaatgttctgagaccatcttctgttgttcctgagaaatgatacttctctataatgatcatcttttgtcttatcaggaacctcttttgtcatatgtggttggtcatgaacctcgtcagttactctccatacctgtgaaccaccactggaaatattcttggatatcgaagatgtcatgtttgactgctgatgtagtttacatgcactctgttcaatttgagaaatggaatgctttgtatattttttcaagtaacatgacacatgctgaggtttatcatgggcacatatcttgtggataatgatatatacttttcccctgaaatcattttctgtagccggcatatacaaatatgttggttgctggtgcactaaaccgtttttttagtgttcttgattctcattgttaaatagttccctaataaactttagtgagctcattcgatgccaaactgcacacatgcatacctgaatctttggtaatcgtctagggccagccatttttctctactacttatgaaccgttgtgttcagtttttactattctggtgtattaatttgctgcaaaacttatgtatcatgtaagtattttgtgttggtgtaaaatcgctatgctagaaattaagaaaaattaacaagacaagtcagagcaaccacatgcatatttggaaattctgtgcagttcattgtagaaacaaattatgcatgagccagccttgataacatattttcaaacttaagttgtctgctcaggctccagtatgcaacacctctctttagaggggctaaggccattacgggcaccagtggacaaattggcttaggcatatccgaaaggggacgcctattggcaattcaatatgtgtgagcattatggtacaagactaccagtgcagagcctttttgggacactaacataaaaacttgggtgggtatccaaattgtagggtcactactcactgggtcaagcagataagttctccatcttccaacattctttttctatactccacagtacacatatctgcacacttatttgtgatatggaatatagtaagcattattctggcaaagagaagacacctttttttttctggtttgctattatgaatcagacggcaaatattgcttccggccgagtcatgtcatgctgacttcatgtttagcaaacgctaatatgctatatgaacatatctttgctcctggcccagaagatgatgatgttccacttgctacatacacacattgtgccttttgtcatgccccagtgccccaatcatatactaccggtatgtacagactacagagcactgagcccggtcgtgaggcagcctctgccctcctgccgaggaaagccgacgctattgccttccccgcactgacccatcatcaacaactcaactcaaaatcacaaaacgccttgaccgcacactgccatactattatgtgtgtattcacttcgcgagctaggcacgtagccacttcgccctggaatcaagtgcacgccccgctcggctcggccagtggtcgcgagctgcacgccgccgctgcctgcacgcacgagcgctgcttcatttcttcttcttcttcactcctaccgtcgatgacgactaattaaccgccaaccccactaccgcctctctctttgctggctgccattgcctcctctcttccccggcaaaacaacttctctcctattcccacctcttttcacccataaagcggaagtggatttttgtcgggacatcctctcgttttgtgcgtatcgtttaaaaagttatcaaaatttttttaaaaaaaattatcaagatatatattgtgatcaatatatgatatatcttttcgcaaacatgcaagttaaaattcgacatatgtaatttgaaactgggtatcaatcaattttagcggtagaggacgtgttcttttcacagttaaatttgctatttttgtttttacttgtataagttgaatttgaatatgcatgtttgaagtgacatatcacatatagggtgtgtttagttccacgctaaagttgaaagtttgattgaaattgaaatgatgtaacggaaaagttgaaagtttgtgtgtgtagaaaagttcgatgtgacgtttttgggattcaaagtttggaactaaaccgagccataatctgctacactaaattttttaccacctccgtcccaaaataagtgcaaccatagatatccgtgtccagcgttttgactgtccgtcttatttgaaaaaattataaaaaaaataaaaatattagtcacgcataaagtactattcatgtattatcatctaataacaataaaaatactagtcataattgtttttcaaataagacgaacggtcaaacgttgagcatgaacggtgttaaaactgcacttattttgggagtgacatgtaaaaacgagatgatatccccttaaaaaatgaatatagtttttcccataaagcacgctccacttgtgctgatccattccatgtcaatggagttcatggagccatggacccatctcctcctcctcctccttaaaactcgtcttcccccccacgtctcaccaccatctaacgtgcgtccatggcggcggcttcaggccataatgcgcgcctgcttgcgctcgcgctcgcgctcctgctcgccgcgctgcacctgcacggcgtggtgtgtgaccccagccatactcacttcgccatggtgtcgcgcaatgcgccgtcgtggaggcccgatcgcggtggacaagggaaggtatcggcgccgtcgctggatacgtgtggct

SEQ ID NO: 30898 - DNA, 17040 bp, Oryza sativa
  unsure (1)..(17040): unsure at all n locations
cgttcccggacctagcgctcttccacgccaactccaacaacttctccggcgaggtccccgacctcaccggcctcccgtacttctacgagctcgacctctccaacaacaacttctccggcgcgttcccggccaccgtcgtcccgctcggccgcctcctcttcctcgacctccgcttcaaccgcttcgtcggcacggtgccgccgccggtgttcgacctcaccgtcgtcgcgctcttcctcaacaacaacggcttctacggcaacatcccggacaacttcgggaagcaccacggcggagtacctggtggtggccaacaaccagttcaccggcccgatcccgcgctccatctacaacacgtcggcgaacctctccgaggtgctcttcctcaacaaccacctctcgggatgcctcccctacgagatcggattggtggaggggctcaccgtgttcgacgccggcggcaacgacatcaccggacccatcccgctctccctcggctgcctggggctcgtcgaggagctcaacctcgccgggaaccagctgtacggccacatccccgacgtgctctgcgcgctggccaagaccgggaagctgcagaacctctccctctccgacaactacttccactccgtcggccgccgccattgcctcgagctcgtccggagcaaggtgctcgacgtgcgcctcaactgcatccccaacttcccccaccagcggccggcgctcgagtgcgcccgcttctacgccgacccgccgcagcactgccccttcgtgccgcacatcccctgcgacctgccgggcttcaggccgccggcggcggcgttgccttcggctgtggcagctaaanaagcgancgncgncgaaggtgttgccaactgaactgatcagcgatcaccaactttgtcagcgttttgtcgttcagatcgcatgattccaaactttgtaactgttggtcaataaacggaaaacggcctaccaatttgtgccgcaaatctcagcctgacgcattgctgacaacaatctgatatcacatcgcaataagagggaaggatgcaaacacgaacattcttgcatccttccattgtatccttacaagtaatcagtgttctgaaattcactgatcagatgtactagttgtagctatatttcgacagaagtgaataatgagaatttggaacggtaaaacaggatcttcgttaatgtattcttgagatgataaattatatagagtacaaattggagaagataaataagagtacaaattggatcgagctatgtacacagatcactgtaagataaaaggcaggcagtagagtaaataagctgtcccctcaaaatgcgacaacgatatatggaggcacggaagcagaaatttcagaaaggctccacgctgcctcatcccctctcctcgccgattacatgttatcgatgagctcatgcggtgttcagcttagcgagcgtgcgcttcaaagccttcacgctcaatgggctgttcttgctctgcacaattccaacaaaaggaaggtcagttcgtacgttcaaatatcttgcacaattccaacagaagaaaggtcagttagtgcattacagttatctgaactatctttggagccaaagcaaccttaatgtctagttttttcagaaaaagcatgatgacaaatatttgctgagttcagatcatgaaagcctcgtgccttttcaaaaccgtatagcttgtcggagcagaatactatgatgaaaacaatctttggaatagaatgtaggcagtataaagttgcagtaagaacgaacaagaaagcgaggagattaccgctgagcaggttccagcccgggtgttgcagacagggtagtcaggcgggcagcagctggcatgatccttgcagcaggttgcaccttcaactgggcaacagccccaaaccaagcagagattcctgaagccgaatgcgcagcagcaggtgctgcccgctgggcaagagaagttatcatcgcagacatggtcaggggcggatgggggaggtggtgttggaggagttggaggagtcggagatggcttgggtgggtttgctccgctcttggtagggtatgatgccatcatggcaatgccacacttccccgtggtcacattgatattgcgctccatgcgaacgtatccagactcaccccacttcgggccccaagagttgcggacaatccagtagtctttgccattgtcagtgccataaccgacggcaaccacaccatggtcaaggcttgtgccacacctaccgctgaagacgccctgtaatgtaaaaatcaatagttgttacgaccaaaacctcctatatgcatggggtgatatctgcaagttcatttaccgaatgatagagctggaactcgcggccaccagcctcaatagcaacactgactggttggtgagcaaccgccttctgaagtgatttctcatcattttgaggtacatcctcaaagccatcgatgctcacaaccttagcattttcctaaaacaatgcacccgttgaaacattagcgatttgcataatgtgggaactgaaagatgaatgtatgaagttattcatcagaaaataagttaataccctgttgatgtcacacttgccatctacagctttgtaaggatagtcatcttcagtatcaatgcctccattcttaatgatgaagtcaaaggcatcatccatgagcccaccgttgcagccactgttctgtccattggttgagcattctacaagttcttgttccgacaatgtgatcatctcaccagtaacaagttggttgatgctttctactgtgcttactgcggagaaggcccagcagcttcctgcatcccaccattcaagaccaaagatgtcagtaaccatcaaaataactagtgtcatccaagagagcaacaactgcaatcataccgcaagcaaccaattgtaatatgaggcaagaaccctaaactgtttaattgtatcaatattatcaagatcaagatggatagtaagatatttgcagacatttgtttcacccctgtttttacccacaaaagcagtttgaagacacctgtaggctaatatcagcaaacagctcccagcacaggataaaaagtttgctcgactgaacacgaaaggttgataaggtgtgatatcccttaaaagtcttaaaggcccaaaatagttgcaatgcaaagcaacatcatcaaatcggtttaatgtcttagtagttggttacagggtcaccttgtccaaagtatttgactgatagatgcaccgaaaaagacctttaaaaatataaagacaaaagcagcacaaccacagaaacggcagtcctaaaatcaggaaaaaacaagctaagctaaactacaatcctggaaacaaggaaaccacactgagcaagtcagccccaaccaacggcgggctttgaatctgttcaagtccacaccgctgtcactgcacgattcacaagtcacagccgttgccaactccagaagcaaagaacgaagagaacaaataccttacacagttaacccaatgagaggattttccaagaatacatcctgcatccactacgtaataaatccttaccatagaattccaaacaattattcggtccagtaaattatcatcgtattaaaagaacaataactctgtcattaaatcagatatgctcattcaggggggaaagtcagctttagctagaaaaatgacccatcttttctagagactagacggtgtgtgactatataatcataatctactattatattatgtatatatcagaaggaaatctgcactgttttgcaagtaggggcaaaagattactagctgtgaacctgaattaactgttgtgaaattgccctacttagatccgagattagcgtgacaaatagataatcgcatctaagctttcaatggtaaataatcgcacaagggagatgagatgaggaaagagaagaaattccttaccgcattggccctggttcttgacgggggcgacggcgcccttctccctccagtcgacggactccggcagctcctccaccccgtcgtggcggtacctctccccggcggcgcggctcctctcggcgaccttggcgccgaggaaggtcgcgcggaactcctcgttggtgagatcggcgaagcggttcatcccgaggcggaaccccccgcgctcgtcggcgcgggcgttgtgggcgtcgacgaacttgaggttgtcccagaacacgaggaaccggcgctcgtgctcgcccccgagcgcgttgggcgagcccccgccgttctcggcgagccagaggtcgtacgcggcgcgcgcctcggcctccgtgggcccttcttccagcccccgcgccccgtgctccgcgttgtaggagatgatcgacatgtccggcgccgcggtggccgcgccgacgatgagcagcagcaggaacgcggcggcggcggcgcgggcggccatggcggcgacgtggagacgagcgtctctctccaacctcttcgctttcctcctcttttcttttcctcctttttttttccttcttcgttgggtttgtggttttttgggcttgataggctcgatgcgggtgggatttataggcggcggatgcgtgtttgggtcggcgactggaagaggagtttgggtttgggaattgggatgggatgaggtgagggatccaacgccgctaactaacaattctgatctgaattaggttgctaatcgtaacaattcctatcttaattaggagcgaaacagggtggatattctcccccgaataaaaaattttccatggcgaagtcgatcgggtaaaaaattaggaaccgaatcctcaagtaattagtactataatctagctcgtggtaactggtaagacacctcatcggtgtcgaccaaatccgttggatcgtaaataaacaaggcagattttcccccccccctccctttctcatcgggtaatttagaactgacggagcgtggggctcctcaccgggagaccgcgcaggcccccctttgccagttcggccgggggccctgggtgaggttctaagctcccaatctgtggaaggttcgcaagagcggaaacacacaagacacgggcgatgtatacaggttcgggccgctgagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcaccatctctccctccctttctttcaacttgacttctcttcattaatggacggagatttgtatcgctgccatccgaatcaccttctgacgggacggcccatacctacctccactttcaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggaggtaacacgccggctccggctagggacgagtgcttggaggctctcgtcctgactggacggggcgaggcgtgcgtcagaccgcctgtcgccacctaacccacgatctgaccggtctgtgactggtcacagaccggataaacgagcgcgctgcaccgtattacacgcggcgtgacgcgttcgtccaaaccgcaataaatgcggttaggtgagcgccgctgtgctcacctaacccatacacgcggcgcaaaatccacaaggggtcggggcgccccagccctcggggccaaggcgggagcggtccgaccccctcggggagacaaagaggagggcgaacacaccaccctcgggcccgacccccccccccccccccgtgggtgccaggccacgtgggcgattgtgtctgcctcaagcctctagtcacgatactcccggtcccatgtcatcgacagtagcccccggcgttatgccggggcgattaccctcctcgagggaagcggtcgggcgtgacgccacttcctaaggcctggtgacaggtgggaccggtctccacagttgggcagaaacccatcagtcgcaaatcacgcacatcggcaacggttactcggctgtcaataatgaacggtctcttcaagactgccacattactcgagtaacgtgtgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggattagtggaagagtgggcgcgagaaacgagggggcaagatagtgggcgcgagaaacgaggagccgggcacagcgttggcaagggtataaagttgccgaggaagagattgcttcctttctttcgccattattccccttgtcttcgccgcttgcgccctaactccttgtttcctgtgccctacctccgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccgggagatagtctcgctgggcgaaggatgcccggcgccacgctacccggggcggtccgtcttcttcctcccttttgctatggcagggctggttccgccattttcttctttcttcgtggatgttctggagttttacgatctccagatggcgcacctcacccccaacgcggtaatgacattggccatcttcgcgcacttgtgcgagatgttcatcggggtgcgcccatcccttcggctgttccggtggttcttcaccgtacagccggtttcgccgccgtcggtggttggtggttgctacttccagccgcgggggccggtgctgaaccgctacattccctgcgtcctccgcaagaagtgggatgactggaagagcgactggttctacacccccctcgccgacgaatcgcgcctccgactcccaagccagcctccagcgcaggcctccaactggcgggcgccggtagatctgggagatggctacgacgccgtcctcgaccgcctggcgggcctgcgatctcaggggctcacaggggccatggtgttcggcgactatcttcgtcgccggatcgcgccactccagcggcgcgcccggggcgcctgggagtacaccgggtccgaggactgtatgaggacccaccagggggtccgatgggactgggctcctgaggacttcaagatagtggtccaacgggtgctgaatctcagctccgtggaggcatccctcgttcctcaaggagtcctccccctctgcagtgatccagaccgtgcctccatcttgaccatcatgcaggcggtcggggcatcggaggagcgggctcctcgaggccacgatggcccggtcgggagccgcaggggggaacgatctaccccgggagggggtcgtgcttctgggcctcgcgacgggggcccggggagcggccaccctgccgacgcccgggggaagaggaagcaggaaggaacccctccctcatctcctccccgagggggcggggcggcgcgtgccagcagcaggcgcccggagggggccacgccgacgtcgcagcccgagggggagcggaagaagaaacggccccgcaagatgagggggacagaaccatcccggggaaaccttatttcccctccaaggtggtcgtttaaccgaccccctcgcaggttcgtcccacgcccatcatggccgtattcattcctttaacgcgagttttcactcatccatcttgttttgtcttctggtctttcttctgtttcagcgagatcccgtcgcgtccctcccgccattccaagtccggccagtctgagtccgaggacccggcgtccacagaggcccggaggcgggaatctgaccggcgagaagccgcagaccgccttcgggaagccgaggaggccgctcgggaggccgccctggctcgccagaccgaggaagccgttcgggaggaggccggactccgccaggccgaagcgacgacatcctctgaggcgacccgtgaaactgaccggcaagaggccgcggatcgccttcgagaagccgaggaagctgttcaggtggccgtccaagctcgcctagctgaagaagccgctcgggaagaggtcagacttcaccaggccgaggcggcgacgacttccgaggcagcttgcgacgaggccgcgggcgcatcgcttgggcccaattcctcgggcgacgcccaggataagctaggtccgggggatatccctgagtccggcacgtccattggcgggccgagccgcgcggcatcctcaccgagacggctcttccccacgccttctgctgctccactgagcgcagaaccccttctgcgggccttggccgtcgcaaacacgacggtgttggacgggttaagtgcccaagtggaggccctgcaagcagagcgggcggagctcgacgccgcatgggtgcgtgtcgaagaggggcgacgctcggtggaggccatggtggaagtgggtcgcaaggcacaccgtcggcacgtctcagagctcgaagcccgtcggaaggtgctggaggagatcgccaaggaggtggaggaggagcggggggctgccctcatcgccaccactgtgatgaacgaggcgcaggactccctccgccttcaatacgggagctgggaggcggagctagagaaaaaactcgatgccgcccagggggtccttgacgctgccgctgcccgagaacggcgggcggcggagaccgaggtggcatcccggcggcgcgacgaagcccttgaggcccgtgccatggcgctggaagagcgtgcctgcgccgtggagagggacctggcggatcgcgaggccgccgttgctattcgggaggtcacactagcggtgcacgaagccgcctgtgccgaagaagagtccgcactccgcctccgcgaggacgcgctcaccgagcgggagcgagctctcgaggaggccgaggccgcggcgcaacggctggcggacagcctgtccctccgcgaggcttcgcaagaggaacaggcgcgccgtaatctggaagatgcccgcgccgagaggaccgcgctgaaccagcgggccgctgagctcgaggcgcgggagaaggagctggacgcgagggcacggatcggcggggcggccgcgggcgaaagcgacttaaccgctcgcctcgcaactgccgaacacaccatcgccgatctgcagggcgcgctagactcgtccgccggggaggtcgaggccctccgcttggcaggcgaggtagggcccggcatgcttcgggatgccgtctcccgtctagaccgcgccggccggcaggtgggcctctggggcgggcagactgcgaagtacgccgccacccaagggggcctcgcccagcgcctctcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccggaaccgaggacggcgcacgcgcgcaagtccgggacgccgccgaccatatcgtccacagcttcgagggttcggcccctcggctcgcgttcgccctcaactccgacggggaggatgatacggcggagtgggcaatagtggcgacgaggccggcgatccgggtgcgtcggagtgagcccccaggcccccgccaatctttaaatagtatcttcttttttttttaaggccttcgggccccctgcttgtatagactaatttaatctgcaatcaaataaagaggaaattttttgtgttaattctatttgttgtgtgtatgagacaaggatgtctgtgccgcggttctcttgtgtcttggcttgaacaagggctcgtgcccaggtcctagtcctcaaatggctcgggtcggggctagtgcctggagagatccacatgtcgagactggccaggccgggagcgtggtgaccgagggttatgggtgacccgattgtgggtttttgccgattctcccccggagttcaccacgccccggggcacggctcggttctgggccccgtttggcgattttagccgacccgagcccccgagggcaggattgaacacgagtgacctatttcaagtcaagattcttcaaaaggaaacaacagcacagatacagcctttaggaaatcgaaaatacttttattgaggtacagatataagagaaataagaatatgcatatgtggcagcccccggccaaccctgcacgcccgaggggggtgcggggttggcccaagcctaaatcctgatacccgatcccccttaggggtagaagcgacgaaggtgttctatgttccacgggttaggcagttctgcgccgtcgctcgtggccagccgaacggagcccggccgggggacaccaatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcctctaggtagtcgaggtcatctctacgaagctgatcttgatcagcttcgcagtacatggtggcccgaggggacctcagggtgagctcggatgggagaaccgcttccgcgccgtagacgaggaagaaaggcgtttccccggttgctcggcttggcgtggttcggctcgcccagagcaccgctggcaactcctcgatccacgaatcgccgtgcttcttgaggatgttgaaggtcttggttttaaggcctctgaggatttccgcattggctcgctccacttggccgttgcttctggggtgggcaggtgaggcgaagcagagcttgatgcccatatcttcgcagtaatcgccgaaaagttcactagtgaattgggtgccgttatccgtaataatacggttaggcactccaaaccgagctgtgatgcccttaatgaatttaagtgcggagtgcttatcgatcttgacaaccggataagcctcgggccacttagtgaacttgtcgatcgcgacatacagatactcaaacccgcccggggcccgcctaaacggtcccaagatatcgagcccccagacagcaaatggccatgaaagcggtatgatctgcagggcctgggccggctgatggatttgcttggcgtggaattgacacgctctgcatcgccggactaggtcgaccgcatcattgagagctgtcggccaatagaaaccttgtcgaaaagctttgccaaccaaggtacgcgaggcggagtgggctccgcattcgccttcatggatatcggcgagaagctcgacgccttgttcccgaggaatgcacttcaggaggattccgttagccgcgcgccgatagagggtcccttctaccagcacatagcgtttggaaatgcgccggacgcgttcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccaacggctaggcaagcctttcttcaaaagcgcccggtggggtctgggctcgcgaggaagcgagtcgtgagagttcgtcggcaaccgtgttatcccgtctgggcacgtgccgaagctctatcccgtcaaaatggtgctccatacgccgtacttggcgcacgtaagcgtccatctgcgggtcagagcaccggtactccttacagacctggttaacgaccagctgggagtcgcctaacaccaggaggcggcagatccccagtccagctgccaccctgagtcccgcaaggagtccttcgtactctgccatattattggtcgcccgaaagtcaaggcgaaccaaatatctgaggacgtctccgctcggcgaggtcaacgtgacccccgcactagcgccctgaagagacagggagccgtcgaactgcatcacccagtgggcggtgtgaggcagctgtgaggggcccgagctggcctcggggactgagacgggctcgggagctggggtccactctgccacaaaatcggcgagggcctggctcttgatagcgtggcgtggttcaaagtgcaaatcgaactcagaaagttcgattgcccatttcaccacccgtctagtaccctctcgattatgcaagatttggccgagggggtaagacgtaaccaccatgacccgatgggcctggaaataatggcgcagtttcctcgaggccctcagaatagcgtaaagcatcttctgggcctgagggtatcgggtcttggcgtcccggagggcctcactaacaaagtagacaggccgctgcacctttcggtggggccgatccccttcgctaggggccacatccctggggcgctcttcgtccaagcggcctcgcgaggcgcgctcgtcttctgtgccgacgacctcggggtcagaggacgacaggggcggccttcccacagtggccccggggccgtcctgggggtcggaggctcctggcgtcgtcggacaagcgggcaaagggccaactccggtcgtcaggggccttaggccaccgttcggctcgggggtctcttctccctgctctctcccgagtcgagcgggcacaggattagcctcggggtcagagggtgataggtgcggccttcccgcagtggccctcaggccatcctggggttcgggggcacctggcaccatctgacaagcgggcagagggccaactccggtcgtcgggggccttgggccgccgttcggctcgggggcctctcctccctgctctctcccgggccaagccagcacagggtggggatgcgcgaatgaggattatcctcatcgcgctccacaaccaacgctgcactaaccacttgcggggtcgccgctaagtaaagtagcaagggttcatctggctccggggcgaccagaaccgggggagagctgagatacgccttcaactgggcgagggcatgttcagcttcctccgtccaggtaaacggtccggagcgtttgaggagcttaaataagggtagcgccttctctcccagccttgatataaaccgacttagggcggccatgcaaccggtgacgcattgcacatccctaagcttgctggggggcgcatgcgctctatagctcgtatcttctcgggattggcctcgatgcctcgggcagagactaaaaacccgagaagcttgcccgcaggtacaccgaacacgcacttatcggggttcagttttatgcgggcggagcggagactctcaaaagtttccgctagatctgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgcgaatctgttggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttacgcccggccgcacggcgagacggtgctcaatcacctccctgggacccccggcatatttcgcggncttcatgcgaagacgtcagcgtttgcccgcaggaaagagacgagcgcgtcttcctatttgccgtccagaagaccaccgatccgtgtggtcttggacgggccgtcgcccagggcaatctccttgaccgggacctcgtcgcatgtgactatccgctgcctcggggcggcgggggcggatgtgccaagcctctcgtcgccaccctcgggcttggacgcgacggcgaggcggtccgcgcgctgctccatacaagcaagcgcgactttgaggtcgccatggacagagatggggccatcggggcccggcatcttcatctggaggtaggcgtagtggaccgccgccatgaactttaccaacgcgggcctccccaagaccgcgttgtagggcagactgaggtccgccacatcaaagttcacctgctccgtgcggaagttggcgggtccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcataagtaggggccgcggccagaagctctcgcttcatggccttaaggctccggcgagaaacgtgagcacactctcccccatcgacagtggcaatggtggccccaggctcttggaaacctaggtcatcatcgccgtcatcgatgtcctcggcgggggccttctgcttggcctcacttcgccgattgctggaaggaaccgccggggacttgccctctcggcgctcctgcctcctctcctcctcccacttcctcgtccgctcagccaaacttttgactgcacggcagtccgcgaggtcgtgaagggaagtgttgtggacgatgcaccacttgtcggttgggcgctccctactaggagcgccggcctccttctttttgtcgcccgcaggcctcccctttcgagtggcccgcgaagcgtcctcgacagcgaggacatgaccctcgtcgtcggtgtgggctgacctcttcttcctcctcctgtcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcgattgtgccgcacaccccccctgaacgcgtaaatcaccgtgtgtgcagggatgcatggtatggtgttgcggacttgacagaaccgctgaatgtacgagtgaagtgactcatcatcccttcgctgtactgcgtgcaagtccgcttcctcacctgggcgcggatatgtgccttgaaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtctgtggtgaggtgacactccggacgaggaggcgccctccgttgcgtggggagcacgtcggccattacgccggcgctcgatactgatgcgggcatccggtcccccacgcagatcttcccgggtcagaggcgttgacgaaggagtggcggccgaatggcgaacagcggctgccgctcgccgcgccctccgtcttgacgacgcggagccggtggtagcagcaccagaggccttggtggcggaggaccgcccaccagcatccaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggagggggcggtggagtacgagctcgacggcgtgggtttagctccccgtcgtcaccgctcatactcggggagaggtcgtgcgcctttgcttgctcggccattgggctgaacaggaaaagcttggcgaacacgaaagagtgcgagagctcagaagatcactcacagagccccctacctggcgcgccagatgacggagcgtggggctcctcaccgggagaccgcgcaggcccccctttgccagttcggccgggggccctgggtgaggttctaagctcccaatctgtggaaggttcgcgagagcggaaacacacaagacacgggcgatgtatacaggttcgggccgctgagaagcgtaataccctactcctgtgttttggtggattcgcgtatgaagaagctacaaagtgccagtcagtccccgattcttctgggattgctttctcctgtcctttctaagtgggcaa

SEQ ID NO: 30899 - DNA, 3615 bp, Oryza sativa
ccccccccccccccccccgtgggtgccaggccacgtgggcgattgtgtctgcctcaagcctctagtcacgatactcccggtcccatgtcatcgacaagaaccatgccattataattttacaaagtttaagatatgtcatcggtatctcaatgacataaagaactcacatgagtcaatgacatgtgggtcaaaatggcatatcttaaattttatataatggcatggttccaattttcactttctctctctttctcatcacttagtagtatatagtatcctaatttaacatgtacttcatcggataagactctgactacttgctgagagggtaatctttgctttgaaacgctttacacctcctagaaaaccactaaataatactcgcgcgctgtaatgcgccggaagctaatcgcatgccataatattgtcaattgtcactaataatagggcaatactatcttcatttgcatcatgccgttaaagtgatcccgtcactgatggatggctgcggtcgctgtactgcagctacccatcgtagactggccggtgacgcacacgcggccatcgccgccgtgtacgtggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatataggatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatggccacaacatataatcagcctaagccataatattggtcaataaaaatgcacacttacgtggcgaaaagcaatgatattgtatccaatcaaatgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacgccctttaaaggatgacgcatataacatgctcccgagtaataaatcttccgggtaatatagaccaagcgtagctcatatgaatagcttctgatctgagtggttatcccttatgggatactctaaaatagatgtaacaattgaatcccgactggcgcaagtattcaattgataacccttacggggaataataaatagtccagtctttgagcatataaaatagacccatgatcatgaattcatgttgcatgtatccggagcaagtccaaattgaagatataatacttgtatttaagctagtaagcccctgagcacgtagtcacaattgttcattgatggtagctgacgcagttggcatagagacaagacaaccaatatagagagaatattgcccaccagaggtggcaaaaatattggtggtagcgaagatagtgataccaatcaaaagtaatgaagtcgcatagccatggaggcgaagaaaccagtcggcggcagacagatcaactaacaatgaagatgaaggagcccagcgataaagttgtgtagccatggcagcaaaataatcagtcggtgacagacgaggtagatcaaaggtgatgacaaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgataataatccatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtagttgtgtagtccccgactctttgattagttgggaaacaactgaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaggctcataaagacgtcgtggttggtgaagtagcaaaacttgcgaagtagcagcaatagagtttgccagtgccgaagataataaagatgaagttgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagctgtataaaccagatgtagaaacgagggtactagtcagcagcagacgagacgaccggcgatgaagatggtaaggccaatcaacactggcagaatcatgcagccatggaagtgaagaaaacagtcggt

SEQ ID NO: 30900 - DNA, 6092 bp, Oryza sativa
gtcggtgaagacgtagacgcccaacaacgggggcataaaggccagccatgcaggcggaaacaccagtcgtcagtggcggatgcgtcggccggttggtgaagacgtagacgcccaacaacggcagcataataggccagccgtgcaggcggaagcaccagtcggcggcggacgaggcggccggtcggtgaagacgtagacgcccaacaacggcggcataataggccagtcgtgcaggcggaagcatcagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggacgaggcggccggtcggtgaagacgtagacgcccaacaacggcggcataaaggccagccgtgcaggcggaaacaccagtcggcggcggtcgaggcgagccggtggtgacgttctgactgatccattcctggagcgtaagagataagcttaaagccatgaatcccttttatgcatatctggatctggatcctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacgtccaacaacggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccaatcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccagtcggcggcgacggaggcaggccggtggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccactcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagatgacgatgcccatcaacggtggtgtgaccaaccgaccgtataggcggggacaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgaagacgatatcgccatcagcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccagcacaaagttccatcgcacttctcgacggaaaactcgacgcagcccctacctggcgcgccaactgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatgatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacacgtggcgagacaccatttccgggcgcccgagcgaggcgtcaacgatggccaactgccggcgagcgcgaggcggcggtcggacgaatctcgtgttcctttcgctccgtggtggcgcgtcctaccgcggtactcgctacctcccaaaatataatgattttaaactataataaggtctctaaaatataaaatattagtttgactaccaatatctgtaaaactagtattgtaaaactagtattttaaggtaaaaaaattacatattataatagtttgtttaatgataaatctaataccatcaattttacatgattgatcttttttaaatttttttactattaataattaaagtttaaattttttgactttttttgcggtggttaaattttttgacttgctactctgctacaaaataattagtatattttaagacggaggtgtacttgatacgtaccacgacaccggggcagttggtcccccaatcacggccgtttgcttacccgataaggaaaaagagttgggaggagacacaactcgcccatgcactgcacagagagcggctggttggtcaccacggtagcgtacacgaacacggtcgatcgggagacgacagacgagacgccatgcatgttcgcggccgctcgccggccggtgttagcggtggccggtgaccgggtgtctgaaatcctatccgatctccttgggaaccggagccccatgcgcgaacatgagcatcacaacgtttgaacatgaccggaacctggctggggtccgtcccttcccttcgcagcccgaaatgcgcaacgtgctgcagatcaggggttgataactccatgcttggttatgtgcaccaccggggaccacggggtagatcacgtgtaaatcggcgcacacactgacggaatatgcccgcactagataaatcggcactggtgtaccaagcgctactgtagtagttgccgcttttcaccgatggataccagggaaatccaacgtgcaatctgccgcgaggtttaccgggcgggggcggcgaggtcggcaaattttgcccgagacgcgggcagtcggcagtgtggccaactccgcgtgaatttcttttgcccactcgggggaggtttgcttccgcgatttcgcctccgatcctgcagttgcttggcttgagcggccacttctccgctccgcttgctgctgtggcctgtggcatgtccgcgctgtatgtgcagcgtcagcgcggctcgcgcaacacgcgtctgttgcgtactatctccccaccttgttggttgatggccacatctcacgccttccagtctcgccggtgtcctggtgtgccctgctgacccaatgaacgcacagtagcatcgttttgctcatcgaagagccgaagatatgtccaggcagctacagattgtctatttgtctactttttcttttgaaagagaattactaaatgtcaattaaaaaaaatctatctttgcctgtgagcattgctagtggccggtgtctactagctagccaagagccaaaaatgggtgatccaatagctgtaggacactgcgccgaccggagcccatctcccacagattccagtcgattcctcttatcgtctcctattatttttttcccacgagaattcagatggtatcgacaatatcctagagtaggctccgtcctcgtgcaccaattattcatgcacgcaataataatttgaatagtgcaactatgattaattggaaggattagcttgttgccctacgcaacgcacaaccccaaacccaactgacggggttaatatctatcaccagcacgactaatgacatgtcaattaaactttgattatccgagtcatcatcgaatggctttcttatctcgcaactcgcacattgctttttcagtgacccaaagggagctctcacaaagtcccaaaaggaaagcatttgactctgagttagtgcgagccacgttttgccatttttctgattgcaagatgctttcccttcctgactgacccaggagagcttcaccgattgctaagcaacaaccctgtagcttcgtcttatggattttctttttctgtaatcacatgggggtatggacttgtagctggtgaagtagataagctgcttaccagataagatacttcacgagaaaacagtattatattaaaacagatactttcacgagaacatgaaggcaattgtgactgactggctatatatactccaggatgaacccattatactatccctccatctcaaacaatagagcgtatttttgttttgttaggacagggaatactctattatgatataattctcacaaaattaatatgctttgcacgactgatcattgttttacatggcattgatc

SEQ ID NO: 30901 - DNA, 1423 bp, Oryza sativa
ttatgatatagttctgacaaaattaatatgctttgcacgactgatcattgttttacatggcattgatccacaggtaaagtatgtatgaagaaaagaagctatgtatcaacagctcattcatgtttctgtgcccactgagatcaccacctcaccgtcagtcccatgatcccatcctgaaacttggacaggcttaacaacagtcagtcagcagaaggcagtgacgtgaagccgtcaactgggcaagagaaaaatcaccatctagatcatggcgtccaagcaaggtagaccgcagacatctctcttcaaaactgatgccccgcacattcctggcggctacacactgaggagaacatcaccctcgtcgaccatgttcatatgcaaagagctcctagatctggtgcaactttagaatcgtgatcccggatggctggtgtttcatcttgttctttcttcttttgcttcttccccttctggcctttcccttggccacctttggtcctgatagtaaagcacattaagcagatagtattagtacataacacttccagcattgtgttaaacatgcaatgcaactaacctccctagtgaaaaaggaaatagtaatcaggtcggtgactttaaggcatatgggataagtgcatattttgcagcaatactgttaaggtttcataggccagatacaacagcagcaatgcactatgcaaatacgctggaaatattgatttcaccccccaaaaattccatttgaaagaatgcttacaatgcgaacagcaggacataagttcagttgtagaatagaatatggtaaaagacaaacaaaaggacagaaacattataaaggggattagctatatttaagacaccacattttccaccaaaaaacaaaaaaaaattaaaaccaaatctcaatacttacaccatattttttgcagcacacactatataagagaattaggatgaaaacaattaattacctacttgaaagaggagatagtagagcgaaacatacttacataggagtataaaagaatggtagcaatctgaatgggaaagaaatgcctgagatctagtcaaagatgtggcgccatatttttagcggaaccattatagagccatactttggaggttctctcgatggtgcagttgtttttggaggttctctcgatgctacagttgtggctaaattacaagaaggcttgtgcttcctagcagatccacaagagcattccttggtttttgactttccctgtgcaaaagaataaagggataattcctatttattccttccaacatagtattttaacaaggcaattcaatgtttggaaactattaagagtcgtccacatgatagttacctttttagaatgtgaactgttgtgtttctgagctgtttcgcctttgctagaacagtccttttcttctt

SEQ ID NO: 30902 - DNA, 37676 bp, Oryza sativa
  unsure (1)..(37676): unsure at all n locations
ctcaagaaaatgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggtcagtctcaccctgaattgttagtgtgagaaattcactttagattctgttcatacaagcttacttactgttcattccaaaaattcaggctccacggcgtttgtaatgagaactccttggcaccattgattggctatcttgggctgaaattatatcgcactagtggcgacaactctgttctgtatgatcatgatttagaaaggtaatcttttagctcttgatcttacgcttttctttaccgatccgcacaatccttgttgattcttacatcaactctgtcaattgattctgttacagttatgcactctttgataaggctggccatcaggtctcaaaggagacagttgctaaagttgaagaaacatttgaaagaattcttgatgaggtacataatgaactcatttatacttggtacttctggtgccgtttgaagagcatgttcagttcactatctaatttctgttgcattaatgttccaaaaaaaattttctgttgcattgcagacagttaaagtgcgtgatgagcaggaacatgacatgccccttctacaggcgatttcacttgttcttgagaggcacccccatctgaagtatgcacattcttgtaccatgctatcaatttactcacaacatacttaataaattcgtaggatgcatcatgagaggttgactgatatggttaccattatttgtaggttacaagggatagatgatcaagtcttgcaatggtgtgtctgtcggcttgaggcatggtttgctgcagatgctgatgaaatatctctgaaaaactgggatcaggttagctgaaatcagtctatattagcacactgcacattcttatagtgacattagtttgcttagtgaaggatattggtaaattacatcgaattgtttgccatcttgcatagttagttacttatgtttgtattcctcttaactatgcaggagcatgttcttaccggtggccatggtctgatggtgaacggatactatcctataattcaggctcttgcacaaggtctagatatccggcttaatcaaaggtgtgttcttttacctcccgagcatacaaacacaacaattaatttcagcatactgaagtccctttttcagtgtattttggctccacaaaattacttgtcgtttcacttgtcaatattgctaaacagttttgcttactcgcttttgctactgctaaatcttcagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctgtgagtttgccatctcagatcatggccacagttagttccattttcgagttcgcattatctgaatgaattcgttgttcttgcgactgacaatttgcacttgttgatttgtgttattgcagacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatgtatttactccatcgtcacttaaagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctgtccattcgttcgcttctcccatggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgagacgccctcgcctcccggggccccttctccgagcaggtgaaacgccgcctccgtttctctcttcctctctcttggccttcgcccttcgaggtctcacaatgatggtgatggggatggatgataatgaacaagagagcatgcgtttttcagattccaatttcttgctgtcaattgcttttgttaagttgatggatcccctgcatcgagtacggaaaaggctttaagtactaaattgttcttactaaagtcttattatgctataagtaaatctagatttcctctaacccccatctagttaaatcaagcggttaagatcattgtttgtaagagttatgtaagatttttttgtagtacgtgtggttataacaacgaacaggaaaagaatgatccttagggtgcctaaagagatggcttgatgtgagaatagtaatgtattacttctatgtttttcattgttctgtgtctgatccgatttcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggtgagctagttatttgacctgactgtaagtatgcaaaacacatacttgcaacttctcagtatacaattatgatttgccttcaaatttgcattttcatatttaagaggtgaaatcatatacatagcatgcaatttgatacacataatgtgtaacttgattgctgaggtagtattaatctttggcagttcaacattaagacgctgtgcctttataatcagcttgatctggttactagcagcattttggcgactagacaaatcaatttgttaacctttgcataagttggtagctatgcattagtttacttaggtgtgccataattccataaacggatcagttaagatgctatttttgtgcctatattgcatatatcgttgaggccaacaatcatcaactacttgttaaatcttatccactggaactattttgtgctttggtaggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttggtatgttctagcttgtgttatttttatttattgaattcctcacttgtaatttgctagtaaaagactaaggctttgtttgtttgggcattcggcagttgcaaattccttgttttccgttagcatgcttcccaaactgataaacaatgtgtttcttttttaaaaaaaaactttttatatagaaatttctttaaaaaacaaataaactcattttttaattttatttatactcaatttatcatgcactaatggcttgtcttattttatgtgcaaatgaaaagctgaataagggaaagtttacatttagtttactttggcatcgtgccgtcctctctaagctgtcatttttgcagtgtgagccagtggaggacttctacagagcacgtggtaaactattggagttcaatctaccaggaggaattccagaatcatggccgaagttactgcaagcattgaatttagaccctggcaatgaaagatctgcagcagcatgatttttgctttaggaatgttcgttatgtatttgtagccctacgccagaagtagttaagtaatgagtattccttgtacctctagaagtagttcaatcgggttaccaaaattatattgatatagcactcaattgtataggtgattcatcatcgatcttgcatgatgccatgatcgatgagtgtgctggttgttattcttaaatgagaaagcttccaataaaccaatacacatttatttgtagccaactatgcttgttgaaagcaacacaaggcaagccttgtgatgacagtaatattttccttgcaactatgcctgtttgaaagcaatacagagcaaccattgtaatgaaattctggtgctattgacacattgagagtgtttgcacatggttctgaaatttcccttgccccaggttgggtcttatctgaatatgcaagtagcctgctgaatactacctccgtcccataataagtcccataataagtgtagccatgagtttctgtgcccaactttaatcgttcgttttatttgaaatttttttataattagtatttttgttgttatgagatgataaaacatgaatagtgctttactcgtgacttatgtttttaatttttttaaaaaaaaatttcaaataagacgaacggtcaaagttggacgcggaaagccatggctgcacttattttgggacggaggaagtacagcagaggtcacagactcagttcaagtagcaaatctgtcttttcgaatgcaatctcctcacggtaagaaatgtgtctacccttttagcaggaaccaaatagtatctggattagaagaaggtatcacggttaaaggcgttaggaattgttatactacagcattggtagcaactcaccgtcacaacgggggtgtagctcatatggtagagcgctcgcttcgcatgcgagaggcacggtgttcgattccccgcacctccaatcttttgatctttttttgatttccattttatcataacttaaaacctgttttttgtttttcattccaccacagcttcatcactcagaacttccatttcatcaaaactaaaaatctgttttttgttcttttttttcattccaccacagtttcatcacttagaactttattttcttgtgatgaaatgaaatgaaaaacaaagaacttcgtatttaggtagtacaaaattggaataggccgtagaaggtgcctatgattctgggctctggctgtccgctgatccgctggccgtagaagtcaagcccatctcacagtctgcagatcgcttctttttacaacccaacgggccattttcagaggcgtcacccgtaaatccttgggccaatgtgacccaatcaatttcgtgaaaagtactccgtagcaaacaacgcgcgcgcgttccctgcaaaaaacgccggaaaacgcattgccgagcgagccgtttcagcaaataagggatcgttagactttatcagtgactgtatgaaacttttatatatgtgtgtgttcttacgacttaaaagataatgctgaaaaatttatttcaaaatttaaattttggttttgacttattatatatttttggggcaaccgatggggctatgaggctatgagctatccatccatccatagcgcaacgtgtgacagcgtgaggtgacaagatggaaaaccgtgagccgcgccaccggtgtaaaccccctcccttcacgcgcgtttactttgcaagcaaaggacaaggaaaaaagccgtaattggcgaagaatgttcttggatttgattagcagcggtacggtaacacctctagcttgcatttgcatggtagggtgatttggctaggagagcaggatcatccgtgcattcaattttcctcatttctttttgcaggctcaatagaggagaggaggggcctagctagcaccaagataatgcagcaaaaaggagagaagagaacatgtcatccagtccaaagtgcaaacgtctctatacaaatggaacatatggagtggacctaagcctagttgcttctgtgtcccaagctcccaagtgtcaaagccttaatgtgcaaaaccacatctgtggggactcctgaaagcaaactaaatgattgcaaaagagttcgtttattcacctatttatttatttattttattttctttccatgtgtctgttgtttgatactttgattgatcatgtgctaaactgcagaaaaaaccaacaggcccagagtaccggcgaaaaggctcctcgatgaaaagtgcagggattctgggggagttgccagtgcgcccccgttggatttttgcacacatataaacaggggactctgctgcacctctcacacagtaacatatatagggacggttccaccaagcacgtttgggaaatggttttttgagcaacatctcatgcgaacaatttaggcactatttacttgtaccttcaccttgtacgtgtgctccatcccatagctgcattatttgcatcaatcattttaattgcatatatacatactccctctcgtatttattttttttaataaatgacatctttcactttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaaaaaaaaagacccgaacagagttttgatgagcagtgtcaggtctgtcacatgagaagagagcgaagtagctaagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacggacgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgccgccgccgccgtcgccggcgtcggggtcggcgccgcgggactaccgcaaggggaactggacgctgcacgagacgctcatcctcatcaccgccaatcgtctggacgacgaccgccgcgccggcgttgggggcgcggcggctggtggcggcggcgccgggtcgccgccgacgccgaggtcggcggagcagcggtggaagtgggtggagaactactgctggaagaacggctgcctccgcagccagaaccagtgcaatgacaagtgggacaacctcctccgcgactacaagaaggtccgcgactacgagtcccgcgtcgccgccgccgccgccaccggcggcgcggccgccgccaactccgcccccctcccgtcgtactggacgatggagcggcacgagcgcaaggactgcaacctccccaccaacctggcgccggaggtctacgacgcgctctccgaggtgctctcccgccgcgcggcgcgacgcggcggcgccacgatcgcgcccaccccgccgccaccaccgctcgcgctgccgctgccgccgccgccgccgccctcgccgccgaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgtgatttgcagatggtaatctgagcaaatgacaattaattgtagggacgtgtgtctctctgcattgccgggtaagccaagtacgctgctcccatttcaagtccggattaatgcaacgcacgcatgcacgcacgcacgcacgcggccaagtgatcaagaccgcgattaccccacagtcccacacgtatctacgctcgccgacacacgcgctaaaccctcactcacctcacctgcttttgctcgcgtgcatgcatgtgtctcgtctcacagcattgaactcctggtcactgcaaacttaactgtggtttaagaaaaaaaaaagtgataagttccatcccttgagggatacaaccttactgtttactatatgttatctaaatagttattaaaaaattaaaaaataataatatagattaatacaaaatatatcacatgcaaaaccaaatttaatttctataagctgcaataaaaagaacaaactaaactgaaaatagttaccgtacattcacgtctacattggttatttttttttacaatttataggagttgaattttaatttgcatatttgtaaagtgatacatttcatattaatctatcttgctaaattttttaattttttttaactatttatatgatatgcacaaaatggaaggatacttcctcgagcggataagttgttctccacatgcataggtcggcggccggatcgaacagccgagctgagcagcagcgaacacacaaccacctctctagtatagctagccctgcatgcacgacacatatattactactagctcgttagtttagagacgatatcgtagacagattaatcatgtggtagtacgtagtacgtgctgattctccaggttaacaaccagctagctctcgtagatgctttgcttacgttacagacagtagtacgtagctcctcgatccctagctagcctgcatgattcctcacgatttgtttcttcttgtgaaaagaatttaattacttatacgaagtacgtagcttgtgttccaccgagaaattaacgcgagaaggaactagtaggggagagattctcttctctggtcgattccactagctactctgctgtgctgcctgtgtggtgggtagcgtagctttgccaaaagctcgcgatcgatggatcatcgcatgggacgcgcgcggtcaaaaaaggctcaaaacgcacacacgattctgcgattctgcgcgggcggcgtggtggtgaggagaaggccgtcgcgcgaggtaggcggccggcgaatcgcggggttggtgcgacggctgcgctttgctgggggatcaaccggcaccgccctgtgctgtactacctgggctattatgctaatctattctagcgagagagggaaggtagagactagagagagagagagagtgggtgtgggtggaccgctgtcttgtcgctttgctcccatcatctcacctcacctcacctcaccgtccccaaaggcagcgcagataggggcatttcggtcttttcattttgggcataaaaacaacctctaattttccattgtcttgcctggttattcaacggcgagaaaccaagttagggagaactgtaaaagaaagtctcagttataaaaagagttaacttctgataataaatctgaccaatatttatcttaattagattcattgttaaaaattagttttttgggacgtaaggtgtacttgtactccttggagatagatttgttttctttctcacatgatgttccctgtttcatgtatgttgtgtaaaaagttaaatttttcaaagaattgaataatacagatcaaaagatagcacatgatatgccactacacaaacatataaattaaaattcaacctataaatttagaaaaagaacccataaactatttattatatattcgtagtcaaatttattaatatttttgcttagcttgtattagttgaatctaatcttataaatatgtttgtgaagtggtatattatatgttgatttatcttattaattttttaactttttaagatgatatattacgacaacacaagttatggtaatctacatcgttcatcaacgctaagcaagcaaacagatcaggttaagatatcaggggtaaagtaaggtgctctcaataaaacatatacatctcagcaatagactagattaataataaaccatctcaatagtatgtctatatgggtatttatacctctttaatccattgcctcgtttttctctatagactatctccaggttagtagatagttttgctttctctcttcatttaatcttttccatataggaaaatatgctgacatggatcttttatatatagtctataagagcacccgcaatgttaaagtaaggtactatttataaaacatatacatctcagcaatagattagattaatagtataccacctcaatagtatatctacacatgagtatctatagctttctaatctattgcctcgtttttctctatagactatctctaggttagtagatagctttgctctctctctcttcatttaatctctttcaagtaagaaaatatgctgatatggatctcttatagagagcctatagataaccattgtgggtgccctaaataactattacggttgacctcatatactgagatggcggcacagcgtataggatagtactcgtacgtttggtggcgatcaggctttaattgattttggtggcgatggcgatgattttggtgtgggagagtgagaggagaggagagtggacaggacactggacactggacacaggcggtggtggtgaggttggcttggagtgctagtactacacgtactactactactactgggagtatatggattcctctccccgctttgtggtgtcagaaaaggccctgacaatctcccctagctgtcatccccgctcagagccgtagtcaaacccccttgaccggacagagtagataccatgccactcaactcactcatatccccgaaatgcccctcccttccaatcacaaaggtatacgtaaccctagttaaggacctgtttcgagaagtttaaaattatgagaaacagaaattaaatggtactctcctcgtttcacaatgtaaattaatttactatttctcacattcatatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagaatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatctaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaacacgtaccagcactagttgcaaaactgaactttcttcgagaaaaaaaatgtattggattattttcagttgaacacagtatgctctaattaagctagtactgaatttggctaactcaagtacgtatagcagtttttcaagctactaaacaaccccttaatgagccaattgtgagtcagctttaattgattttttttaaaaaagctagtacttcctgaaaaagaatatgaggtgcagctacaaacaacacactgtgaatgcatggttcgacggccagatcgacgagaaacgccgtacctatatagttaagacaacaataagctcatggatggacgtcagaggacgtggtgccattggaggagcgtaggccgggcccctacttacaacaatctgcctatacattcaggacataaattgagcttgtggccatttatttcaggcttttgggttggagccttgcacaaatagttgcattattatattggaggaaaagaaataaaacgaaagcatgaactgctggttatatccgagaaattagtacacacacagtgggttactgatgatcaggtgatttgtaaactagttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttcaggtataataatattatatgcattaaaagagaactggagtaaacctactcaagagttctataaacatactaggaaccactacaaaaggaatatgggcatttccacaccaaagaaaccagattcgtcatttggctccaagcaccaggagggaaaaagaaaaataagagaagcaattatgaaccctcacagaaaatcactcgataatcttgacttggagccaataaagaaataacatgagttgataaaataggcttttagtcccacaaaaggttgatcatcgagttggccaacccggcttctttgaaagttttatcactctcgtactccaggtttgtggatgccctaggaatgggctgtacgaaatggaaagccttcttatccccgtcctccacttgaggatagcagaatgaccacaggagctgcggcgagatggataaagcatcagcgaacaatgtaggagaagagacaaaactatggaaatttatttcagtgttctaaccttaataggatccgtgtgaaggaaattcctctggatcctcctaccatcaggtaggcgaattgcaactctgcacaaaagctcccgacttcctttgggttcttcagggagaggaggatagttcagcttagcactcaggctaggctcattttctacctcaggttcaatcttttcctcactagtgtcagagcctttactctcctcaagagaagccgctactgcccgtgctagttcttcgtcttcatcctctgtggctactacgggtacaggggttttacctacaaagaaatggaactgtgaacatgtgcttttggtcaaccttgaaatgcattgcacgtaaccagatcctaacataataataaaaaaaaacacacacacacacacacaatcaatgctgcgaaattaatccatcaaaatatccccttaagtagtggcatccatatgaccataccggtaatattgaaaattacaaattttctttgtgcatgtcatgccatgcatggagagcttacgctaacttttgttatgcctacccctcttgcaaataaatctgggtagttgcttatcacaagtcaaatttgaaataaccttaacttacaatcgacacacaaagaccatcgttgtcagagggtggcaaaaccagttgtgacttttgcctaaagataactgtgattagacatgatttaaattctaattcctaactacacaacaaataaattgttgttgacatatagactactgaaatattttttttccttgcgtctggtctatgttatgcattatcattgttcaagatgagtgttaatggaaagtgatatgtcagcgatgattcatatccaagtttgaaacatggctaagacaagtactgccagaaaccatacatttccaatgattttcctattataaaaaatgtccattgagtctcgtgtccatactatccaattattgtgttatctgggccattaagaatccttaatatctagaagtacctgccaaaaacaagttgaaataaaccactaaaacttattgccagctatcaccaacaggataaaatctggtgacagatgatgtatgaggatagaatgactcgtaaggccaatcctccgactcccataaaggtcagtgattatgccaggcacatccaccagataatcatcgttatatcataattcataacaagagtaaatttcacaaaactacaggtattttgaccaaattatcacaactacagatttaaggagttgtatcacaaaactacatatttagcaccaaatttatcacaaaactacagattttagattaagtatcataaaaatgcatatttaatattgaacttatcacaaaactacaacttttggagtttaaatccctagcaccattgttatggtggagctataaacatcattactttgtgatttaattgattctaaacctatagttttgtgataatttagttactaaatatgtagttttgtgacacttcatcttaaatgtgtagttttgtgataaatttggtgttaaatatgtagttttgtgatacaccgagttaaatctgtagtttggtgataatttggtcatagtatctgtagttttgtgaaatttactctcataacaattacaagcaacctcccaatgaccaactgctcctggaaatcacgcttatgtagtgtaagaacgacctaactgtagttggatgatacaaatgaacaccgctcccccttatccaattttgtaaagcatcaaatgctagtacagctagcctacccccaacttgattgggaacaaaggctgatgctgttatactaagtactagaaaacaaaacacaatgcacctagaggcaccctcacatgacaatcatccctgctactttttcaagaattggacatccactcacaaggtttgaaagttttgattgtatggaagccccatatctttaacagatgaagtttcgattgtcacgaacttagcattaactatgcatctattccacaaaaaagttatttcaccgtgttaaaagataaatccatataatgtgaagaaagattgcaacgaaaaaagataggctcaacatatggttatttatgtactaatgtgcttggttcatataatagttctgcagaaacaaactattcgagcttaaatgtttcaaagggaaaaaaaaacatcactgctagttaacatatctttggacacaagccataccttgtttgccgatagaagtttcctgatcaacttttcttggccgtttttgaggttgagctgcatggtgctcctttggacctttgtccaggtaaggcatcaaatcctgtggacagttcacatgcagacagtaacaaggaataccatgtcaaatcacagttaagattccagtattagaatgtggaagtaagaatgttatcactacagaagttagtaacatgagagatgaaagatagtaggtcgatagggttaccaaattacctccagcaaacggtccgggtgaatcattccattccacccacgcattttttgcccagtgatagggtcaatcagaagaatggcaggaacagagaccaaattgtagtaggtgcataccttcctcccctcactggtgtcatggtaaacctatatttaagatgatagaacatatcagtagacaactagagatgctaaaaatttgatccatcttggggtttgggaaaaaaagtgaacattagaaactctttctttccaatactattcctaatacatcaggaataaaaattggagatacagttatgtggctcaggtatagaaggcgaaacaaaggagtaaggaccaacctgccagaaaataaagttcgatcgaattgtctgagccacagcctcattagcccaagtgtcccgattaagcttcatgaaagaaacactcaagagtaaaaactttgccaatgcaggaaaaagaatgaagggttaacacaaggctgcatgacattaatggtaagatctgtaccatgtgagagctgaactcttcagtcgattgcaaattgatcaagagccacttgtccagaacagaagcctctaactttgcctacatttatgaaattcattgtttttagaaatctgaattaaattggtaggttatagaaaattaaaggataatcaaattagtattatgaagttcatcagctccaggctttcacatgaaaattagtagcagtttactagttctcgtgcactggtcattagacaacaaatgaatttgcaacaactaataaaaacatcaatgtactttcaatgataaatagtgtgaacaaagaacattaagaagcatgtttgaccatgcctcttgttgacaaaagggaggcaatgtttgcttgagtaataaactgaaccttagcagctaataaaccgaactaattatttgacaggtaggattgttagcagctgagataaatgaagagttcgtgggttacatggcgtgctgctccatgataacaattcagtatgtcactaatagaatattgcaattttcccaatgcataccaaatgcccacagacaaagcaggttattgaagtttgcaggcaaaggcagcacatggtcatgttagagataaaaaggtaacaccagacgttaaataagaaaaaaaggatagctgaccttgtcgaagggtccattgaacatcaaagcaaatggtggacgatacaatgccgccagattatcacgagaactagatgcagcattctgctcagaatcccaaacagcagattgccttgactcctcttcaaagttacgaaatgcaactgttgaattaggccgaacgctgaaaagaagtcataaaaccgtttcaaatttagaaaatgatagattttaaattagtagtccacgttccaggaaaatcatgcaaaaagtttggttctattagtgctatacttctctttggttactgtggctcaacttgagtttcatctctagcctattctaattttctttagagtaaaaggctgttgttttagaattttggttttagcaaagcaagacatagaagcctaacaaagcatgtcggcccaaaagaaaagagtacaacaaaatttgggccttattcatctccaaaagaaagagtagaacaaaaattgcatcacttcccacactttaggtcattaggtgtggctcagcgctattccttccagatttaacaaaagtggactataacaaagaaccatagtaataatgtcatatgtattcaagagatgttgcatctaccaaagaaatggctaaacatcagcaaaatcaaccccaattataataaatacttggcacagcgcatttaagtatatatatctaagtatacccccttaatttgcagtgccattggggcagtcccagatatgccatcggtatcatagagaataagggataaaataagagctgtgactgatatgttaatggtcattgtgttgtcctaatgggtagaaggataacaccccgaataaaaacattcctaactttatctttttcaggaggcaacaatctctcctgttttgaaaataattggcagcaaatgaaatgactagatgtttcttctgatcagtaaattctggttgagttcgagctagtgattgtcatcatatctgttggtgacaagtaaagatatctaacttgtagccatgaacgaaatttgttggtgaccaaccaaataccaataatctcattggttgcaaactatatgaaagagatgttagtccacttggcaggggaagagagggcaggaggcttgactgcaaattagtggtactagaaaatggtgctagctattaacatagccaaaggtgcaatttaggccaaaaggtttatatcccatcagcaagccaacaatgattaccaacaacacatgctaattccattggacgagaacaaaattactataggttagtgacatctattcatcaccaaccaaacacacacatgccttttatgaggacttaagcttcgatttgaagccatcaaaaacttaaagctcccctaaacagcatggccttaacattgtcggataagagtttttttagacaatcacatgccccatgtaacctatcccaatttctctttgaaccaaaccaatgattctaggcattactagtaccgattttgtgccaccgatacaccctatttggctatttacatgtatcagtacatcacataaaccacaatcaccacaggggcagcacagatattgcattgaactagaagttgtctcacacaaagtcttaacacttatactgaggaactcaatcccaggaacccaactatcataaagagtttgctaaccaagcactagacttacacgaccatgggggcatcgccgtagagagtctcccgctttgtgggcagcggtgcccgcacatcctcttcctccccaagtccctgcagcattccatcacccagtgcagcagctgggggcggagcgaacctgcccatcacagcacacggtaagcgtacacaaaccaacagaaaactcaaggacccaaaaaccaaagcccaaacccgagaaatctcgcgccgatccacctatgacctacctcatcgcgtcctccacctcagcagctgctgccaccgccgccgccgccgcttccgccgcagcagccggcgatggggccggatgcgccgcaagggcggcctcgccgtcgatgtagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagaggggaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcgaggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttttttttttttttttttaaaggggagaaaaaaaaatttgaaagaacccaccaaaaaaaaaaggggggggggttgtttaaaaaaaaaaaaaaaagggggaacttaaaaacccatacaananaatttgcaatctccggtgttgagcacgcgtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagcaagcagagcgagatctggaaggcggccatggcgcgcctcgcgctcctcgccgtccccgtcgcgctcctcctctccctctccttcctcctcctgcgccccgcctccccgccgctccccttctcgcggcagcaagcggcgtccggccccgaccgccgccgcctcctcagggtctacgttgcggagctcccccgcgcgctcaaccacggcctcctcgacctctactggtcgctccccgccgccgactcccgcatcccggcctcctccgaccccgaccacccgccgccgcggcctccgcgcgcgcactcgccgtacccggatagcccactgattaagcagtacagcgccgagtactggctcctcgcctccctccagccgggctcgtcgtccgcgcccgccgtcagggtggtcgcggactggagggacgcggatgtggtgttcgtccccttcttcgcgacgctgtccgcggagatggagctcgggtggggcgccaagggcgcgttccgcaggaaggaggggaacgaggactaccgccgccagcgggaggtcgtcgaccgcgtcaccgcccacccagcgtggcggcgctccggtggccgtgaccacgtcttcgtcttgacaggtactgtgattcagttggaaattggaaatgtgctttttattttttcctgagtgaacttaagtgatcaaaatggcataatggaacgggctgttgatcatattaaccctccattgctcccaattggtgtgggttatatgttaagcattcgataggttaagttatgcttgttgtccgtctattatatactcaatcccaactctcaactagtatatgattggaaactagttttttctcctccatactcaatcccactttctgactgatatctacagggtttagctactcaactctaaaaactgtgagctgatttaggcttgaaatcattttgtgtgttctgttagttaccggctatacatgtgatttgttgctcggcgcctcagtgtaagacttaccaagttcccttttccaaacagagggagtgtgcccagaacagtgagcacattgacatgtagatttaaccatgataggaacctcacaatgcactcataaatttgaaattagttatgtgcatacttggaataggggggtcaaggtagctggttttggtttcttaggcacgctttacatgttttcttgtgtaagggagtggcatacccttgaaatgccatcattaaagaaaaacaattttgaaccatgtgactttctgtacatttgtcatcaaggggatattggtaatcctcagtgtttcggagcaaaagacacaactgttttgcaagcaatgtaggaatacaagatatactgtttatgttttcgttgtaattgatctgcatagtagcttattattcttttgtatgctcaggttttgttaaatattgaggcattctttgacagaccctgtggcgatgtggcatgtccgtaaagagattgctcctgcaattcttttggtggttgattttggcggatggtacaaacttgattcaaactctgcaagcagcaatgtttctcatatgatacagcatacgcaagtgtcattgctcaaagatgtcattgtaccttacactcatttgctccctacaatgcacttatcagagaataaggaccgccccactcttctgtacttcaagggagccaaacacaggcatcgggttcgtaccatttatcatactaataagcatttaatgtatgcatggcaatatttatcttctttgtagtatctgaatctaagcaattggaaatgaaaatggaataaaagaacatgttagtatgatatgggctatcttaaaattttattttagaacctgttgagtctgaatccacagctctttgatattatttagagtaaagtccatcaccggtccctaaacttgtatcgttgtgtcatcccggtccctaaactcgcaaatcgaccgttcaggttctcaaacttgttcgactgtgtcatcccggtccctaaacttgtagatcactcgtataggtcctccaacttgttcagttgtgtcacctcagtccctaaacttggatttgaatatcatctgggtcaaataggacggtttaaagactttatatttaaaaataattcataactttttcatgtgaactctaatgaagacaaactttatatcaaacttgtagccctcgacgcgatctacaactttgtagttgatatttttttttattttaagtcattttttgtcccagaatgtaattttaattttaaaattacaaaatctataaacatgcaacaatattttgggaccctaaacagttttaattcaaaaaattttcaactacaaagttgtaggtcgcgtcgagcgctacaattttgatataaagtttgtctttattagagttcacatgaaaaagttatgaattattttttgatataaagtttttagaccgtcctgtttagagaccggcgtgacacaactgaacaagttggaggacctaaacgagtgatctgcaagtttagggaccgggatgatacagtcgaacaagtttaaggacctgaacggtcgatttgcgagtttagggaccgggatgacacagcggtacaagtttagggactggtgatggactttactctattatttatgtatctacaaggaaactattgccatttgaagcattatgctctcaacagaacttttatttacaaaccagctttgtttatgacttatgagattgttgttctgtactactgtgcatctctatacagctttatcttactataacttctgaaattttctttcagggtggtttggtacgggagaaactatgggacttgatggttaatgagcctgatgttgtcatggaagaaggttatcctaatgccacaggacgtgaacaatcaataaaagggatgcggacatcagagttttgcttgcacccagctggtgacaccccaacttcatgtcgtctctttgatgctgttgctagtctgtgcatacctgtcattgtcagcgatgagattgagctgccctttgaagggatgatagattacacagaattcgccatttttgtctcagtcaataattctatgagaccaaaatggctcacaaactacttaagaaatgtccccaggcagcagaaagatgaattccgaagaaacatggctcacgtccagcctatatttgagtatgatagtatttacccaggtaggatggcctctgctgcacaagatggtgctgtgaaccacatctggaaaaagattcaccagaagttgccgatgattcaagaagcggttacccgagagaagcgaaaacctgatggaacatcgatccctcttcggtgccattgtacatgactcgcgagacatgattgttagtattagcaatcaatcccccatgggaggagttagttagcattccctgccaatttatggattgtttgtagtgcaaatatgagagaaatttcaacagtaggtttatgctcttgttgtcaattgtatttcgtctggagtgattccccgcattgctccatgtgtgaggtttgttggttcactgccatgagaattcatatatgaatctgcccattcggcagacaattttccatattactcagagagaagcttgagacagtacgtagtcccttatatttgttgcttctaaatgatttggctagcgttcacccaaaatgcatgcatgatcatgagcaaaataccttttgattcaacagaaagagatccaatctatgatgtttggcagtaccaaattcaggacatgaaaagcaaaagggagaaattttatagtctcaacaacatgaactgtagccaaataacagataggctgccaacatggtggccaaaggaacggagatattgtcatccacaacatcattgacaggaatacactccactacagtagctgctaatgcaacaagagccagtttaccaagtgccagatcccagcagacagtgaagtaaccaaggcaagagaagtagaacagcatcctgtgatgcaaaagatccatgagttaacaataacaaggagtaacaatgcaaaagaaccagcaatgcattctgaagcaaaaacctacagtgcagatagaaggaagccagaaatgaacattgagatgcttcctatccagctcttgttctcattgaatggcagcttcgcggagccataccttctcccaacaatgtcagcaaagcctgaaaaaataagaaccaagaaggtggatatacttagcagaagcattcatttcatcaagtgaactggggtattacaaaaaaaaactgcagattttcctaaattcccaggagatccaacatcttaccatcaccaccactcatcatcgacaacgaaacaatcccaataggagactggcgccagaagaccaaaacactgaccagcagcacaatgacatagtacagaggacctctcagcaattccctgtaagcaaccaaagatcatgtcaaggaatactattttgatttttgaatgaaggagtatcagaaataaggatcatagcacgaactctggttttccttcacgggtcaccgattttactagagcttcatcagtggaaaggcggagcccgtaggtcagaagccttatgcagttcagcaacgggacaattgccgcgaagaaccgtgcttctgtcgaattactgcgaaaggggcatgattttcttaagatctctagtctgatttggttgtagaaaacatttcgatgctggaagaagcagtggcaagggagacctgaatagtggccaggaagacatgaacaggactccggagagcacatgcacaatttttctgctcaggttctgagattaattatgaaaagaatcagaagttaacaagatataattaagaaaggtataaattttatgcttgaataatctattttcctttgattgatcaataaagaaagacttctcttttatctatcctaactactgtattttttgaacagtagcagtccatctgaaccagtcagatcttcccagcaattgaaaataaattcaagatacagatcacatccactgaattgtatataccatattttactctccggataacagtcaacagagctaaagaattgatattttttgaagaatggcggagatcaaagcttcagctccacctcaaaaaaaaaagaaatacaaaaaaaaaggaaaaacgagatccgacacctgttcgatgagccgccgcgccgtgagcccgtcgaaggcgcgcaccagggagtacgcgcccgcggtgatgagcagcgtggcggcgcagtcccgcagcgccgcgggcgtcgccgaggccgcgagcgccgccacggccggggcggcggcggcgcccacgccgagcacaagcgttcgccgcatggagctcgctgccgccgctgcaggagacgcgagcttggacttggagcgcgacagcagcaaggaggagaaggcggcgaccgaggaggagcacgggaagtggcggacgacgtcgacgggccgcgccgccgcggccattcggtagacggactgcagtgaagcgaaatcgctggtaggccaccgcgaatttttgtcggggcgcgcgcgggtttctcgttgagacggggcacttttgtagttttgtggaagcgattcgtcccacctatccacggtactgtgtactactgtatctttttccgaaaataggagggctcgtccaaccctcctagagtgtacgtaatatctttgttggaaataggattctcctgatatttatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaaactatcgttcaaagcacaagcataacatgcactggatgatctctcgcgctttgctgcagaatatatacgttagatattgaagaaacgatgaaatgatttgaactgaaatattatgaaaatgattgaaggatgatggtttagcatgtatatatttagttttataatgaaataattgtaaatataattactatatgtttatatgttataagttttgcgtgtttaatgagtagaatctatatatatatatatatatatatatatatatatatatatatatatatatatatatatatatatatatatagatttattatatgaatgtggggaatgctagaaagtcttataaattgaaacacaggtagtatattttgatgttaagttttaggtgtttaataggtattagttttatagaaagaaggattattgggatgagccaaatacgagatggttctcctgatatttcaggacagggttctccatatggaggaagctgttcctgtcaactcagtcaaaagctacaatcccatttgtcagctgtaacgtttattaataatttagttcccaatttttttctctaaaaatattacatcgaatctttggacacatgcatcgggcgttaaatatagattaaaaaactaattgcacagtttacatggaaatcgtgagacgaatcttttgagcctaattagtccatgattagtcataaatgctacagtaaccaacatgtgctaatgacggattaattagacttaataaattcgtctcgcggtttccaagcgagttatgaaattagttttttcattcgtatccgaaaacccctttcaacgtcgatcaaacgttcgatgtgataccaatttttttttcgtaaactaaacacaccctaaaaaacaaacgatagagctgtaacaacacgtgatgctgtacttgggagaactcatatccaaagatagataataacttcagtaatagtaacagtaactgtttaggactttatacatcttgcgaaaaaaaaagagcgataataataaaggactcggtaacagtaacaaagataaggcttctatactagatcttccctattcaaaactacaaaagagattgaatcaggttgttccggaacacttcgtgccatcgccgccggagtcctgatattgtacgggctgttcttgctctgtcaaggaaaaaacatggcaacgtgtgagcacataacacacacagacataacacgtattagcggccaatgtaacttttacatatgttcttaacaacttaaaaaaaagtcaatgatgaaaaagaaattacttataaaaacgctaaaatcaactctaaaaattaaaagtaaacataaaatttaaatttaaaaccttggagcaagtgcgagccttggcgttgcagacgggatactccttggggcagcaggtggagtgatccttgcagcaggtggcgccctcgacggggcagcatccccacacgatgcagtggttcctgatccc

SEQ ID NO: 30903 - DNA, 1528 bp, Oryza sativa
atgaaggcgaacgcgtcgtccatgatcccaccgttgcagccgctgttctgcccgttcctcgcgcactccaccagctcctgctccgacagcgacaccagctcgccggtgacgatcttgttgatgccctccacggcggcgaccgccgagaacgcccagcagctaccgcactggccctggttcttgacgggggcgacgacggcgcccttgtccctccagtccacggagtccggcagcgcctcgacgccgtcgtggcggtacgcctccccgacgcggcgccccctgccggcgggcgtggtgccgaggtaggtggcgcggaactcgccgttggtgaggtcggcgaagcggttcatcccgaggcggaacccgccgcgctcgtcggcgcgggcgttgtgggcgtcgacgaacttgaggttgtcccagaacacgcggaaccggcgctcgtgctcgccgatgaacccgttgcgcgagccgccgccgccgccgcgccggtgccgcgccaaccacaggtcgtacgcggcgcgcgcctcggcctccgtccgctccagcccccgcaccccgtgctccgcgttgtacctgatgatcgacatgatgtccggcggcgccgccgccgccgggggagcgaaggcggcgaggatgaggaggaagcaggccatggccagcgccgccgctacggacttgccgccaccgcctgccatggttgtcgtcgacgtcacgtcacgccgcggcgcctcgagatcgtcgaaacgaaatcacgtagaagtatgtgtggatacgaaatcgtgcggtgtttggttggcttgtgctatgttctggagaggcttggcggtcgatgaatttatacaggttggtggcgtacggttcgtgaccgaattttacttggtcgctgacgacgtgtcggtctcgtattggatctgtatcgtgtagagtgtactcgtttctactcctaaatctgacgtgtcacgttcaggttcggtattcgattctaaataggatgacgtgtcacgttcacacacgggccgtagcagattggggattgaggtgttacggcccggcccatttggcccacgaaatatcacctgacgacttctcttctcttctcctcttccttttcccatccgatttcttctccgggcttctggtagagtacgatttgatactatctgcgattccgcctcccctccccctcgccgccgccgccgccgcggggaaatctaggcgagactccactactaccgcacgtgtcgtaatggctcggaacaagaagaaggtagccgtggcggcgcccaaagcccggaagccgaagcgtgatgcagtaataccccgcgcctcagtcagctggagattggatcgtttttggtggaaggggaattgagctttagctaatatattttctcgtttttttttccttttggtgattgatttgttaggaggagaagaagttcgcgaagaaggccgacatgacggagttccgggcgcaactggactcgctggggttgaagattatcgaagttagtgcggatggcaactg

SEQ ID NO: 30904 - DNA, 2458 bp, Oryza sativa
tttcgattccattactcaaattcttgccactttttacaagaagaggctaatcgatgttgtacgatatgttagagtactgttagtttatgaaaggaggaatagtatatgcattatgcagtcttgtgttatatggttactcatcgtagtctgcagggcaatgggcgaccagctcgaaggcaacgaggaagagcacatgaagtaccgtgcaatgattgtgcaatacattaaggtatgcatcagatgagatgaccaaaacaaacatcttgtaacactgtgacttaataactgtagttagggtgccattgaatcaataaggtattagaaatactgcaagctttggctatgaccaagaaacatcttgtaacactgtgacttaagaactgtaattagggtgccattgaatcaataaggtattgcacatgctgcaaactttggctgtgtacatctgatctgggcgtagagtacaggctgccaggctgggttgttcttttatctaaaagacatgctgcaagcaagcattggcctatttacacttcataatctttcttgtatgcatcttacaggagcaccgtgtggattttgagccattcattgaggacgaggaaccgtttgagaaatattgtgactctatgcttgaggatgggacttgggctggtcatatggagttgcaagcagcttctattctcaagagaaaaaacatatgcatccacatggtaattttcaatacaagctttgcagtatgatttcttcaacctatgaataacacgctaggcagttgagccttgcctagtctgtattttgaaacacatgggtgatatagatcaatgtgctgcttatatatcccctgatggttctctgttatttttcgtactcattttcatattatagcctttcttctatagaagagaacgtactgtaacatttgattgatgcctgtaccattactgaatgatttgcagcttaactcaccacgatggtacataagaaacttttctgatcgtgaagctaccagtatgattcatttgtaagttaatgtgtgttctgctgttttaaactaatatgctaatactggcagtaaaaggacatacattctcatgttcctttgttttgattccaatatagatcgtatcatcagggtgagcactacaatagtgtcagactgagggaagatccatgtcaaggtcctgcaatgccagttattatcaaggtttctcactgtccaaattgtaaactgttggttgttttgtgtccctggaaggacagtgagatcctgttgtagctcaacttgctctgttactaatcttaattttatccgttatgaaattacaggcagatgccaatgtagctagcacaagcaataatgctcaaacaaaagcaaaggacctgaagaaatcttcagacagatcaaagtatgatcatatatcggttaaattggtgatggctggaactggatgttctaatatcgctgcagttgaacaggtatgaattatacaacaaatcgactttcttgtattgcaactgcgagcctaggctgaccgtagcagccaatcagtcattatatattaatggtcaatgccacatcacataggttttgaaagacatggatggtgacattgatgctgctatagagtacatgttagctgagcaactaatactgggttctgatgatgcggatggagatccttatctggactatgcatgtgatggtaaacatttgattattctgaagtctaaagtggctgtccctatgaatgaatctcatccttatctttcttgaggacttcagcttatgacaattaatgaaatttatggtgaaatttggagtacttctgggattccatagattgagttttcattgtttaatcctattcatattcttgccaaacatgagctgcctcacctgagcaagcgtttcatgcacacccctcaattcagtagcataaatctagtaggtaaaacctatactgggtgttgtgctcatggcattttgggtttatgcctcactaatatgatatttaccatttactggttatttttaagatcatcaaaatatgataacagtaccaagaagcatgaacggtgttatagaaagctcaagtaagactacggccttgttggagagcttctagctactgcagcttctcccagaattttcagctctctcaaacaatccagattcttagctatagaatccagaaaatgaactagatgccggttaccaactagctgtttctcagaattttaagctcccaccaaacagcccataccagttgctgtgctgggtgttttccatgtcagttcctctgcaattgccaaaggtcaatatcataccctgtaggaggtatatctgtactaagagttagtgtgctatctaaccaccctgtaggaggtaacatttttgtttggctggttattgttggagaccactattttagaagcacaagtagttcattttgta

SEQ ID NO: 30905 - DNA, 438 bp, Oryza sativa
tgttgggcgtctacgtcttcaccgaccggccgcctcgtccgctgcccactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtttacgtcttcaccgaccggcttgccttcgccgctgccgactggtgtttccgcctgcacggctggcctttatgccgccgttgttgggcgtctacgtcttcaccgaccggccgcctcgtccgccgccgactgatgcttccgcctgcacgactggcctattatgc

SEQ ID NO: 30906 - DNA, 562 bp, Oryza sativa
aatccatacacaccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaactagtgtggagatctccatgaagaaaagcctgtgctctctcaataaacctgcatatgcaaatcatgtccatcatctccaaatgaaaaggaaagaaaaacgctggtttaatcaggagagctagttacattgattttaattcagcaatctccaacttaagctcagcatcctctcgaaccgctgcagcatcattatcaaggaagggtgatgtgcagcgattgtatttggcgaccctgtatggatctgagaatacaacttgttctgtgagcctgctcatctccacattatcgcaatactgagcaactgcaattcacataacacaacatgccatcaattcggttctcatttttctcccttctcaattttcacaggcaaaccaaacctgtaataaatcaac

SEQ ID NO: 30907 - DNA, 180 bp, Oryza sativa
cacgctacccggggcggtccgtcttcttcctcccttttgctatggcagggctggttccgccattttcttctttcttcgtggatgttctggagttttacgatctccagatggcgcacctcacccccaacgcggtaatgacattggccatcttcgcgcacttgtgcgagatgttcatcgggg

SEQ ID NO: 30908 - DNA, 563 bp, Oryza sativa
caatccggctaacatgtaatcacatcatagagaacagaagcttttatttatatctgaatagtgaagctagcaggcaggcaacataccaagcttcaacaacgctagaagggcaggattaactagctcgagtagccggtgtgaaaaacacacaaagaaacgaagcaattaaaccactagtactcatgtttcctcgcttcgatcgatcgatcatggcgccgcggcgaagccggcgaccatctatggctttgccccacctccacaggcgggagcttggggaacttgaggaatggattcttcttgatcaatggcagcagcttcttgaacagctcggggtcagcctccgcgtcgtcctgcatcgccaccttcttctcctccgccggcgggtggtagatcggcggcgacggcgtcggcagcggctgcttgtacaccggcgtcgggtgagagtacgccggcgtcgggtaggagtacaccggcggcgccgggtgcgtgtacgacggcggcggcttgtggtacgccgcccgcgctggcggcgacgggttcttgtagtgaaagaagaagtcctt

SEQ ID NO: 30909 - DNA, 386 bp, Oryza sativa
gcatccgccactgccgactggtgtttccgcctgcatggctggcctttatgccgccgttgttgggcgtctacgtcttcaccgaccggcttgccttcgccgctgctgactggtgtttccgcctgcacggctggcctttatgccaccgttgttgggcgtcttggcctattatgccgccgctgttgggcgtctacgtcttcaccgaccggccgcctcgtccgccgccgactggtgcttccgcctgcacggctggcctattatgccgtcgttgttgggcgtctacgtcttcaccgaccggcttgccttcgccgctgccgactggtgtttccgcctgcacggctggcctttatgccgccgttgttgggcgtctacgtcttcaccgaccggcc

SEQ ID NO: 30910 - DNA, 405 bp, Oryza sativa
gggagtaaagatccgggggtatatatattcccggtgcgccctcgtcttcttcaccaacgcttagacgttttcggccgtttgatctctctcggcctctctccttcgccggcactgcctagggcaaatccccgcgccgacgccgccgtatctcgacgtcgtctggagctcgtcgtcctcgccgccgcctccgcctcctccgctgccgcagcatctctagggtgagagccgccgccgccagatctcccttcatctcgatctctccgatctcgatctctctccgtcgcgccgcccgccacgagacgccgcgccgcgaagacgacgtgccacgccgacgccgggccaagccgccgccggcacgccacgccgcaatcttcgccgccgcgcgcgcaatgccgctgccggcac

SEQ ID NO: 30911 - DNA, 12543 bp, Oryza sativa
ttttagctttaagaaacatgtgggccttcatcagttgatggaattcaatatccatacattttgacggctgggattgaagaagattatcttttcctttggctaatgatgtaaaggccaagcatcccttttctctgtcccccagaaaacaggcccagttcttggatactgtaaaaaaaaaggacattgtcaaagggagggaaagtcagtagtatcatatattgagaaacgagtttaaaactatattgagagagagagagagagagagagagagaaatgcaggaaaaagaaggatgctctttatttatggtgaaaaaaattatagaatggaaaactgcgatttttatgtgcagtttaaaatacgatttgaccaaatgttaagctaagcgtgttctcaatgtttttgttgaaatcattattcagtaatagtatgtgtatggaataaaaaaaatggcactcttgttttaatgtataaatgatgtgaaagatgataatttccaataaactaacttgtatggcgtgaaatggaacgaacacaatcacaacaaaatgtgtaatgtaaacaaaaatcaacatgaagacaaaggaacagggaatatattgttctttttagaaacatggtgaatatactgccattactatgtagcatcaatgtacaaaatttgctaaactaatgaagaccatttctatgagctctctgagttggaccatagaattccagatttgttaattaatttaataataataataataataataataataataataataataataataataataataataataataataataataataataataataataatatccagtcaaatccatgtttttacgtcatctcttgaaaacttctctaagagtatatcttgtaatatatattttaactcggaaacttcaagggtatcgcttgaagcgataagttaaaaaggagaatatcaaattaatccgctagtaataggagcattttcttttgtaatttttttacttttaaaaagtcaaagctatttactataacacattttatcatcatttcagtattgggttgattataatacaagatctctcaaattttgccagactagatcgatttttgaagcagccatgaatttataagtttttatggctaaaatatgtgccaacacagagtaaattcagataccctattggttatacccaatcctcctctaggcctttttattgtggcctgcgtgaatcgtggtctaaatggctgtaaaataaaatcagctcacaatgcgctcgaatttccccttttaatccacttagattatgtttatcttttttagaaaaaataaagagtaaattgcattttgcactgagtaaagcgcacccggtctcactttacaccaggtgctagtttagcacgtacttttagtttataccaggttgccttcaaataaatttcagttaacaccgggatacatcattaaacctataaaaatttcatgaaattttatataaaatgaatgaaactttgtgaaacatggtctatttttttttaaaaaaaacataaggtccactcgtgatttataaataatttccttcagttatatgacacaatctactgctacctccgtttcaggttacaagacgttttgactttggacaaagtcaaactgttctaagtttgtagaaaaaataaaaatattttcaacccaagacaaatttattatgaaaatatattcaattactgatttaatgaaactaatttggtattgtaaatattaatatatttgcctcaaacttgaagcagtttaactttgatcaaagtcaaaatgtcttataacttgaaacggagggagtacaaaataaaaactatttttatatatcctgatgtaaaataaaaatatatagtaaacccggtgtaagtgcaaaatactatacaatttactctaaattaaatgtttttatgtttttttttctgttttggggtgttcttgttgcctctttcggaccaacccaaacccccccaaatctcactccccaaatgcctcctctccactgattcctctccgccgccgccgccggctcgctttctcgtcgccggctcgccgcgccggcggcagcattgtgagcctccctcccctccctgtggctgtgcctcccccggtggccagccgccggcctttggcagtagtccctgcgcggcggcgggccggcggcgaggctggtctggacgcggcggaggcgactccgtccttccatctcggcttcgaatcgaattcgaaggtatcccctctctccctcctccaccaccgccgccgccgccgccgccgcggcgtggactgggaatcaatccgggcttggattggtttcgtttctctctctagtgaaaccctactagcttcttcaggatttctttgatgggtgcgtggtgtagaagaagtagaactaataacatcttgtgcttgcagagagagaaaaatttggggggtttgagctgagctgaccaccacgtctaggtcaggtccacccccctgctgttcaagctgtggagtgaggagatgcgtctacttttgccaaggaattagcgaggcattgccaggtttccgatggataataagcatcataagaatgttgaggcagggaaaagctcattccacaggatggttcttgggcagcttgttggggaattcggtttcgacgaggagaatgttccttgcaatactccgagaagctcggttcgctcgcggttcggtgcttcggctagcagaatcgtcgcgtctactagcggtgcgtcagttagccccggtgagtatgtcagagatcctgggtccatattgagcctgcagccttggatctttaagaggagtggctctcagaagaatgaggaaaagatgatgctcgcaagtggtagtagggttgttggtgaaggcaagaatctgatggattcctttcgagatggctcggctgttgaggtctctccaaggagccctggtcttggttctggacctgggagaggtcgaggtgctcttaggagcagacggtcgcgtaggcacttgattaggccactcgtgccgatggagaattcctacattcctcaactttatagtgcagattttgaaattgatgagtgcacgtttgggccagctccctcccccgcttctgctaggccgttcatcgtaacagatggaaggagagtcattagtaagtcacgttatcaaccagtgcctgtaccatttcatattggatttgagaaggaagggcgtcgaaacagctcagaaatggtggaaagtgtaattgggattgctcctctacctgagctgaagaaatcaaaaagggagaggcagggatcacacaatggagggatgggtttgtctgctttcgagagtagtaagccatcaaaatcaacaggtaatttcagcatcatgctgcagttattgcaatacaataaacacataactccatattctaaatattttttctcctcatgtttctgtcacctagaatactagataaaattcattggatcaaaataggtcagtgttccttggagttgatcctcatatgctctgacatgtcacagtaagcacaactcctgaatttttgttttcaacagaacacttttattaggttaagtgttgcaattgatgaagtaaaacttttttttttcaagtgaggtcaattacatcgttcttaaaataaatggaaaccatacaaattaggctaccatgcctattagagtttggctatgttattcattggttttctgagaacccagacacccagttctttgtcctgtgtttcttggctcaaccacataggaataggataggagacttacatctatcatctgatgatgtggtcaacactgacatctatgccccagtgctatactggaatgcttgcagtggctcttctgttgaacttctgttcgttgtgatgagattagttcaattattatgtgcttcacttatgcactactcttctcaagtcagtttccaatgtttaacaatgttctcagtggtttaaaatgtattgatgattatttcaagaaattgtttaatctgtgctcattactttgtactctgagaactagagctcttaattgctgagataatttagaagagattacagtccatttatcatcgagccttgtatgtcaacatgatttcgtgggcatttgtctcttctgatgtcctctttctcaaacccaagtaaagcctattaaagtatcattttttaagcatgaattacatgctaaatacatacatttgatctgcagatttacttgctcgactgcgcatattctctactggtgtcagtattggtattatatcatccactttatcaaacaagaatgagcttgatgcattaaagggtacagtgaaacgaatggagaacttgattcaagatctgcatgatgagctggagatgagagagggtttaactgtaaaggaattgcctaatgaaatgtctgtaaaaattgatggtaaagtatcaactaccaaaacaaagaactttcttttacatacacaaactgaaaagaattgtattgtttgttaatgctagatgatgagagcaaagctcatgtaactgattcagagcccatgagcaaaatcgaagaagagcttgaagctgagcttgcgagattggaattaaatataacttcaaactgcttgaaagaacaaacatttgacttcagtgaggtaacagttatactgaaacattatgcattacatctgaatgtggccaccttctacaagtctactgaatagataatcacttttctaggttgaacaggatctcattggagatattgtccagggagaactgaagatcgatacaacccattgtgatcttgctgaccacagcagtgagagtgcccatggcagggatagtagagaaagctccccagattacacacatgatgcaaactatcctgtctcacctagggatctcagcctccgtctccacaaggtaatccaacagagactcgaggagcgaatcaaggaacttgagacaacacttgcccagagtgagatgcagacgcaggtgcaagtgatggccaccgagcagatcttgtgtgaaagaacctgctcagacagtgattctggttctcccaaccaggaaagtccagtgtatatacaagaaactaactccttggtagaaccgttctgtctaaacctagctggagacgcgctagaggcttacgatgaagcttatgaggaattcatgagaattgcggactccccttgcaccacaagtaccaacgggaagcctcaagttcatgaagattactcggtggaccgcagcttgatctggggcttggaggatggcagtgcaaggaagctgaaaaaagtgcccacttgggagcgaattttaaagagcagagagcctaacagaactcaggagagtgacggagatgatgaagatgaatttgaagatgatgaccaggatagtaagatgctcatccaacagattatagagagaactaaacaaggctcacctgtactaattcatgctcaaagaatattgttttctgtggatgattagattgttggactatattgaattagaatttagtgccaattgattgtttagagaaaaaaacataatattattcttttcatcatcttccggtgatacaatttttcaatgtgtgttataagctctgctctgcttctcttgaaacacttatcgatttcaaaatgttcttattcattaccgggttgcgtttagtccagggaggactgtgttgcatcactacaggtaacgttgacgactagtatggctagaacacacaaaataccgaataatttgaacgttattacaattttgatttgaccatgttaattgaacaagaggtgtttgagggcgttttaatatgggttgaagggtgttttaatacatgtattcgaacaggtgtttgaattcaatgggtgagtgtgttttactataagtattatgtaaagattagaaggtctcacccataataaattagaaaaggtgtatgtttgtgtgtctataaattgaaaaggagtgattgaaaaaggtgtatgttttcgtgtctgtataaattgagaaggtgtgtgtttccgcccatgataaattgaaaaaggtgtatgtttttgtctctgtataaattgaaaggagtgattgaaaaaggtgtatgttttcgtgtctgtataaattgaaaatgtgtgtttctgtataaattgaaaggagtgattgaaaaaggtgtatgttttcgtgtctgtataaattgaaaatgtgtgtttccgtgtctaatcttgtacacactgatcaactggaacttaagatgagattgaactaagatgaaggagccaattgtggtcttgtacccactcatcgattggaactaagatgaagaaaggagccaattgtggtcttgtacccactcccaaactaagatgaagaaaggagccaattgtggtcttgtacccactctcactcatcgattagaactaagatgaagaaaggagccaattgtggtcttgtacccactcatcgattgaaactaagatgaagaagctaatgtcgacatcactactcctctgacagcctaaaacacaaacaacataaattagatttaaaaatatgaatgaatttctattttatactatgataattcataggaaaaataagtaaaatgggctgattgacagattcttaccagtagatttgtttcccacaaatatcccataccctgaaacagctgtagatagaaatatgaacgtcaagcccatctcccagaaatagcactctctttctatatataatcttcttacaagcaattagttgaaatcatgctagaactgtgcagcttccatataggagatgtgaccttcacaatttcattatagtttgaagagtcactcaagaagtgtgatgtgtgcattatgtccattgttgttgccatgatgcttgcaggtgcagcggctctctccgatctacaaagcaaaatggaaatgatattagttgcagcatccaaaacatgttctagtgcatagtgcatgataatgttgttcagttgttcttgtgttggtttaacttttgctcgctaattctgattgtttgtttgcaaaatatcaccctgaatgctccaaatgagtgggaaagtggcatgggtttgaatctttgctcggataattcagataatcttgggaatatattgcaacaattggcatgctgaagtgatgccaattcctttttttttctctaggccgaggaatacaccggccaaacttttattaagcaagaggagatagtttacaacaggccaacacacactcaagccagggtgaagaagccccgttgcccactaatgccttagagcaggtacaatagcaggccctgctattagccagctataaatatattttaatgagataaaatatgagagagaagagcagcgggctacagatctgtacccagctgcagcacggactccaagacgcagtgtgtgtatgacaggtgggactatatattaatagtatagtaagcaactattgtatatatgaattggctattagattggttatagatgaattggagttagtagtgggctatactattaaacttgctcttaggggctgaactataggaacagaaaactcggtgaattactcacagcgcacttcgcaaccccgccgactttctagtctttcgttcctctttgatggttgtgcacacttgcatgacggatgctgccttccattcgaaaatacgggcgttgcgctcccacatcaaaagttttcctgtcatgctttgtcaccatcttgcgagccacacaccaccaggtagcgaagccagatgtcggagttgcgcatgcgagtccttaggtgcatccggactcaatcccacacttgttgtgagaagacgcaagcttagaagatgtgggtacatcgttggcagaaagatgacatcggggggctagggatcaggatcctctgcagtcgaagtcacgtgactttgtcactaacatatgagcctgatgatccctaggcccacatgtaagtgacaaaagtatcgtgcatttgactgtagaggatctcaatccgggggctaggtgccaacctcagcgctgcaaatcgttcgttgtgaggcaagcgccccgcatcacacaaaatattggagaacttgcatctcgccggaattttttttattttgtttcgatcaaattttcaacggtgcgatcttctcccgtgaatgtatgaatgcaggcatgtagtggcacccttagcccgttcaattccaaaatcttggttcacattttaggctgtgttttgttgggccggccctgtttataagtaaacaagtaaacaattgtggcccttgtctattttagcaaactgctatagtatcatttgttctttccttgtcttgtgcaaggctcctttttatctacaggctcaagcttaacactttgttaaggcattggattatagcctgatacttgttgttctattcaagaacaaaatagaaaagtagatgaacctaaaatggacaaatgaaatgaaaatgaaaaggccaaagaaaaaaatggcaccaagcaaacttaccaatcaagaagaagaatgcaaaacccagaatctagaaaaaatactaaatctagaaaaaaaaaactgtagtgaaatctaattttgatgcattatgtgtaagtgctatgtaactgaatgtaagtacattgtaactgagtgtaaatgctctgtaattgagtgcaactgtaagttggatatataggaacacgaattttaatgcaagatcctacggacgaaaaattaaaagataagagcccaaaaatctatcgtaagtgaaatagtaaaaccgaccaacagaaacagaaagaaaatggagggagcagtagagtttactcatagcttttcatatcacgtagctgcaaaaataattatggtggcaaattgactaacttttaaaaaaaatggtgacatatttatagaaaatccgttggttaaattaatttagagtaaattttacaaaactacatgttttatggttcaaattgtagaaaaccacacatattttgacacttagcatttaagtacatatattttggtagtttagttttacaaaaccacactatcgatgaatggattcacccgtgagataacatggttgttccatctaggatgaggacgtgacatcctattaatttcgtgcgatggctggtaataggatgccatatcctcgtcctagatgaaatagccacgtcatctcgcgggtgaatccattcatcgatagtgtggttttgtgaaactacacaaccaaaatatatgtacttaagtgccaagtgtcaaagtgtgtgtgattttctgcaacttggaccacaaaacgtgtagttttgtgaaatttactcattaatttaaccagcggatttgctataaatatgtcaccatttttttttgttaaaagttagtcaattttttttggccataggatatacattaagattcgtgctattttcatatcacgtagttgcaaaaacaattatggtggcaatttaaccatcggatcctatatgcctatacaagtcatcccctacaattgaaactaatttcctgtgatatgagtgagccacgtcacctatattaatcccagccatcatattacagatgagcgtttgttactctgcagaacatagatgtactctacaggtgaatgttctcctatctcaacgcatggcaccacaaatcaaagtgaacgacccactaattaatgtggtaacgcctaggagcccactaaagctcaaccgtttcatctccacgaaaaaaataaagaagctcaaccatttaatcccactaagcaacacacatctcaaagaaaaataaacggttgacgctattttaacttgattgatgagtgaagtaagcaggtactccctccattccataatataagacacaaccattttcttaatgctccataatataagacatgcatgcatgtagggaattaattatgaccccttctctattaaattattacttttttaaatcctccactcttatgttctcttattctattagatgcatgcattgtatttattaggatgatccaaattacaagataataataattatattcttggtctttggattaggggtggttatgccttatattttagaatggatggagtataatagcaggctataagtcggctataaacatattttaaggagataaaatagaagagagaagagcagcgggctatagatttgtagccagctatagcacggactccaagacgtaatgtgtgtatgacaaatgggaccaggtattaatagtgtagtatgtaactattgtatgagttggctgttaaattaactatagataatttaaagttagtagttggttatactattaaacttgctctaaacagtcttcatgcctttatatattcatctactaggaacgtcgagatattcatcctcctggtgttcatcgaaatatgcttatgaaggatgaaccgcatgtggcagctgaagctccgctttaatttaccttcatcgatgttgtaagtgatcagttccagagcttccgcggtaggtgcaggtgctttgcctcaaatcaactcatcgtcaatcggaacaatcgctgtgtcatcagtgaatcggcgccaacgctggacggcagagttactgtcacatctcacaataggtaacatatttctcctctttcaatttttattcagtagctgtcgctttcgattctccaactgggctggatgaaaatgaagattttcatggcgcgcttttcaaactgctaaacggtgtgtttcgtacgaaaactttctatataaaagttgttctaaaatattagattaatccatttttcaagtttgtaataattaaaactcaattaatcacatgttattactacctcgttttgcgtgaaatatttaaacttcatcttcaggtagccatgcaattggctcatcggaagtattcaccattttcagaactgctgacagcaagtccttcttcaatggattttcaggacactgtctgtttgccctgatttgaaagctggtgcactccatgttttgataatttttcaacacaaaatcatttcttttctttccaatgatatggtcgcatcctctgatttgatcaagctcagaagtgcaactgatcgccattcgcagccagggcacatgtgtttgtctatttgattattggcctcttcagatttttcttaaaaaatatataatttccatgctctcaaaattgacccaaccagtccattcaaaagcacctcaaaatggaccttctatctctgtaccggttattaatttggtactccctccgtttcataatgtaagtcattctagcattgtccatattcatatgaatgttaatgaatctagacacacacacatatatatatatatatatattcattaacatttatatgaatatgggcaatgctagaatgacttacgttatgaaacggaggaagtataatagttaatacaaatttcgttgaacatagtattggaggcaacttttacaggtagatgttttcatatgatatagtaaatagtagattgagttggaaaaagaagacaatgacaagttttgcaatttatcctctatttttctaccactaagatactgccagttgatcttctttccatattgtattatgacatctgtttattatattaagcttgactgttcaaccttttattaacctcatttcatcacaatggatatgttacaattatatcattattcgttcttgcaaaccatctcaccgagcaatatatagtatctaacttagatttcccgcaacaacgcgcggggtattatctagtttgctataaatgtgtcacctttttttttgttaaaaaattgtcaatttttttggccataggatatacattaagattcatgctagtgcctagttgcaggaaaaaaaataggcaatggcagggagcatgaaaaaatactcactgctcagtagtagagagagctcctaaccaacagagcacagtagagtcttctttccccttccccctttctacagtagccgctcccattccccatctcccggcccctcttcctcctcgattctggcgccgccagcgagggttggaggagtggtccggccacctcccccctactagtattgtgtgtttatgtcagttattaagtcgtcaggttcttcctgttgttaaggtttgtctctagttagtgcttttgccggcgagttcccatgggtgccggagtggtcggcggaggtgttggttggtggcggtggaagtgcaagatccgaagatcagtgggcaatttgatggatggagctggcttcttgtggtggcgtcggctgcgtcgccgtcttcagctgggaggccgccgccctgcttcttgcatcggctgcggcggcttcctgtgtcccttgctggctggttctgttgtcgcccggagctcgccgctcgtggtgcggacgacagcccgtcagcgttgtggcggcggtttctctggtgcctgaacatgtgcttccaatgccatggttctatcagtc

SEQ ID NO: 30912 - DNA, 333 bp, Oryza sativa
tttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaagactacatccgtatctgaaagatggagggaatactaatagaagataagatgatgctgggcgataag

SEQ ID NO: 30913 - DNA, 534 bp, Oryza sativa
atgtcccctgagcttcaaaggaaatatgatgcattggatgctcatacgataatcacgagactacgtaacatgtttgaggaccaagcaagagctgagaggtttaatacctcaaagtccttggttgcgtgcaggctagcagaaggtaatccaatgagcccacatgtgatcaaaatgattggttacgccgagagtctggataagcttggttttccccttagccgagagttggttactgatttgattctccagtcgctacctcccagctttgagccgttcataatgaatttcaatatgaacaacctgaacaggaccttggcagaattgcatgggatgctaaagactgctgaggaaagcattaagaaaaactccaaccatgtgatagttgtgcataagcgcaagcccaacaacaagaaaagttgtcaaaagagaaagctaaactctgatgagatcacgagtactagcaactctaagaccaaggttcaaaagacagggcccgctaaggatgcagagtgcttcttttgcaaggagacaggt

SEQ ID NO: 30914 - DNA, 619 bp, Oryza sativa
ccttcgggcctcttttttgtatacatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctgggagatccacatgtcgagactggccaggccgggaacgtggtgaccgagggttatgggtgacccgattgtgggtttttgccgattcccccccggagttcaccacgcctcggggcacggctcggttctgggccccgttttgcgattttagccgacccgagcccccgagggcaggattgagcacgagtgacctatttcaagtcaagattcttcaaaaggaaaaaaaaaaacagcacagatacagcctttaggaaattgaaacttcttttattgaaatactgaaaaaaaaaagaaataagaatgtgcatgtgtggcagcccccggccaaccctacacgcccgagggggtgcggggttggcccgagcccgaaacctgacacccgacccccccctcaggggtagaagcgacgaaggtgttcgatgttccacgg

SEQ ID NO: 30915 - DNA, 693 bp, Oryza sativa
  unsure (1)..(693): unsure at all n locations
ctggaactgaatcccccacatgacatgggtactctacgatattttgctctggatgatttaatggccgaaatttaaatttcttaactgaaatcgaacccctacgccaaaccagatcatcagtgacgagcctaaactgtcatctgtttaagaagagagttgagatgacggtattcgaaggccgcctcctagagtatgtcgtctcttctctccaaccagctgaagtgcttcagtacggctgtctcgtcaaactgaaatggatcgaccatcgctcaataaaaggaggagcaaacaagcaatgaaggaaagttaattcgttcagtaagaagctaggaaggaagaaagaaatgtagtccagtttccagagttgatagatgttggtcaagccaatccacggagacgagcacttgctacacatcagcgaatgtagtttgttggattttggcgatgagatggttgattaaccctgcatttgcttccacatttgctttgatctgcattcctaaccaccggaaacaagcatttttttttgaacgactcgcaccatacagcgcanagtttatattgataaagcatgaaaaaaatacaagattataaccctgggaggtcgtaacccaaataatgatatctcgtaatctagacatcatgtctaaagtaccagatactactctaatatcatcgtcataacatagagta

SEQ ID NO: 30916 - DNA, 749 bp, Oryza sativa
gacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgtcatgagcacgactctcaaaaccatgtgctcacaacccaccattatcaagttttagttggcaag

SEQ ID NO: 30917 - DNA, 1316 bp, Oryza sativa
cttaatcacgcgtgcatgattttttttcacgatttttttttatttttttgtgaattttttaaatcatgtgcacctgaatgcgcctgattcaactcgaattttgagtcaaaagtttttaaaattttagttaaaagttttgaattttgagatgaaagttttcatatttgagttaaaagttttcaaaatccgatataaaagtttttaaatcttgactttgaaagttttcaaatctggattaaaaattttcaaaaaatcttgttaagttttcaaatctaagttgaaagttttaatttgaaactttttaaatctaagttgaaaattttccaaatcgttaaaagttttattgatgtactaggaggagaggccgagaggggctgtgccatctagcacgcacgtacccattaggaatctctatagcacacatttaactatgcgcgaagatgaccttttaactttattcttacatcatcacactccacataacatcattatatgatgattaacgatatgataataagtttgataaacaatataaacaaagttcaacagtactttagcatcgataagctgaggagaccaaagttcagcaaaatccacatgccacatcatagggttagcaacattttcttggtcacttccccttttttatgagctgcaagcgtaccaggctttcttcatttatgggcttccgatgggtttggccggctgagccactggggaactttcagatttttttttcagaattttgacgaaaactaccgtacaaatacagttaccgacaaaccggtcgggaaaacctccatcctatttccactaccattttcggaagatattatcgtttccatttccaccaccgtcggttaccgataccgactgaaacagtcgatgcaaactgaaaacggcagccgaaaatctcggaaatttccagatcgttttcacccctacgaggaggcgggttgtgtcgtggcgcaactgggcagaacgcattttcgggtggtggtttggtctttggtggatgtgaaggaggtgggaagcagtgcctaggcatgttaacacttaccccctctgtccgaaaaaaaaacaatcttaggtttgaacctggatacatgtgtgtctgtgtccaatttaggttcaaacccatgattgatttttttttggagggggcggaggggacggagggagtactggccatagtggcatcggtggcgcagctttgcgtcgtcgtggtttgcatgtacactcagccatccgcaagtggccgctacgcgtgcaagttctctagtgtctggctaggattgagcgagccaaaaatatcg

SEQ ID NO: 30918 - DNA, 655 bp, Oryza sativa
tggcagatcctagaaccatctcaattttgaaagaaaaaaacaactccacctggcacatgttgtaataacactatatcgcaaaccccaatctcgaatccatctctggtggatggtgacagcaccttgcttccctgctaaattcatctatagaaacaccggatgctgtagatgtatcctggtttacttctgccacatggcttagcctgatcatgttggggtccaccatctgcccaacgatggtgatcaccagtgtgcaagcgtttggagttgtaggagtgtgaagatggggggaggtcgctgtgggctgatgttgtttgcggttcagggacgacacaatttatttgcataagattttggtgggaagtaaaaagggagctaatttgctccaggctttgtttcacccggatctgctttgatcgatagtgtagaaaacgtgattgaacagcccagatcagttcatttcataattggacaccaaagaacgcttgcccatgatacatcaccaggctaagttgtagttgttacttcgatcttataggatttgcatatgattatgctcacctgcatcgtctcatcaggtttagttacacatactacgacaagagccatggtgctatacataaatcgatagaagccttggaccacatgggcatgg

SEQ ID NO: 30919 - DNA, 1121 bp, Oryza sativa
  unsure (1)..(1121): unsure at all n locations
nnnnnnnnnnnnnnnnnnnnnnnnnnnnnnnnnnnnnnnnnnnnnnnnnnnnnnnnnnccagaagatgctttacgctattctgatggcctcgaggaaactgcgccattatttccaagcgcatcgggtcacggtggttacgtcttaccccctcggccaaatcttgcataatcgagagggtactggacgggtggtgaaatgggcaatcgaactttctgagttcgatttgcactttgaaccacaccacgctatcaagagccaggctctcgccgattttgtggcagagtggaccccagctcccgagcctgtctcagtccccgaggccagctcgggcccctcacagctgcctcacaccgctcactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctgcactggggatccgccgcctcctggtgttaggcgactcccagctggtcgttaactaagtctgtaaggagtaccggtgctctgacccgtagatggacgcctacgtgcgccaagtacggcgtatggagcgccattttgacgggattgagcttcggcatgtgcccagacgggataacatgattgccagcgaactctcacggctcgcgtcctcgcgagcccagaccccaccgggcgcctttgaagaaaggcttgcccagccgtcggcgcgacccgaccccttaggggagatggatgcgcctgaccggcccccgaggcccgtcggagtccaggcctcgggacctgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcc

SEQ ID NO: 30920 - DNA, 1086 bp, Oryza sativa
tggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttata

SEQ ID NO: 30921 - DNA, 2042 bp, Oryza sativa
aattagatagtcatggctaacaaaaatattaaaaaaattctattttttgtcaatccgaaataatatttggctaatgtgaaacattaatgacgatggcatagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattgtaatttttttaagtactttgagtgtccaagtattttcaggatttttcttcaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtt

SEQ ID NO: 30922 - DNA, 600 bp, Oryza sativa
atcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgatagctcttaatgatgcggtcgacctggtccggcgatgcagagtgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgtgaagacatgggcatcaagctctgcttcgcctcacctgcccaccccagaagca

SEQ ID NO: 30923 - DNA, 103 bp, Oryza sativa
agagggaactcatccagcgccatccatggagagaaattggggtccctggcctggtaactcgccaggacgagctccaccgctccttgggcgaggtccctcgagg

SEQ ID NO: 30924 - DNA, 673 bp, Oryza sativa
tgttttcttttttttttttgcggggacaccttcctgttgttgttagtattgcatacatcaaaacatttatctcatgcttgttcggtggcctcaataatcctcctgtacagactgcgcaattcaaacatatccttggagtgaagccaacaccgcatagtgtgctaaatgatgtccctgtcaaaacttatccaagatcgctgatgcttccaaaggagtttgatgccaggtctgcatggtcacagtgtaacacaattgggaccatacttggtaagttcaattagtacctcaatgtttgacctgtaattagttctaatgaatacactaaccattcttcatttcctcaataattttccaccaaaccatgggaaatgttgattttcatgcgcagatcaggtaaactacgcgcaccaccataaattgttaatcccatgagggtttagaatgcaagatataataggtattatgtcttggttgacaatgacagggtcactgtggctcgtgttgggcatttggtgctgtggagtgtctccaggatcgtttctgcattcatttcaacatggtcagtgaatatgaatgacaagtccgttctcatggccaaggcttctaacttaatttattgttcctttgctcacatagccaagctactgttttttattccttgtagaacatttcg

SEQ ID NO: 30925 - DNA, 2324 bp, Oryza sativa
  unsure (1)..(2324): unsure at all n locations
gggcgatgtaagtccttggcaaatatataagttcaataagtgaaatgttgcataatttgtattttttgagctattaataatgtttggtcggtgatactggtaggatgggtacttcaagatcataaggggcacaaacgaatgtggcatcgaagaagatgttgttgctggtatgccctcgacgaagaacatggtgaggaactatgatagcgccttcggagtcggaacggccatagtttgactttaatcaatgttaatggcctcaaatacggttgggatcatgtaaatttgtcctgggtgatttctggattttgcacacacgggcaggcttctcgagactgatcggagtttaggctacttgtccagaaacacattggaataatatctgaataatagatgtattctctctctctctctctctctctctctctctctctctctacgtccggttaactacgggatgtgacgtagaggtgttagggaggagcgcacgttaatctcgctgtaatccaagttgagacttgaagaattaatgtgtatgctgtaagtcaaatgatatgcgatctgtgcgctgcttactagtatcccaaaagtatggattttgttcaatcagtctacagcttgacacaattgcagcagcaagcactcgcttggacgcatctagctccaaattcctgcaaaacactggatatcttggttcaatgggaaccgagaagtcggacaatgacagcaggcatcgatttcaggattccccattcaaggtaccagaatgcagatacagtaaataaaaacgatgatacattcatatggacagaatcacagaatacaaacagcgcagagcaatcggtacaatcgacaacagatcgaatggcacactgcctttttcctatcagtaagagttagctcagcgactccgagacgcagccgccatggccgtctccatggcattcttgaggagcaacatttccttggcattcttgaggagcaacataaacgatgatacattcataatcggtacaatcggcaacagatcgaatggcacactgcctttttcctattagtaagagcttagctcagcgactccgagacgcagccgccatcgccgtctccatggcattcttgaggagcaacatcatttccttggcattcttgatggctttcctgaggaggagcaacagcaacatcccgcggcggccagtgctccaccagcctctccacgggcactttgacgacatcgcggcgaacaccgatatctgagacatatcgccccacgcagtacatgccgctcgtcacaaccaccagcccaccagcgctggtcgtcaggaaccggagcggcgacgaggccaccgcgctgaaggcagccgtgagggaggccagctgcccgctgcgccccacgctgaaagcggtctccaccagcagccccgtcttgcagtatatcgcaaagtcctcgcaattgttcttgaacaggctatacgtcccgaacccgctgttcaggaggtgctgggcacggtggatcacgatgtcngcggggtccgaggctgccagggtgcacgttcctcctcgcgctntcacgaggaagaaagcgggggacaccgcgtagtcgaacaggtacggattgcccccatccaagaagcaatcgaggcacgacattatgaccccctgctgcttaatcaggtgaccacatttctcgcagggaggaccctcctccgttgctggagatgagctgaaaaggaacatgtccaagaatgttcctgtcccaatttcatgtccagttgctcttgtaaaatgaataaccatggcatcaccaatatatatccctgaaaatgaagttcaatttcgggaacaggtcagagacatggtcttagcgagtatccttgctccttagcaaataagtcaacaggaaaacatgaactgactgtataatgtggggttaacggacatggagcacataaatgttgcgtggcatgccaatcaagtaatgagtgttatgttttccataatagatggcaaatgacatcgccgacggtatattgtgcatatgtcggttaccagcatgtaggagaggctttattttcgggaatgcgcaaaatgattgcacgtcaatatattagaataggagaggctttatttggaaaggggatggccattgtgatggtggattggtgggcattgtttagttaattgtctaaggtttgtacaccaaaaaaaagggcaggttgggcataaaatacctacctgtgttcgggagagctctaaatttgagatggatttatcttaaatggaaagataagcagaatccttcgattgagatgcaggttccatgcgac

SEQ ID NO: 30926 - DNA, 583 bp, Oryza sativa
cttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggccttaggagtggcgtcatgcccgaccgtttcccttaaagagggcgatcgccctggcataacgccgggggctactgtcggtgacatgggatcaggagtatcatgactggaggtttgaggcagacacaatcgcacacgtggccttgcacccccgagggacgtcgggcccgagggtgatgtggtcgccctcctcttagtccccccg

SEQ ID NO: 30927 - DNA, 676 bp, Oryza sativa
tactatctaaatagtattatgtattaattaattaattatttgcaacattattgattaaaaattatttttaaaaaaattggcgggaaattttaaattttggcgtgcatattttaccaggcagccccgccttctttatcacaggcggccccttccctctttcccaggaggcgtgccgtgctcccgttcacctgcgaaaatcggcgataagaaggcctttgcctacaaaaatgtttttggtccgcctgagaagagaccgttttcagtcctatgcaaaaaatgttttttctagttgtagtggctggtgataatcaaaattcaaaagggaagattagatggatcccaagtgcatgcatgcagtacgcttctgggaaagaagaggatgcatgttcatgtgcaaaagcttgctgaatatgtacgtggaccaagaaacaaaggaagaagattacggctcaatgttgtgctacatgggctgagcctgttggactctgtcatgcgtgaaaactcgagttgggcctcgtcagtcagattgctctcttgccgtttggatggcagccggccctaagggaaagtttgtttgtgtcgctagcgtaagcttagattgattcatctatttttttttaagaaaccactaggatataggccctttcgcagagattcatctattattatttttgct

SEQ ID NO: 30928 - DNA, 1273 bp, Oryza sativa
  unsure (1)..(1273): unsure at all n locations
ttagcggccaccaaacgagccctctgcgaatactttggcgggttaccatccttcagaggacggattccagtaacctgcaaggcatgcagaaaacaacattatgataaaatgaaaccagaaggaagatcaaatatggagaagtgcgagtctgtaaacaaatatggggagattaccaaccttcaaatcactgaatgtactcgatgcggaaaatccaatagatatggggaaaaatgttgatggatcagctggggggacaacgaattccatggagccactgcaaataagggggaaaagagttaacaacggagggcaaaaaacccaaatagaagtacaaaacataattatatgaactcatatttcaaggacctgcggttcgactgatcgataagaagaatggaccattccaacacggagtttctcgagtcatacctgtatgcacagtgaaatgtgaaacaggcattagaccaataagctttcactgtgctgtctacgttattgccaacaaggaaaaaaaagttgagctctatctacaagagatgtcatttaggaccaattcatacaagggatctggactaaatcccgataaattcaaaacacatccctcttaagcatacagattaacagtttgagatgccaataagactgtcaggaacaaaagccagaattgaaagttatcacttgttatattttaatactcctaccatcaagactaaggaaggagacaagtatgacctgttggaggattattttagtataatataacagataagttcactaaagaggaatttgaaacattacttccattctccatcaatctgtctaacacttggagcctcccggagagcaggcaatggtatagagatgacaacattgtgcaggtcaaacatctcagcagcttcatactcaatgttgacataggtttcacttccagatactgatggccagcagttgactatgcgaagaaaaagcaagttaccaaaagtattaagcaaccagtgtaagagaaatacatgtccttgaaggacgagttagtggacaggagaaaataaaatgattgtgcacctgatacaggtaacgatgactgatccatcccctgaattctccatttaaccagaggagtttcattttgaccacttgggaatggcctgtttggctcttttgctctcgcgccgtgttgtctgatacacagatccacgctgatattggggtgtgnnnnnnnnnnnnnnnnnnnnnnnnnnnnnnnnnnnnnnnnnnnnnnnnnnnnnnnnnnnnn

SEQ ID NO: 30929 - DNA, 587 bp, Oryza sativa
ctcgtatagatttatataagaaacaaacaaaaattgtgttacattctttggtgttgagaatttctgtaaaaaaaagaattcaagcagaatgctataagttcagaaggaatgttacctgcaactggataaacccatctgcatcattaaggacctgaagagcaagggttccttgcacatcaaagttattaacacctccatctcttttaactgtaacattgagtttttcttcaattgtcactgtgacaggatcacttggtggaagaggcgatgcccttgactgaactgagctgggttgtacatcctccagaatgacttctccttcagctttcaaagactctaggaactgattcgtcttctgtgttttgcctaatttcataccaagacctttaccaggagcagtagcagctgcagatggacggcctgtgcaaatattgctagcaaacataagtaacattgtatagctgactgaactttgtcaagcagttttatgtaaagcaggagtactggcatggggaaactatattacgaatttaagtcttgagatatttgaatatcaagtaccacaagaagaaagtcctaggttaaca

SEQ ID NO: 30930 - DNA, 977 bp, Oryza sativa
cagtgaacatatgggaaaaaaggatacaagcttagagagcagcctcaaggtgtccagatcttcaagaatattgctctgcttgtttgtgataagtagcaagtacaggccttctattggctgataaacatagcgaacattttcagtctcaacataagtgtgctgcttcccagttccaaccagtttggggaaagctgcaagtaatccttcaatccttatgcgagacatgtcaacaaactgtcttgaaacaagtgctgcaattgaaaagcacagaaaagaaacagcatttagtctaatcacattaacttcctggaatgaagcatcaacaaattggtaaccaggaggtgctcactacataggattttagggttataggagttaagaatctactgaggtaacacgataacagctagtttagtatttgggttccacaaatttgcatatgagctaacactcttattagcataggtgaatgataaaaacttatacaaatactttttttttctttttctatgaacaaaaggatttgttttgattacaatataacaatataaattaaaaaaacttcttttcggcactgagaataatacaatacaatatataaacaacagaatatttcaagccagctgacctttcccggactttgaaatgatggaagcagcaagaaccacctgcggtacacaaaaaccaataataagctctcctaaacaaatcaaccacttgcttataccagcaaaatgtcagaatgttccttcttaatattacaaagagtaataaaccattaggcataccattttgagggcttttttggtactcagaattactgcacttaaaatggattcaggaattatgcgcctgccagaagtggaaaaaacaagagattattcaatcagtacgacataatcagaagatctcctgcgagcttagatccaggccccaactttttttttttgcttccagatcttactacttagtactaa

SEQ ID NO: 30931 - DNA, 680 bp, Oryza sativa
ctatgatcttcccacgggattaaacaaatacgatacccttagaatactctcgggtgaaatgctacaatggtatatccgtgcgcttgcgaatgaactctgtaaccataatataccaagagtatttatgcgccattgctgggaattatatttctagtaatgtcgttaagaaataccaacagctaggccaacaatggagctacaaccgggatcacctaaaacactatcctaacaaccgacactaaccgcactctatccacatctttgggattcaaggagagagggtgagaaagaatgatggaatcgctctccctcctaggccctccgacgtggtcaacttgcataagctagagcttcgacacaagaggactggaatctacagcgagcttgcaccgtttgtcagggaggtttcgtcaagaggtgtgcctagacaatgtctccagggagaggagcggcgaaagcaccgccgtcgtcgtccgtcgaggtctcagggagaccaggactaggttttcactcgacaggccccctagaggagatgggacagcatggcaaggccctcaagagggaaaggacgctcgagaacgccctcgttgccagctcggccaagtctgggctgggttttcacccgctgccgaccacctgtctatccacaactgatgcaccatgctccaccgctgtcaatc

SEQ ID NO: 30932 - DNA, 858 bp, Oryza sativa
attaatattcattacaaagtaattacatcctagttccgttgtacctacataccaattacacgctgtacttacatctcagttgcattatacttgcgtatcaattacattgtagttatttggtatttatattgcaatttttactatatgtgtggagtgttatgtagtgttaattatatggtttgagaaataaagtatgtactagtttataattaatcgtgaaagtctgtacgtggaggccctctattcttgtcgttatgggtaaggattagagattgagaaaaatctgactgtgcttggctccgttttgtgtcgaatactttttagataacccaccaatcacaattatgtgaataacaacaacagcagacttaacttgcgaatttctatcctacaacagtgtctccacaaggggtacaatgcaaattgccaatcataatttgtcaatttgtgactgaaagttaaaacgtccctaacccgatcactatttcagcttatacgtcaacagctcggttcatatatagaacagccgtgaagaagctcaggctgccatcggtttgccaactgctgataatacatcaaacgatcgtattagcactaaaaaaaataatttccctcttatataggctaatcgcctgcttattagacttgctattaggaaccctctttccccgttacactctaaacgaagtggatgtttaatgtatgattaattaagtattagcttaaaaaagctttaaaaatgaattaatatgattttttaaaacaaattttctatataactttttataaaaaatatacaatttagcagtttgggaaacatatgtgaagaaaatgattaaggagaagttagagcatgac

SEQ ID NO: 30933 - DNA, 447 bp, Oryza sativa
tgcattggttttctttgttggcaataatcaagtactgtgatctccttaacagttccacaggtgcctgaatattctccctctcttgatgaggaggggtgtttgtaaaacagcatttgagcttatatttgccttcgatgaggccatctgtcttggaaataaggaaaacgtaacagtccaacaagtcaaacaatattgtgagatggagagccatgaagagaaggcgcacaagctgatgatgcaaagcaaaatcaatgaaacaagggatgtgatgaagaagaaagccagtgagcttgataagatgaaggtctgcactgcacctttcttcagattaaaaatacatattatatcttcagagaaaataaatgacagttaatgtagttgactttgaccattaggaaaatcgatattacattattattgctagtttgaccttatgactctgtgctg

SEQ ID NO: 30934 - DNA, 16594 bp, Oryza sativa
atatgactgtgacaggagttccacaacaagtgcaggttgggcaaaacatggtaaatgctctttctgctaagccctaccatcctgtgttttctgtctcacatggtacaagtgccagttcatcttcacaacacccatatatggcgagacagttgctagagcaccctgaatacaatccaaggatgcatcgcacccatccttcattgcaaccaacaatcgaagctgcatccacctcaatgacatcccatgttaaagagccctgttaccaagaaaatgttggggatagcaacccaggtatgtccctgcttcgcagcacagctgtttcctccagggatgtagagaacaaatctcccaacctgggtgatagggtgcatgctgatgtttcggaaatatactccactttggatcaccaaacttcagctaacagcatgcagattcagtatgctcctcaggttgtaaggcaaccatcacaacagtccctgcattctgatgttacagaaacatattcagcttttggtcatcagtctgcagccagcaatatacagaggcagtttgctcctcgggttacaagacaagcatcacacaggtccctatatgaaagcagcaatagcagtctatggactggacctcatgatgattcccagatggaactgttcaggccatcctcgtctcgcagaattagtactaatgtcatctctggtgaattgccaaggatcaacttgcagagtgagacaatgatgggaaatgctgatttcaaccagcaaaatcttcggagacaaatttctctccgtgaaaacactgaatctcactcttttggcacatataacgagttgccaagaacatcttcctttttgcgccgtcaaagctctgaatcctcacaactgaatagtgcttctgtcaaatgttcaccaggttctggtagctcatcaaccacgatgggtcctcctcgccctttcaatacagtatcaggaggtgccagttctctgctaggaagtcctctttcttccatgtctggaggttcaagttctggtggtaatcctgatcatcagggcactgttttatcttcaatataccaaccagatggatacaatattaattccaccttgcctctaagaatgagaacacatgcaagggaggcctatgccacatctgttctacctcaagccacaaggcgaagccaccaagtgaactttgattctgcagaacggagaccccaatatgttcaacaaaggggtctggatgacactataaattcaaacatgttgagtgctcggcagcagtttcagaggcaggttgaaaggcagcttcagaggcaacttgaaaggcaacttcagaggcaacttgaaaggcaacttcagaggcaggttcaaaggcagcttcagaggcatcatgagagagcagctgcatctgaagcacatccattttatggcaatgatgagacttctgtcaggatgaacccaactgaggaatttcttgatatagtaaaggatcatgaagcattcttcctttcattttatcatccttctcgtattccagcccgtgtcatgaatacagtagatcaatgctatggtgttgatatggaaagggagatgccacatcaagagagtcatccaacacctggctgtggtactgagctttctcataagaatgacacttcaggttttgaaagatctgatgtggatgtcgcacacatacatgattccaaaaggctaaataatgaggaactcaatgcccttctattacataggaagttcagcagcttaaacaaagggaattaccggctttttcacatagaaggccatgtgcttcaatgcaggtctgtgaactttgtatcaactctgaagttgcagatgataggctgctaaagaaccattcacatgtatgcaagacataaaactatgttttctgatggccacattgctgttcttgttttctcttttgcagcattgatcagtgtgggagccgctttatacagcagaagcttccaacagcgacacctgatgagaaactcatggtctttaaagaaatcatgcctcattttcttgaaatggtgactgatgtatttggaaattatgtgctgcaaaaggttttactccaaatgatttcaactttctacatttgaatatgtaagcagacactagaaaattcacacacttatatttatttccttttccaccagatgatcgagcatggagccccatttcaaagaagggaaattacagcttgcctttttggaagtgtttcgagcttaagctgtcaactatacgggtgtcgagtagtccagagggtaatgtgcatttcatgtctaatatcacttcatactgttgcatatctgattttcttcatataaagatctaaatctcagtctggtattctcttgaacgggggtatgattaggggaaggggattagtcgaatttcacacctttgaatttttcttgctgatttgtgctcttgagcggcgttgtccacttctatcagctgtgtcagtttcacatcaaggactcctatctcttgattgttccactttgatacactccccttcacctgctgcatccccaccaacactgatgggtcagtgctcaagtttaccaggtaagagttggcctttaccagagctccctaccccagaaggtagggagtagggtgggtggtgataagtagcagatctggcggcaacttgagatggaaagatcaaagatggcagtcatagcggtggaggggtggcgcaggagaaagtatgaggtggtggaatcaaatttctcacttgcacaagaggtggcagccacaaagggcctcgccggcaccaggagcagccctggtgccggcgagggagatggaggcagcgtaggagcggttgatcgaggcggcggctagggggattagggttggagtgttgggtcacataggtgggattatatagggaagataggagaatctgggcggttggatctccatcaacggtcaaaagaaattcgaccaattttgagcagagaaacagacacataatgtatataggacaagggaaataaataaagtttagatgtcgacaaatgaggttggtgagtaaaggaggacatcattgataataggggaaaactgaaggtactgacatttatcaaagaaaagattaccccaatctaccgtttttgggaataattaccatattttgaagtggcgtgtacttttgcccatgtgcgcctatgctactgttagaaacaaagcaccttcattgttttagtttgtctatcatctatgtattaatagaacacataattaagttctttattttccttgaagtgttatgtttggttagctaatgcccacaactccttttcttgccccttgctttcttatgcaggctgtagagcttagtgatctagatcagaagatacagattgccaaggagctcaatagtaatatcatgaaatgtatacatgacccaaatgcaaaccatgttgtccagaaatgtatagagcatgtgccaccacgattcatacagttctttgtggagagcatgtatgggcgtgttgtggagttatcagtccatccatacggatgccgtgtcatccaggtaatttaattcattactttttcgctaatttgcaatgcatttgtagcacggagtcaactaatccatatgtcatcctccccatttattttcagagaattctggagtactttgattcatcgatccaggagatctttctagaagagattatagaggaggtttactatatggcgaaagatcaatacgctaactatgttgtgcaggtcagtcagtttgtattgccttcttgatgttattcattattcattactactatacatatattgttctaagaagctgcaggatctgcaaattttcttacctaccatacatggatgggggttgctatgaattttttgtaccggatgtgcattcccatttaccttgttgtttgatttatttcttttgcagaacatattgcagcacgggaaagcccttgtgcgatctgcaattataaagaaatttattgggagagttgtggccatgagcaagcaaaaattcgcctctaatgtcattgaaaagtgcttaatatttggtagctatgatgaaaaacagaagatcattaatgaggtcatcggcacaacggacctcgtcagaagtggtgaaaccgaggctcttgtggtatatatcaaccttcttctgaatatctgatgcttaggtggctagatgtattcatagaaatgatagaacttaaaatgaacataaaaataatttgaaatgaatcttccagcacatggaagttacatcaaagttattagcatgaagtgtagcttcttgtccactctacaatggttcctgaaaagcatccatacttttttgaaagaaaaaaaacagtttacactggtacttaaatgctcttgaaaatgatacaaccattgtgaatctggtcttatatatttctgtggataatgcaggttatggtgaacgaccaatatgctaactacgttgtacagaaggtgattgaaacctgcgacgagtggcagcggaagctaatactcaggcgcttgagggcgcaccacagcctgcttcacgactgcacctatgcaaagcacgtcgtggcacgactggataggctcatcgatatcgggggtacgcaatctgtctccctgatcacttgaacagtcatgagatataccagaaatgcaccaaaaatacactcttttttgcagtaaaaaaagaggttccacatgactttgttctaaacccattttgctattgccttttctccagagcgcaaaatggcgaatcccaggcgccccaggcgacatgggaaagatcctgtgccaccactgacctagaaatgagctcgagtaaatcagctgaaggggacgacggtgacctctgtccactgctgcttctgtctgcagcttactgaatcctactactgcggtaaattcgacgatcaatcgagactgctgagatgatgaactggtcatgaactctctgtaatgttagtgaataatggatgtgaagatcgaatgaacatttggatatctgtaatgtcacttgaactctggtaactgcgaggtctattctacctgtgtttgtaaggggacgagactttactatgcctgtcagagacatgtatcaacggccccatgtttaatctgtttagagggggccaaatgggccgggccaaaggggcggcccggggcacggccgaacctgtagcaagcacggcccggcacggcctgctacagtaacgggccgtgccggcacggcacgagtagcgtgccgtgcttgggccgctggcccgagcccgcgggccggcacggcacgacacggctactgtagcgggccggcacggcacggcccgcggcacggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggatgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaattttttttccttatacatttcctttgcttttttttttaaaaaaaacactgtgcactgcaggctggcgggctggcggcctgccttcacgggccgccgtgccccgaacggcccgtgggccgcgggcgtgccgtgccggcacgggcacggcccggccatccatgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctataaatctgttgtactactaccaggtttgtgtaatggtgtttatggattcagctgagtgcatgtttgtttgataataatcgggttttaaatctctgactatatagctaccgttatctccggccatagctgttcaagaagggttcgctctcatatacaatttagccgctatatctccatttaacccactataactattagagaagatcaaccgctaaatatctttgcctgctatttaaaacactaataataatgcagctttgctttcatatggattttggttagaatgactgggtcaaattattcaaagcatacttcatattcttcatctattaacaaaatgtttttttttaaaaaaagaaaattatttctggatgctgctgttatgcctaactaaaatggattaaagatttgtgatatgcttttctgactttctttttgaaacaaacatacccccttgtcttcatcaaatcatcagtacgacatctgtgcttttcattgacgggatagaaattttggtaggtggaagaccaaccaaccaaccatcagtactggtattgacttatcattagcagaattttgtacaaaatcattatacaatgccacccattgaggttaacaaattcagctcaaatacacaacttcaaattcacagactaactacagctaagcggcgaagaatctgttcaaatcgagaggtttcgctcaatttgtccctgcctcaaaattttgtcatttgtctctaattttacaaaatttaaacaaaacagatgctccacacttcactggtatcccgatcctaacacgattctatactccgtatctccatactagcacgataaaacctaaaatgatcataaaatcgatatgtgcggttctatccaccacagtatcctacaatatgtatcccaacgctaacgaccttggtggcaagaacagagtatcacaatgggttctctggtcccacttgaaccaaggttgcgggcagtgggtcccacctatcgttatactgacaggcgggcccaggctgtggagtcatacgctgacgtgggatgacctcatcgacagcggcgagtaggggaacgtggccaccgacgtctgcgtcacgccgtccgccgccgccgccgccctctcgtacgacgacgtcgggtacgagtgcacgaagtcgtagtagccgacctcgccggagctcaccggcgggggaggcggcggcggcggcggctccggcacctccgccgcgccgccggcgtcgaggtacctcgccacctccctcatcgtcggccgcaccgccggcgccgggtgcgagcaccagagcgcgaccttcaccgccgcctccgcctcgccggcgtcgaactccccgcgcagcctcgcgtccaccaccgcccccacctcgccggcggcgtacctctcccacgcccactccgccagcacgagctcctccggcggcgcccgcggctcgatcggccgccgccccgccaccacctcgagcgccagcgccccgaacgcgaacacgtccgccgccgccgtcgccttccccgtcctcgtcagctccggcgccaggtaacccagcgtccccaccaccctcgtcgtgctcgggttcgcgccgtgctcgtgcagcttcgcgagcccgaagtcgccgagccgcccggacatgtcgccgtcgaggagcacgttgctcgccttcacgtcgcggtggagcacaacgcgctcccacccctcgtggaggtagagcagcgccgccgccacgtcgcggaggaccttcacgcgggcgccccacgtcagccgcgcggccgcgaggccgtcgccgaacaggtgcttgtcgagggagccgttgggcatgtagtcgtagacgaggaggaggtcgccgcggcggcggcaccacccctggagctggacgaggttgcggtggcggagcctcccgatggacgcgatctcggcgacgaactcgcggaggccctgccgggactcgtgggagacgcgcttcacggcgaccaccgtgcgcggcggcttccccgggagcacaccgcggtacaccttgccgaacccgccggcgccgaggagctcgcggtcgcggaacccgcgcgtggcgcgccgcagctcggcgtagctgtagcggtgtggcccgtagtcgagctcccatggctcgaccacgtcgcggttcttgtaccggtgggcggcgtaggcggcggcgccggcgagggcgacgagcgcgacgaacgccgagaacgccgcggcgaggatcgccgacgtgcggttcttgccgccggcggcggggcggggcagcgacgggagggaggggacgtcgagcggcggcgcggcgccgccgccgagcttgaagctccagcccatgaggtagtgggagctcgcgaggaggcccgtggacgccgagaagccgacgaacatctggtcgaggaagatcggggacaggtcgacgtggaacgagatgagcggcgacgccggcttcgacgccgacgcggcggcgatggagacgttcagtagcttcgcgccgccgtcgtagtcgacccaggcgacgatggtgtcgccggacttgaggttgaccggcgcggcggaggcggaggcgttggaaacaaggctgttgaggtcgacgccgacgtggttgtcattgatgtcgccgaactcgaagtcctgcacggtgtcgaactccaccgcgaggacgtggttggtggcgttgccgacgtcggcggcgctgagcagccccaggtactggctcggcagcgcgccggggaggcgcgggtcgggcgcgacgacgaacgcgaggccatggccgcccagcttcggatactccggcaccaccgcgaacgcgaactccgtcgagaacgacaccgccgcgccgccggcgaggaggcggaggggggacgggtagaacgcgtggccgatgagccgcgacgtctcgttggtgagccgcaggatgccgtccggccggagctccgtcacgccgttcagcgtcaggttcgggctgttcccggcgccgccgccgccgccgccgttgcggaagccggagtaggtgaattcctgggaggcggcgagggcggcgaggaggaggaggaggaggaggacgacggcgaggtgtcgcatcgcatcggagacggagaagacgacggcggtggacaggtgatcgtccgtggattctttggaggaggaatggaattcggaatggtaatctcgggggtttttttttgtagtgatgataaagaagagaagaaggggagaggagtgacgtggcaccactatgagtgttaactaaatgactctttctcatgtcactaatatttgatgtcgtgtagaggataatgcaataacattatgaaaggacatgcagttcggtggttgcagtgacctaagtagcacattaagatcgtaagttcaaatctttataagagcgaatttcagattgagttatttgagagctaagtttctaatttaaaaaaagtcctgagttcaaatctccataaataagttccctgtttaataggctaagtttctaatttaaaaaaaatcataagttcctaatttaaaaaagtaatgagtttaaatcttcataggcaagtttcctgtttgataggctaagtttctaatttaaaaatattgcatatatccggttgaatgtagagaccaggttaaaaataccattctctacaaaacaaaaataatattgtgcagtgttgaatattggtgcaaggtgtaaaataatttctttttttgcttgatttattatttttaaccacttaatcaatgcttgggatggaagtgacaatgacactcaagtggctatcatttttattttgtatggttctagatagccagatgcgcgctctctctatagccataaaaaaaatgtcatcttctttaagaaaaaaaaagagtcaaaattttaaaactttgaagacagatgtctttaataatattgagattgaaaatcgtatggctttggatagcctactacatctttaggaaaaaaaccaaccatggaactttccacccaaactatcaagttttgccgttgagttgaactatttgttttaatttgtaatgtttcaaatagaacattataatttcgaatactattttatgtcgaagtggccatacgaggaccatgaaccaatgcattataaggctgcgttcttttcccctctttttcaactcacctccctcattttccgtgcgcacgtttttcaaacggctagacaatgcattttttaaaagttttttttatatgaaagttgctttaaaaaatcatattaatctatttttaagttttttttgctattaattaattaatctctcaacaatcgcgtgtcaaaaccaagtcttaaagtttactaccaaccaagtgtaatggaacggttagcacccaaatttgtcaaccctatcaaaagagagactttgggttcgaatctgagccatggtatggtgaagcaaaggataaaaacacaggcttcaagagtcaaccctatcaagacaactcttacacaatgtccagagaggttggcactaatcaattgactttgaccccaggtatcaaggaagaaaaatggagtactcctgctaggtgattattatttccggatgcagcctcatttggagggcagaatttcagagacttcataagagatactcctacgggaaagaatccttaaaacataaacttaaaaagtaaaaaaaaaacaaacaaacaagtcgtccaagcaacaagtctaagcgacataatataaaaaaatttctttaagaaaatgtgttttttttgaagcgtggagtaaataataatacatttcaataatccggtgaataatgtgataagaacatggcctatgttttaagttgttttctaaagtattttatttgtctttaaaagtagataatcagtcacaatagtccactaataataaatcaaatagggccacgctgaaaaaaaaaatccctaaacagggtggggtggtgttcttgaattcgtgcattcattggtcataactacaatgctcaatgccttaaatgctccattcgtcttaaaaaaaggattttagatgaatggaacatttctctatatagattcgtactatgatacatcacacccatctaaaattacttatattttatactttaaaacgaagagaaaactactatcaatctatctgtagcagtctctcactcccagtggataacaggagaaggggccaatccacatccatgtagagtacttctacagcagtatgaaggtctctgtaggcctgtaattggctgggtcagctgttctgcatggagtcaagcgtaacagatcatgaaagcaactgtggagaaccagagagtgaaattactctgaatttgtgaaaaaggtcttatactgtgaaacagggaacaaaatggtggatataatttgtgttttaaatcgaactatgctcctttggaacacatgattattggaagaattcaatcctatggaaaaaattatcctatcagatcatttggatcaaagaaatatctatccaaaaattctatgaaattcttttggcttgactcaaaactagaaaactggagggattctagcatgtgcttcaacctcgtgtgaaaaaaaaaatcctttgtgcctttctcttctaatccctttatttttatcgttatgttttttcaatccataggattcgaagttgatagaacacttcaatcctatattgtttctgtttatatgttttgagaatcttgcgttctaaaggagccagaaatatttcaaacatgcggagcgtctttgttttgttttggcatatcttatgcttcagtttcttgtaacggcagagttacaatatcatgtttttttcttaaaaaaaagaggtgtgattcataaaaagaaaataaagaaaaaacagtaacactctatcgtttatcagactattgccgaccataaacgtgaggcattggaggacatttgaaattccaaatatacgcagttgggctcagatcctcggacatactcatgacggatgcttacataatactccctccgtcctataatataagggattttaattttttttcttgcaacgtttgatcactcgtcttattcaaaattttttgaaattattatttattttatttgtgacttactttattatctatagtactttaagcacaactttttattttttatatttataaaaaaaattagaataagacgagtggtcaaacgtgataagaaaaactcaaaatcccttatattatgggacggaaggagaagtagtttaaattgaccatcgcaaagctagccgaaagccaaagttctggtgaaaccgcattttgcaaagcaaataattgttaattcgctgacacttgcttccagacctctaattaatacagatttagtcgaaaggattagaaattttagttggattccctggtctgcttgctcgatgcgtatgtgaatgtgatgatgtattgacagttaattctggttcacgaccgaagtcgtaaagctggaaattttcaaaagaggttaagttaaaccaccgtttcagttcgtaaaccatttcagctatggaaatcatggtgatttaattagatattctgcacattaatcagttgaattcatacccctttttttttttgcttgatgaaccagaacatgtctggccgaaaagttttatgtgattttctaatgtttccacacgaggcagcgaaaattcttccttttacgcttttcttttctacgaaaacatcatatcgccaccaactttgctggagaaatcaaactgaccatcaatctattcttcaaatgactcatgtctaacttgggcttcacaccgatcaagtacaaaagtaagaaaaatagagaagacccgccgtattccctctcacaataaggcctcgtttatttggggaaaaattttagatttagttgccacatcggatatacagacacacatttgaagtattaaacgtagtctaataacaaaacaaattatagatttcgccacgaaactgttagacgaatttattaagcctaattaatccgtcattagtaaatgtttactgtagcaccacattgtcaaattatgacgcatttaggtttaaaagattcatctcggaatttacatgcaatctgtgtaattgtttttttctacttttaatactccatacatgtatgatgtgacagcgagaaaatttttgttatatgaactaaacagggcctaaacctactatccgtgagaaaaatgttcaagaattcggagaccaaagtttatccctgaacacatatagtgggatgtgtggtgagccatccactaaaatctccatggttggatccactgttgtagtggtggctgatcatggtgtacaatcaatttgtggcttttagcattgcatacttgcaacttgctaagaaggagatcaatggagtgtgtgagcttagcttagtcaatgaaagtggctagaactggtcaacaaattcgcctccagatccaagccggttcagccattggacaattagtagcactatagtgcagcatgcttgcttgctcttgtgaattgtgatccatatccaattattagtaaatattcctaagcttggtgtatggtctgactcattgaaaacacctttttgttccctctcttgttgttttgctaggatggagccatgagcacttgatgtgatgttgatcggtgttaattagtgcattatcctaatattagtcttagggagttggaataagatatactagaatctggttggtgtgtcccaattgaatattgtgttgcatattccttgcaactattttcaggttgccatttttttgaacgaattgcacgttgccacttggcaattcttttttttttgggggggggg

SEQ ID NO: 30935 - DNA, 4417 bp, Oryza sativa
  unsure (1)..(4417): unsure at all n locations
tccgccctaaaatataagtttttaatacctcgatataattttaagatgctactttgactaacaataactataaaagtaagatgatctaaataaaaagagttaaatattataatagtttgtttaatgataaatctagtaacatcaattttacatgattaatcttttttattttcttgctattaatagttaaaagaaaaaaggttttacttagcactattttaaaaatgcttatattttgagacggagggtttacggagcattaaagtctcactgtaaatcaactggaagccaattaaagatgacgcagggtctactgaaaactaactacagtacttcaaagctaattaaggctgtgtttagttcctgaaaaaagttgaaagtttagggaaagttggtagtttgaaaaaaaagttagaagtttatatgtatagaaaagtttttgatgtgatgtgaaggaaagttaaaagttgagaatagttggaggtgaactgaacacggcctaaatatggtgtatcaattgaatttggcatgaaagttgacaggactacttcaaagagaaccccacacgttgacctatcagtcgtatgtgatgtgatttttatatgcatagtacagtatatgtcctatactatttgctggagcaattgccgatcatgaatagttttgattatccttctttatcttgtctcaataagaaataaatcaaattttcagtctctcattcaaagttggcagtatataataatattactagtgaacagagaacgaaaatgacagctacattatgccacatttgcaagcatgcagctgctcctgctcctctggttgactgcatatgaaaggaatttgattgaatttgcagattattttgtccaacgaggccatttaaaatataactccaaaaactactgatcacacatccagtgaaggtctagctggtgactattaattgcactcttcagtaccgtctggtcagttgctttcaaattaattaatcctcttaactagacgagtggttgacacaggtggcacgcacaatgcaacacacagattctcgtccacttgtccttacctctgactttgactccagtagagtactcgacaaaactacaagtcgatagatagactgatacctttgacaacaaagtcgttgcaaatcaggcatgaaagggagcgacatatatatagtattaaggctatgtttagttcacgccaaaaaaatcaggcataaaagggagcgacatatatagtatgaaggctgtgtttagttcacgctaaaattagaagttcggttaaaattaaaacgatacgacaggaaagttagaagtttatgtgtgtagaaaagttttgatgtgataggaaaagttggaagtttgaagaaatatttcggaaaacacggcgtaagttgagtattgaagaaagtaagagccatgctctctccatcctaaaaaaaacccaacctggttggggatgggacattaaccaaacgtacgtaatgggccaaaatgacatgttaatcaactttggtgtgtcaaatttatcatggcccattaaacatgacagcctcgatcaaattatcagcccattagaagtaacgggccattcaacgtgtgactgagctaacttaactgatttcagcccagtttaacgtcgtcaggtgtaaacattgaggacacatcatatggcaagcaaatgggaaataaacgattctcaaactacaaaatctcaatcagtactcgcttcagcatcgaccatctcaatctgacttctacacatttcatcaggaaactgccttgagggaggaactcgctaagtaaaatgtcgatccatcctagtcagcatagtcaggttttgtacatcagtcgttctttctactacgagtaggcacgggaaagaggattgattaccaaaaggggagcaggagcgtcattctttggatgaagactggccatggctttgagggggctaagaagcacgaccttccaaaatcagctccttttgaatcaaccatagagggaaacagcatggtggtcatagttacaacaaatccagcttacagttgtctggttgggtgcaggttgggtgttctttggaacaggatcgcgtcataccaccctgcacaattcacaactgatctggtcagaaattaacacagttcagagtattaattaaaaagttaatttgctacatgagttctgaagcaaactgggaaggtccctaagggcagtcccaacccataacactagacatggtttccataaactccacatcatcaagaaactagtactagacactactcttccaatgcaaaaaccactattctacttcaatttaatgctacttatctcacatgatgtcttggatgttgtgtagaaaccatgtctcatacaagacatggtttccttctctttcctcatttattcacttgccacatcattttttatcctaggtggcaacttatttaatgctatggacaccatcatagtcattgggttgggaatgccctaacaagtcaatcaacaaaaagtttctatcctactactagactattcaaagtacactgatatcgttgcatgacagattttatgcatcattatcactttgcattttgttgacataggtgcgagattgttcaataggggaaatcatgcatgtcctccattgtgatcatgaaaactattaaacacttttcaacagttgggaacttgagtggtcatccatctatcattaggtttgctgtgagcagcattgagcttttccttttaaccaccggtgcaggaaaacttcccaaaaaacattgaccaagtttctatatcagctctaaccaagaaaccatgcaaccaatagttcagctgtcagagagtgggaatccactttaaggaggtaggacagcataaatatctcataaaaaatatgtataattcatttgtaacacttagacattatgatgcttaactaactagcagtataaaaagatccacagttccacactttttagctataaagggtgaagcagccaaaacagaaaggtgggggtatatctataccggtatacccagcacaggacaatgataacttctgattcttgacagatttcttcattaagttttgagtagttgtaccgcaggtgggatgcaatggatacggaccatatgaggtaacaagagcagtagtttagtttgcctagtcccaacaggcataccaaaaccctcttcactgtgtgtgcatagctatatatgtattctagtttatcatcaaacaagacacatctgttaagcaaaatgtaatacagtgttcattgatctaaacacaaccaatgttatgataattcattatcttgaccaaatagcttgtttcaaatcagctaggtactaaagtttaacacatgtaacacaacaaattccaaatttcagcaaatcacatattcactattaacatttcactacaagtccaaatacgtgcatccttgtccagttgtcctcaatatttatcagtgtaaaacaagtatgtgccacatgttctagttgtcatttcactgtttcatgtctacgtagaaatttaacaacatgattattacaaagcactgtaggcctattccattctatctaatgtattacttgctgaaattctaaagctaacagtttactagccataagcccctaattagttatacaagcgggaacactccaacataccttgagataacgcgcattgaagatccagaaaaagaaaacatgtacaatgttgatagctctgcttatcccaagatcaacattatgcagcattaaagctgcggaagctcctgtgggttctccattgatgcccttagtatcatgcccgccctccgcttccgctcatcctttacttcctccttcaagaaagacggatcctccctcagatccaggggttttgaattcaacacagctgataacggcttcttatcaattccaatcttgaggtgcaccggtgccctctctttgggaacaatgctcttctgattctgattgttgtcccaacctggcccagtatcaatgtccatnnnnnnnnnnnnnnnnnnnnctggtgcaaatgcgtcgaggacagagattttcctcctctgtggttgcatagcaacatcagacacctccttctccccaggtggcaatgcaggctcaaggaatggatttctcttgctcccagccacctgtatctccttccccttttccgcagtattctctgtaaccgctggcctaaatccatcagcacctgcaagtgccaaccgccgctgcaagctgagcagtgacttctcagccttcctccgctgccgcacctgctcaaccttgtccaccctggccttggcctcctcttcgctccaaacctctgtccttatgtacgtgtgtggatccgggaacaccgggagccattccggcacatgctt

SEQ ID NO: 30936 - DNA, 9885 bp, Oryza sativa
ggggtttagggtttcgggggggaagcggagaggggaggaggaggagaccgttgggtggattggattagggcttggaggagggtttggattcggatccgagcacgcgaagcgaagtggggggaaggtcgaggtggagacgaaggggagagagagagaggatggctttatagaggaggagtcggtgggtggtgcgcggagctggaagacgaagacaagtggcgctcggtgattggattagcctggtggcacggttttatgggccaacttgtagcacggcccaattaggcccaaatcgtcgaatgaaaagaatacacaatgcactactaataaccagatctccctgatacaggtttgagaacttgcaatggatggcagagtatatgaggaacaaaatttgacagaatataggtagtagtagaacattgcatgctccatccccatcacggcatgatcacaaccacatctggtgaacttctggggaacccaactttgcaacctctgacggtatccagcatcgcggtgggaagcaatctcgggcagcatggcgaaatggcgagtcgcagtcagacttcgctttagtggagcagaagagcaagggagtttgtggcctctactgatcatctcagctcgctgtgcagccatgggagagatcctctcagcgtgcacgctggtgaatctccacgctgccagcggaagcctggttcgcggctcggttgctcccgaagttcttgcggtttgattctctcgctattcttgaaccaaactgcgtgaagcataggatgggagtagtggtgtcaagtcacaaactacagcttctatgttttctttaaatattaattctatggaattaactggttggtatatgcacctggattgcccgctttggttgaagtgcagcctcttttaagcccagtaggtttgcaaccttcaacatcatcacagatatgtatgtattaacgtcacccacagatattgagttacaaaaagaagatttatgcatcgtgatgtatcatgtacttcctccgtttgacgttctagcatttcccacattcatatagatgttaataaatctagatatacatatgtgtctagatacattaacatttatatgaaggtgggcaatgctagaaagtctcacattatgaaacggagggagtacatgttactacttaacaaaaatcaatgcattgaaacacaagaatgcaaatcatgctccaccagaactatttttttttctagaaaaggaattctatgtgttgcttttactcaatgagttatatgtgaatttcaaatgcgaacttcaatttaatgtaacagcccccatatggactaagctcagaacaagcacaaacctctctcaagatcttcttgtcgccctttccaacaggttcatcaagtttagcaatatcccacaatggaatttccaacaaagttttgatcacattctcatcaagaaatggaaaacgtgcctgtagcatggacagtagtacacatcagattgctaaacaaaaattgctgaacatttctaattcagaaagcatgaccgaaattacctccttgccatggtcagaaatgcacctatcgtctcttcccatatttcttttccagattctctgtacatctagtctcatctcctcatcaagtaaaacccagctaaatagaggcaaaaaaaaattcaacattcttgcagttgcagtgtaagaacatctcatggggtatgcattgcacaacctgatatgcaagtatagaacaaacaaattgatgcttacgcacataccctccaagtctatatttagtcctatgtcttccataaccagcgcactgctcatcagccccagaaccgactaaaagaactctagaagttgacttgtacttgtagcgacaaccatcttgcatgttgcatatacttccatccacccaaccatccccaccagcagccaaccagagagctataccaatatttaaatcctgtacaaaaaaaagcagaattataactttataaagctactgtaaaacatttgaagtaatatatcaaagctataaccaaggtacaaaccatataagtatttgaagggtatataagtgacatcacatgttcactttctcctttcaagtttgtcaaaactgtgtcaatctcaacaagacgccatctgcgagtaagaaaacaaacagctcgatttagcactacacaaacataatgattgcagcatggtaaacaataaaaaggggtagagaagtatttagtaacgagagtatggaaataaggaagtccaatcaaaaggcttccacttgattatagaagaaaacaaatggaaggtaaacatggatgagctatcaataagaaggcacaaaagtgtaattaaacataatatattcaatttgcatcggtggcttgatcaaattcactggccagctagaagactatagaaggaaacaaaacaggcaaataattcatcaggctgtaagagtgtcaatttttttttttacaaaaacactgcagggggagcccccacatgagagtgtcaaaaagggagtacataattcaattaaacagaaatcttgtgcaattgaagtgtgcaaaacagttaagacttgaccaaaggtagctcatggctaaggatgtgagatgttcagaagtcaaatcacctacggataggggaaattctctgaagttccttcagtcctgccagtgcagaaatcctatctggagcaagttgcccatcaaaactgacattcaacaaatcaattgtccctgttcaaaatttcaataactgttcctcatatatattgaagtatagtgtgtagcataagcagctaatcttcttgcactaatgtactataaaaatttaaaattcttagagtactgaacacaataaaagcaacggttggctaatatattgaactgctaacagtattgaacaagaaacagtaaaagcaatagttgaacttacatttggaatcaaggcactggtctaataatgctgcaagtatcatggagtccaagccaccagagaaaaggattgctattggggctagctcatcatcctttagtttatttagatcatcctgtccacaagaatggactatcaatagagtatataacaagaaacacaacaaggtccagacaatatagaactattttcaagtagcctgctggagttggggaaaaaagagtcatatagcagttttaagtcagtgccttggtggtcactcacctgaaagagtctgttcaaattggttcgcagcattacagattcccgcaacgcaatcaacaccttatacgctgaatggaaatataattgtaaagaagtatctgtattagcaactttccttaacagtattttgtttcaaaaaacttcaggagtaattatctgtagaactttactgctttatgtgaactgctggaaacatagaagaaaagatctctatttcccagtcaattaggcccttaccagcatttttgtcagcttcggttgagtttctgaagctctgagacaaacaatagtcccctacagaattctgatgtgaagttaagtcatccacagtaggaactatcgatttcttcttccattggattaattcatccaatgaagagttgatccagtcatgcctcctaacttcggagacacatgcttccttcatacacatgccacttttttcaaggcttttcaattggatgctgtatatcccacaaggaagctcttcccagtaactcatgttggtggactcaggaaaatcattatcttcccctgactccataactttgacagttggcgctgtaggagtgaagaagagtatataaatgagatgattatcaatcaagtagagagtaataatcactctccaaagcatgaatagaatttgaagtattaggtgaaattttcaaatttttttgtaaaagaacagaatatatgcaaacatttgatatggtaggcacatcaagattaaaaatatcttaccagagttattacttgcaaatgaagggggtgatactgatgataatataaagcgtggatcatcaggtgatggccaatgtaccaagaggcttcttctcccgaatgcatcccggccaaaccacattgtttttgagtccttctgagagttcaagcaggctcaggtgttagaaagttcaatctacaacaaattgcaaacaggacaaacatcacgattacctgcctgccagtatatcaaagcccaggggcctttgattgtggaaaggatctgtggaactgatttcccaacacttccacaacagagacatgcttcatctctaacaagagcatggcactcacaggaacaacaagattccagtgatgacagaagtgattgagtatcattttggtcatcagcaacatggactcctccatagatctcaccttaattgaaaaaatagtttcagtatcaagttcaagtaagctaatcactcaactactaacatggaagcaacactaatacgctactaaaaagtcaatcgatgcacgagttcgaatcatcaatcaggaaaagtcccagagtatggaaatcggtacatgtaaaggctatatcttacaccacaatagcatacgttccacacaatgaaatacgaaaaggaatcaattggtaatagtaacagggaaaattttagatgagcagaattaccgttatatactaaaacatttcctgattgacccaccatcggctgcaaaatcggctcagctcccctgagctgcagcgttgctccgatgaagcacaactcagtgtcacccacatcacccccattcccaactccacaatcacacccatcactccctgaaacgcaggacaatcaaatcacgaaacgcccgaagcaattaatcaaccaaaactcccaactcccaagcacagggggttacaaagcaacctaaggtcgtgccatccgcgcggacgcggagcctctcgcagccgaggctatccgggccacgccgccgcagggctgccttgagctcatccaccgtcacgcccttcccctgcaagcacgcaccaggctaactaactcgattccagggtttagggtttgggaaaccacggcggatgccaatccgaaagggagggggtttccatacttttccattcgaggatggtaggaacagtacctcgtcgcttggttggattccgacggcagcaacggcggcggcggcggcggcggagggagcgacgactacgcggccgccgccggagaggacgagggctatgccgcacatcgctggctcctggaccccacttgtcagttgctcgagccaagccgtagccgcgtgaagtcaagtgcaaatatgcttgccaatttgcagaaaagacccggagaagaagtatatttgcatttgacgagttcaggctgtgactattagctttacaaaagaattttttttggaactagctatatttattatatttgtggcgccatatttttcacaaaatatagtcggcgtgtgtttacattgtaagtcactaaattacatatgtaattttagtgtatttacaatataagacccaaaattacatatgtaagtcttaaaattacatatgtaaatcctaaaattacatatgtaaatagtgtgttagtgaggtgtaactacaatgtaaatttatataaatatataatttacaacaacaacaaagtttaaaaagcatatcagtatgcatctatgtcgtgtcagaaccaatcacagcaaagcgtgtgtgctgatgccccgtgagcacgaatcttcatgccaatcctaaggctgaaaattcgactgcgtttgtgggaaaaatctgtcgccataattatagccgatccggaaaactaagttttgaatttcttttaagtccatgctttaaaataagagtaaattgcatccgcggtacacgaacttgtcgagtgggtgtaatctagtgtatgatcttataaaatgcttgttttgttacataaacttatcttgcgcgtgcgaactaaggttaaaaggacattacacgactagttttgttgatttaggtactgattaggatactacgtaaacatacaaatgagaatgatatatatagtgatggtagagaaagatataaaataccgagcaatgatacatgggttagaaatatacaaaattcaagataaagtagagaaaaaaatttataaatatagcatgttttatacatactcatacgtatgcacgtcacatcctaatcaacatcagctaggtaaattaaccttgccaagccatttagatacaattatcagataatactaggttttatacaatttttgcaggtacaccaatgctctcgtacaaaatcaaggcgtagggtaggggcacagtaattgatatacacactaaatactctgcttaattacacactaattgcaaattaagtggtaattaatcactcaaagctaaggcagtgagcatgtaatcgcttcagctggacgagctctggagcttggacacgaagctggaggcggcgaaggcggtggagccaccgacgacgcaagcgagcgcgaccacggcctggacggcgacctcccatgggtactcctccgggacgaggtagacgacggcggggccggcggcgagcagcagcagcgcgacgccgagcagcgcgccgggggtgcccgggtcggtcgccgccgacagcacctccagctcctccgccttggacaacaggcccagccgctccaccgccgacagcgacagcccggcgcgctccgccgccgacaggagccccgccttctccgccttcgtcagcagccgcagcttctccacgttcgtcagcagcttcaccggcggcgccgccgccttcccgctcgtcgtctggctcggccccggctcccccaccgggaagtacaccgtcgtcccctgcaccgccgccgctcgccgccgttagcccgatcgatcgatcgatcgatctacaagctcacacgccatggggaagaggaagaagacttaagacttacccttcttgtgccggaggtgggcttctgggtggccatggcggcgaccttgtgaaggcggcggctgctcggcctcgccgcgacggtggccggcgacagcgacggcatcgccaccgctctagctgcgtccatcaccatggatggattccctctcctaccaccacacgtacacctctcgttcttctcgacttctcgtgcagcctagctcaccactagcttcgagatgatgatgtggtggcctatctgatccgcccagggacacgtgcccctcccctacaggctggaaatcccacgtcagacacgcatggattaatcctaattgaaagattaaggaataataaagtaattataattagagaaggtgaatgacaagatgattccatggcccaatggataaggcgctggtctacggaaccagagattctgggttcgatccccagtggaatcgcacagtttttctatttttgggtctttttagctatttggcccatttaaggcccatcgaatgggccttttattcggcctataataggttattgtgtttgggccaaatgtagcgtaaatgggccgacgatgaagcccaatagacccataaagtgggcccacgctccactgctgggttaatacccagccgccgcaaggcccagggcgaagcaaccaaacccttcgcgagatcagaagcgaaaccctagcggcgaatccccacacgacgcgccggagcggggagaggggccatggcggcggcggcggcggcggtggagaaggtcaaggcgctctgggactcgcaggtcaacgacgaggaggcttgggcgttcaactacgtacgtcaatccaatccaatccatccatcctctctcgcgtatctacagctttcttttctgttttttttttaattaatctaggcgtgatgctgctaattgcaaggatgaatttatctaggaggcatcagcggtggcttgtttaggtggatttagggacggatggatgtggattggtgttgtttagtctgctgctgcgttgttgagcaaacatgagggcatatgttgttttttccctttttgcagtgcgtgtttctatggacgaaagggttggactgttagagttgggttgggatggttgcgtttcttgagcaaacatgaaggcatataaatttttcctcttttttatttctgaaatgtatgttaccatgggcggtttaggggttagaactgggttgggatggttgggtactactgttgcttcattttttttattttgttatttacttcggttagtggtcgcactaacttgctagaatatgtagggttgaagtgaactgctgtgcttgactagtccttgtgtaaattgattctgctgtttgatgcttgggtgttatgagcttaatcatgttatggagaatgccaatgagtttaacaaacatgacatgctccttgctcttcttactgaatctttgttgtttgagtcaatcggtcttaactcataaatgctgttctagttattcgtaaggcggtttttgtgtgcattgtccactggctgaaaatgcatgatgtgagttaaagatgatcggcctaatcttttcacttatgtttatgcttatcatccaaaatttgaattttcaaccataaatttgaaactgattttgggggttttttcatcgaagttttatttttcagccttcgcttttagattgctaagaacacggatataaaagttttattcacaaattacttttcgtttactaatatgctgcgaataagccaaatgacggggccggatgttttcctgtgttgacttgtaataactcgtaatagcttctctaatttatgggtaagggtggcaactagagtgtttaacatatcacatagatggatggttagggctagtatactaggtacaaacagttgtatagcagaacagagcagagcagttgggttcactgtatttctgtgataggattggcatcctggcatgttccctgcattctgctactgcttgatgtgttaattgcttgagattaataaatcaaggaaatattgatggattgctggttgaggtgatcacttggctggctctgtccagtgcttcatactttggctagctgttatcatcatcttcctttgttctgtattcgtgtgtctgaattaggcatcctctagttgaaaaaaactcttctgtactcaccaggtagtgtgtgtctgcatatgtggtgctctttctgcagctcatggtgtatatattcactatatttaccactattttcttccaatgatgaattgcattaatttactatcagaaaagaattgatgtataggctatgtatggcgttgagccaattatccttgggatctcacttttgggttatgcctggcactgaatttctttttgctagttatcctaactgtgagttatatttagtgtagtatcttcactcattgatgctaacttcaacatttttgttgggcagttgaatctttaagtttttgttgtgtactttttctctccccattttttcagttgtccagaaagcatttgaagaagtagttattccttcttttcttcaaccacatattttgggcttagaaaattttgtacgcgagtcttttgactatgtggaacttttgattccgttgaagttattttttataataactatctggttgggcacagttaacctgactctttcttgtcgttagaaattctattgatgctaattaaactactgtcttgttttttcttgttctggtttacagaagctgatgaaggctggtggtctgtttgttgcatccatcttcgtgatgcgcaactttggtgacctgatggccatctaaagaggagctgatgcgacagtaacgtggatccaccagagctgtgtgtcttgttagctgttagttttcacttttatgtcagcaacgcaaccagacttgttcttaggatcatgaatt

SEQ ID NO: 30937 - DNA, 13696 bp, Oryza sativa
ggcccatcgaacccgggggaggcaaaatagacttttgcggaggcattgatttgggaaggatttgaattcgggattgaactggacgatagatcggggattgagatccgagatggcacggacactagacaatcaaacaaagaaacaaatttcgcaattagggtttttaagagataattttcccgctaggcgccacgacggaacgggcgctacagaccaacccccctaacaagaatctcgaccccgagatttagcacctaagggagcagctccgggaactcggcacggagaagatcttctcgctcccaggttgcctcatcttcagaatggttgctccattggaccttgtagaacttgatggtcttccttcgtgtctgacgttctgcctcttcaagaaccttgatcggtctttccttgtaggttagattcttttccagctcgatattacccaggggaacttgttcttctggaactcgaagacatttctttaactgggatacgtggaacacgttgtgcacatctgcgagaccttcaggtaactcaagctgataagccacttcgccacgtctggcggttatgaggtaggggccgatgtagcggggtgctaacttgccggacattccaaacctcctcataccacggaggggcgatacccgcaggtacacatgatctcctttttcgaactcaaggtcatgcctccgattgtcagcgtaattcttctgacggttctgcgctgtctttaaacgttctcggattagcttaacttgttcttctgctgccttgagtatgtcaggaccgaataccagtgcttcgcccacctcattccagcacaagggagtgcggcactttcttccgaacattgcctcattcggcaacatctggatgctggcctgataactgttattgtatgagaactcagcatacggcaaacaacgatcccaagtgccttcgaaatccagtgcacacgcacgtagcatgtcttctaggatttggtttaccctttctgtctaaccatcggtctgcggatggtaggccgtactaaaatttagatcggttccgagggcttcatgcaactgcttccagaaccttgaggtgaactgagtgcctcggtctgacacaatcttcttgggacagccaaatctacatacgacatgggtcatgtagagttctgctagtttctttctatcaaaggtggtttttactggcacgaaatgagctgatttcgtgagtcggtccacgattacccagatggagtcgtacccgctaggggttcttggcgaaccggtgatgaaatccattccgatctcttcccatttccactcgggaatcggtaggggttgcaacagaccagctggcctctgatgttctgccttgactctttggcaaatgtcacacagggctacgtattctgcgacatctcgcttcattccagcccaccagaagtatgccttgatatcttggtacatcttcgtacttcctggatgaatggagtaggctgactcatgagcttcctttagcatgagatctcttaattccttcttggccggtacacagatgcgtggaccgcaccaaactgtgccttgatcgtctatggagaaattggtgtctttcttctcttgtattctttttattaactcttttatcccttcgtcgtctttctgagcctcccggatttgcgattctagggtgggctgcactgtcaagctggcagggacacctgactgtaccacggtcagccttaacttctccaattctctgcacaggcgatcttggccaggccgtatttgagctacattgcaataggccttgcgacttagcgcatcagcgaccacattagctttaccggggtgataatgaattccaagatcgtaatccttaattagttccaaccatcttctctgcctcatatttaactcgatctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttctgatatctggcaaggtgagaactggggcagtggtcaaccttttcttcatttcttgaaagctgtcttcacaggctacagaccattgaaatttcttttccttctttaacagctcggtcataggtctggctagcttagagaatccttcaatgaatcttcgataatatccagctaggccaaggaagctgcgaatctctgacacattcttgggcgggttccaagcaagtacagcttcaaccttgctgggatctacttcgacaccgttggaggagatcacgtgtccaagaaatgctactcggtctaaccaaaattcgcatttcgagaattttgcgaatagttgatgatctctgagcttttccattatcagcctcaggtgttcaacatgttcttccttattcttggagtatatcaggatgtcatcgatgaacaccacgacaaactggtccaggaattccatgaagattttgttcattaagttcatgaagaacgctggagcattggtgagtccgaaggacatcactgtgaactcatatagaccataacgcgttgagaaagcggtcttcgggatatcttcagatctgattttcagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcatagccatcctttttcttaaccagaagcactggggctccccaaggggatgagctaggtcgcacataacctttactctccaattcttcgatttgtcttttaacttctgctaactcattagctgccattcggtagggtctttttgtaattggtgcggtgcctggtgccagttctatggcgaactcaatctctcggtctggtggcatactcgttcttgtcgttagaaattctattgatgctaattaaactactgtcttgttttttcttgttctggtttacagaagctgatgaaggctggtggtctgtttgttgcatccatcttcgtgatgcgcaactttggtgacctgatggccatctaaagaggagctgatgcgacagtaacgtggatccaccagagctgtgtgtcttgttagctgttagttttcacttttatgtcagcaacgcaaccagacttgttcttaggatcatgaattacaaactgctcactcgagaattgagatagttttcatgatataatggaagccagagtgctactggttttgtgaatcagcaggcgaatctgcgaaaactcaattgggatatcctttagttgagactggccaagttctctacactccaatccatgatgtagtgcattgtactagttgttgcattgtgttgatgacttgctgtgaaatctttatctcactgatatcgattatgcatgttattctttcgtggaagacttcctttttttttatacgaggtatcatggaaaagaatttttgcaaaaaaaaaaaaaaacttctactggtgagggaaccgacctcttctggctgagttcgcttgctgaggttctcaacctttaactctctcaaaactcaataggtcggccaaatcactcaccgatttggcttgttgattttttttaatttttttataattttctaagtgatatataaacaacgataggatatcaccttaagacacatcatgtaggagactcatcgcctcgatcacacacatatactgacatagtacatcgtactatacgtacttatttaagctaacatccaggccagctggtacatgcagagttttcagatcacatataggctgtgtttagttgccggcgtcctccgatccgttacttgaaagcgccaacgtcttcctcgtctcccttccggctggccctgaagtactccttcgggttaccctcgaacttgtcgcgggagatcatcaccttgccgtcaaagcccggcgccttcattgtccgggtcgtcggcggatcatcatctgccgtcttgtccgggtctccactgctctccccaatcgccgacagcaggaacaaggtgccggcggcggcggcggcgatgaaggcggtgacgccgaggatgcggcggcgggtcgaaggcttgtccgtcttctccttctcctttacctcgttcctcttcatctcgcggcaagagagagagagagacagagagagagtgggggggggggacagtgggtaactggctacggagattggagaggcctcagagcatcagggcagcttttgtagtgagctcgcgatgggacccacatggccacagccatcatcactactccatctgtcatgcactcttccgtagtctttaagtaaagagggatcttaatctttaaaaattagtgtagagagattttaccgtaccggaggaagtacatgtaaatactaatgggctcatcttttggtttatacttatatttatcagctaaaatttaaatttttaaccttaaatttggagctgattttgaggtttttttatcgaagtttattttttagtttttatttttagatcgctaagaacatgtatataaaagttttaaccacaaattactttccgtttgcaaatatgccgtttcgcttattccgcgaataagcgaaatgatggctccgtaaaattttgatatctcgagatatctaatatttgtaggtatcaaattttataatagaaaatatcgtattgcctgatattttcttaagaatgataaaattactgcatcgctcacatttcaagaaaattttacttggaaaagaataaagttaaagtgtcccatactattacttttataaagaaagtaaataagaggataaagataaacttactttagaacaacctttagaattactaacttatttcagggtgtcgggatgggaattcttttagaaataatactcccccatccatctgagttgctcgtattattttttgcattatgaccaaaaagagcactaacttctctatgattcatttaatctcacttgtgatttcagccaatcgatctcttttttacaagtttttattaaaataatattatttctaaaaacttttctggggaaggagatggaaggccaaagggttaaaggtgaaagcttttagtctttcgctggacccagcttgactcctctctccactatgtggtttcttcgtggaagatgaaaaagcttttcgtacgtggctgactcagctagactcctctccacgatgacccattagactgtgttcttgagggcaagttttataataaaggtgatggccgcctttaattttatccacgtcatttatccataaaattaaaactaacttatataaatgcattgcatttaatacactagtcccaatacacttaccactaacaccattctcaacccaatgactaggatagtatccatagcattaaataagctgccacctaggatgaaaaatgatatgacaagtgaataaataagaaaagagaaaaaaatcatggtttttacacaacatttaagacatcatgtgagataagtagcattaaatctaagtatggaatagtgatgtttgcattggaagagtagtgtctagtattagtttcttgatgatgtggagtttgtgaaaactatgtatagtgttttgggttaggaatgtcctaatcaacccctttctttttctcttgtttcttaaagtttgtgtggaggttgccccttatacgagagcaaggtcaatagtgcagctagtggcaagctccaaaattttatcatgtcaaggtaggtagaggtggctccttctttctctcttttctcttctcttctctcctctcctccacatcatcatttaagtatacatgacactttggagtttgtgcttaaaaccttatagtacgttggaaactaactcccccaacacgcaaaacataacgataaattaacgcgtaatttattaattattagttaaaaaacttgaaaaataaattaatatgattttaagtaatttttttaatattttttaaatcaaatcatttaatagtttgagaagcgtgtgtatgaaaaatgagagaacacaaaagccttcttcctaatagccaactaatgccgcatcaataaaatgcagaaaatagtcgctttgtgcaatttctttcgaaagagccgatactaggactgatcaatcctccgcctaacaaggttagggtagggccgtataggatttgttcagtagtcccaatattttattcccaaaactatgtttttttaactcctaaactaaatatagaaagtaagaaaactaatctttttaagagatgtcctaaatttgattccctataatgaaaagtgggctctccctttaactaccaacagagaattagttttttctgctcctcccctacgtgcgcaccgcgtggctagcttaattttttctccctacgcgcgcgaaagagcgattgggaaaaaattcgctccttaaagtaggaaacgagatatccggagttgggaacttggattattaggagacaggttagggattctgttggatacgatttttaaccaaattttcctaaatctgaggatagggaataaaataataataaagctgttggtcatgctctaacttctccttaatcattttcttcacatatgtttcccaaactgctaaattgtatattttttataaaaagttatatagaaaatttgttttaaaaaatcatattaattcatttttaaagcttttttaagctaatacttaattaatcatacattaaacatccacttcgtttagagtgtaacggggaaagagggttcctaatagcaagtctaataagcaggcgattagcctatataagagggaaattattttttttagtgctaatacgatcgtttgatgtattatcagcagttggcaaaccgatggcagcctgagcttcttcacggctgttctatatatgaaccgagctgttgacgtataagctgaaatagtgatcgggttagggacgttttaactttcagtcacaaattgacaaattatgattggcaatttggcattgtaccccttgtggagacactgttgtaggatagaaattcgcaagctaagtctgctgttgttgttattcacataattgtgattggtgggttatctaaaaagtattcgacacaaaacggagccaagcacagtcagatttttctcaatctctaatccttacccataatgacaagaatagagggcctccacgtacagactttcacgattaattataaactagtacatactttacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatggctcagccacgtggccggctgagccaaccaaccgggactaaagatcgagctgaacttttttttttttttgcatggtcctgttgctgcatggtttatatatatatatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaatattaactactttactaactagttgaaagcaagtttgaactgaatttgaacttgtttttgttagattttgattataggtatatagcatccatacatataattagttaggtatgtaatcatggattgtaaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatatatatatatatatatatatatatatatatatatatataaaccatgtatatatatgtttcaatacatatatatgcatacatatatatatgtatatatatatattatattatattatatgtatatacatgcataatatatatgtatttatacatataaatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctacggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgtgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttaccgcggaccaaatgacggaaccgataccaagccctacatggagtttaaagctatgattcgtagtagcaattaacataacaagattttcttaattaacagaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctataacgataaaagggagtattttattttatatagtctacttatatacaaggacctaattaattaaaggagacgtatagtaagaagtctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtcattgttcttggcggcgtcaactttcgccttcttcgttgcccttgtgtgggcaggcgatggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatgatgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagatcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcaatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactagctgcttccctccgcgattgtatcgtacaatatctgttcctcatcgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcgtgctccaattccttctagggctagctcttccactcaggcttgacggacgactccgacaacacgtcttttctgcaagatacaaaaagatgtattaggataaatgcgaagtataacatatatatatatatatatatatatatatatatatatatatatatatatatatatatatatatatagtaaatttgtttggtgctccatggtgtccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatattgcatttcacgttaacgttcgtcctcgttcgttcgctcgttctcgttcacgttcgttcgcttgttctcattcacgttcgttccctcgttctcgcttgtcttcgttcgatcgttctcgttctcgctctcgttcgttcgatcgttctcgttctcgttcacgttctcgtggcaacgtacgttgacatgttcgttctcgctctcgttcgttcgatcg

SEQ ID NO: 30938 - DNA, 2457 bp, Oryza sativa
ttttaaacccggttagggttaataaccgggactaaagattatagcactgcatatgattttctcttacatatgtgtctataaaagagaagttaatgcattaacattatttaaagtacaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattctttgttagctcctaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcgtgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttggcactaaccccattttttgctttccattgcaactactccagagtggtatccaactttttatgcccctgctcgcaacctgggtacaacgaagttctgtggtcctccaacatcttgtccaatttatgggcctccttttcactttcgcagtcctccctggcgtcctgcaacatctgactaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttattttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatatataggggtgggactttagtcccggttggtagcaccaaccggggctaaagatcaccgggatctttagccccggttggtgctaccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaat

SEQ ID NO: 30939 - DNA, 12478 bp, Oryza sativa
ctaaagatcccggggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgttatttctcaaaccatataattaacactacataacactccacacatatagtaaaaattgcaatataaataccaagtaactacaatgtaattgatacgcaagtataatgcaactgagatgtaagtacagcgtgtaattggtatgtaggtacaacggaactaggatgtaattactttgtaatgaatattaatataattttggctatggagacatggagtcagcacaactactgtgctcttttttttttaaacttaaacatccaataatataaaacgacagagttcatatgaataaatcccagtacattgccaaaaggataaagagaaagcataagaccatccgtttcgaaagaacggaaaactgcactaaggccacaatcttcatatagaaaccacacagcagagaaggtgcacatcgacagggagctgcagtgatgaaactgcactaaggcaatgccgcgacgattgcgaccttgggcctccttcagcgtgcacaacgcttgacaatccggtaatccccatccggttgcctccacgaaacgacacaaaacggaggtctgctactgagccgtagattttggagtaagcatccccgggctcagcaagagatgtccacggagtccgtcgtcaaatctgaggagcgagagctcaacccgaacaacaaaccctgcatggaacaagccgataggaaacacataggaagaaagagcctaaatccaaatccccatatccactaaagaactcgaatggtggcaaacgaattgctgtcttcgtggattgacgtacgtggatggggaagtgaaaatctgcaaagcatgactgatagaaccatggcattggaagcacatgttcaggcaccagagaaaccgccgccacaacgctgacgggctgtcgcccgcaccacgagcggcgagctccgggcgacaacagaaccagccagcaagggacacaggaagccgccgcagccgacgcaagaagcagggcggcggcctcccagctgaagacggcgacgcagccgacgccaccacaagaagccagctccatccatcaaatcgcccactgatcttcggatctcgcacttccaccgccaccaaccaacacctccgccgaccactccggcacctgtcacgccccgaactagtaccggtcggtactagcccgtgacgctccaaattaacctgttaatcgataccagtcccaggaaacagtgctggtatcacaggaagatagattatcacagcaacagaggtctctttattatagagtagaggtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcatcagtaggatccgcctcatcttcttcagcaactgggggggattatttatatagagcaagggtgagtacgggagtactcagcaagccatgggaaataagtgtttaatgcaggcttcaaggaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgatcaagattggcacccagccagcgactttcaaacggccacccgggccaaccactttcaaacggccacccgggcctagctgatcccatcagctgcagattttccaaacatcgatcccctttccacaacagcaatttcacaagacaatagtcaaacaaagctacgctaggaatcacctcacatccgcccatgaccgtgggcacggctgttctaacagtttgttaacctctgcagagggggtacactttacccacacgacattactaacccggatcacccagccgtggggatcagccacgttgggagacctccaagctttcatgacaaggcatttccaaagccgacacaggtttaccatatgccgacgagaggggtcccagaccaacaacaggttaggtcccagaccatactgtgccagtgtcacaccctgaaaattcaaaatatataaattgttgtttaaatggaatttttagaatttattttaaaatcctagaagagaagatctaatttttaattaataaattccaatataaaatggggccatataaaatttcattaaatactttgcttaattctataattcctagatttttctgggatttatttgagctaaggaagtatttttaataaatggaattgcatttcatgaatgattttaattgaaaaaggttttaaaaagtctcttttggctttgggccgaaagtcggcccaaaaccgctctctctctcctcggcccagtccggcccagtccgccgccgcgcgcgcgcgcgtccgcccgctgacaggtggggcccacctgtcagggtcgtcgtcaacctccggccgccgccgcccgaaaccctagtttcgcgccgccgccgttcccttccaaattcgatcgatcctttccgtttccggccgaattgatagaggggaaacaatctccgggatctcctctaccttttctcttttggaaacatcggctaattcgttttggaagttcgtggaatcaggttcgattcggattcgtctctctcctccgaaccctaaaccttccttctcgtcgccagccgccgtgggccttcgccgtcgcctccgagcccctttaaaaggttccccggtgtctcctctacccgtcgccaccttcgtcttcgcctctcgtcgcccgtagcgccctagcgccgtgtgccctagcgccgccgttgccgccgccgctccagccgtgcgccgccgccgtttcagccgtcgccgtcactcgggaagaccaccgtcgtgatcgccaagtcgccgccgttctcgtccgctccttcgccgccgccgaagaccgccggagcaccgctgccgccgtcgacccgaagtttgccgccgcttcctcctcgtcgccgtcaccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcatcgccgacgtcatcggggccgttcgctgtgagccggtcgtggaccgttcgatctcggccgtccgttttggatcaagtcgatctcggccgtccgttcgcgtgagccgtcgcctgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcaagcttgtttatgtgttgttttggtatttttgctcttttctgtttagattccgtcgtttccggagagtccgttttcgccggagaagagtttgaagagttccaaggccagcaaggcaagtcacacagatcccaaacaaccctttgagcatattgatcctatttaaagctattgtttctattcaaatattgcatttattttcgaatgtcattgggtggaattaacctaaggtttgttatagcccttttgttcttgattaccttattccttgataccttgggttattataacttgactggttgagctctatatgttggttcaactagatgtattagatataattgcttagccctgcttagaaacattagcacactattgggataacttatgaatcactataatttaatgatggcttaatgatagttcacgatggccaatcgtgatttgttaattaattatttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaatggtgcgctgcggtggattgtgttatacaaggggtattgtcacaactcctttccgaggtaccgtggtagtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcatcataataataggtgctttaattggtaataatttgattagctcctggtttggaatggtatattcctggtttggagatagaactgtgcagccgggatggttgttcagaatggttgagcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagtggaagagttctacagtgaagctgatggtgtggaggattaggtgtagccttagtcaagctgcctgtggagtggagccgtccgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacagccaggaagcccaggggtcctccccgacaccaccccggcgaatccacatgtctctcggcatcaaggctcccctgataagctagttactcagccaggggtgtcccattccacccatgtggtcgtacttgtcttatctttggatgaaattccaaggaaacggtccttaagtgcaagagtggaaaaccgtacacccggtacgttccccggtccgcggttttgggaatttcatttagttcgcaagcaccgacccaggtgtcgggttttccaagtcttttgtaaaacccaagttttatccaagttgtttttcagatttttaagtttgaaggcgaccgtcgatactcgcacagggtgcacgaatatcgaggcacaactagatggttacaaggggacatgatatatcaattaacaaaggaaggatcaaatgcaacaaactaggtaggtccgccaatctgccttgcagacgggacaaacagattaagtgcgatcctatcaatgcataatattttgcaagcaacataattaaattcaaatataggctcaagatgttcaaaggtggcttgcctttctcgagatctggagcttgatcctcgaaatcctcgcactgcgggtcttcgggcttcgaaactacacgcaaaacgggatgactcaacaaacggtgaaaataaagccctattaatgacctataagcttgccattagatagatctcgagatttgaggaattttggaagttgaacggagtcaaacggatttacggttgggaagatattgaatttttaagattattggatttttggtctaaaggaaaaaggatttaattaaatccttttttggaaaagaaaagaaaagaaaagaaaagaaaagagggagggaaatcagacttttcctcgggcggctagggcgcggcccgagagaaatggagcggtccggccgagctcaatgggccggccggcccaaggcggcccaaggcgcgcgcgcgcgggagggaggagagagagagccggtggaccgggctcaccacgcgtggtcccgggtgggacccgcttgttggtgacacggttcaccgtgcggagcgagcacgcggcgcacgcgcgcgggcgggggagggacgcggtgcacgcgcgcggttcgcggtggaacggatgcggcgggcccacgcgcagcctcacggcttgcggtggaacgcgcgcacgggaggggctgaccggggtcggcccgacccgatctcggccgagctggcgccgacgtggcgcctacgtggctgccacgcgggctggcgggaggtagacgacgacgccggccggaacggacggcggacgacagcgacgagcggcggagcgaaccacggcgatacaggcgaaagcgagcacaccgggtggttgctcaggacgaggggagacgagccaatggctcggattcgccggagggagcttgacggcggcgaattgaggcggcggcaaccggcggcgggagaagggggaaacggcgacgaggtcacgaggggccgattcccggcggcgagagcatctacgcggctacgggaatccgttgctagcgtcggattgggcggagctacgccgagcgaggccggcgacgagcggcgcttccgagctcgggcggcgacggcggcgagcacacggcgagcggcggcaacggtcggggcggcgccggctagctacggggaggctactcgtgctactacctgagtctaaggggaggagatggaacgaggaggaagaacggagggaggcactaccgtgcgggggtgatggggcgcagtgacgagaggccgatggcgcgggagtaatctctccggccttgggccggggaagaggaaggagagggcgcgcccgaagtcccctttcgcgtcctcgctcgtgccggctcctccgacacgcgcaacgacgaacggcgacggcgaaacagaggggcggcaacaatggagtggaggcgatgggacagcgagagaagaagagagggagggcgcctgggctttaaagggcggtaatgtcggtttggaaaccgactttgggcggtcaaggcgcgagctggcgctccggctagcggccaaaacggcgacagggaggagggaggaggatgacgccggcgggaggaaaaaggggaaaagagggagagaaaaggggggctttgtcacagcctgaatttcatttcaggatttataaattatttaataaattattaatagaatttatattaaatgttcattaatttacaagtgaagttaaatgtgggaaataaaatttcctaaatataaagcatggttggatttaatttttattaaattctccatgattaattacactctctggaattttctcggatttttcggagctcaattcctaattttaatcatacaaagagcatttcagtaattacccacatattaaattaatcattaaatggtctaattataattttgttaagtactttgagtgtccaagtatgttcaagatttttcttggaattatttgagcattggaagtatttttaacaattgaaagatcatctcattggttaatttatttggaaaagtaataaaaatcctcctcctcagcttgggccgaatccagcccattccctcctttcccctctcccttcctctcagcccagataaagtctgtttgacctccctggcgctacagtactccatcttcctcctccagacagagccgagccagccgtgctcgtgcacagtgccgcctcctcccaccaatccgacctccccgttgctcctctttccaaattagttgcgggaatggaatcctctcaatctcctcttccttttccccaagaaatccccaaatgtttctatggaaatcctttccaatttcgcggttcaacctttcctttttccggcgaaccctacctaatccgtcgccgattccatccgttcccgagtcgatctctccctcttctggctataaatagcatcccctcggcctcctcttccgtttgcctcaagtcccaagccgagccgtcgcttgtagcgccgccgccgccttgccctagccgccgccgacgccggtgaccctccagccgcgtcgcgccgcctcctcggtcgaccccaacctgcgccgtcgcctccctcggcttcgcaagggtgagagctaccccggccacccgttcccttgcgccgaatctcgccggaatcgctctccccgcgctcgccttctctctccacctccggccgccgctccagcagccccgcgccgtcgctgtggtcgtcgccttcggtcgccgctgccgccattgggttcgcgaggaggagaagaagaccggcctccacttccccgtcgtcgaagaccctgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgcccctcggttgttgcctctcgtcgccggaaagccgtcgccatcgtcaacccaaggtcgccgcctttggaactcgtcgcctgccatctccctcgccgtctgtcgtcgtgtaagtggtggtaagggtcgccttgatctcctctctctcccggtgccctccgtttgcatctttgtaccgtggttcgctggtaactgccgttcccgtgcttgcggtcgtcgatcctgcgtggcagccatgtcatcgctgatatcgacgccatcttggccatccaaaattaatataaatttgtcatctcttttcaatgacatattattcatttttaatatatgtcatctaccaaatatgatctaatctttttccggaggatgttttaatcttctgtctcagttataaatcttttgtaaattgtttaatcaatttggaatagtcttttctttaataggtttaattggaattaaatcttgtaaaattcatatttaattcatttgaagtcagaatgaggccgttcaagtctcataattcatctaaaattatgacctacatgtttgtttactttttatgtattatttatttggtttttattagtctttttcttcgttttgcgtgttagcttgtcgtttccgtcgttgtgaaggttcgcgagtgcgccggaagtattcaagaagattatttgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctatttgcattgattactttattccttgataccttgggttattataacttgactagttgagctatatatattggttcagctagatattagatatgattgcttagccatgcttagaaacattagcacactattgggataacttatgactcactattatttaatgatggcttaatgatagttcacgatggtcaatcgtgattggttaattaattatttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttactgtcacgcccagaaattcccgaatagaattccaagcagaatgtgcataaaaatccccgtccaggaccagccggggtacacaagcgacaatgttgacatacagatccacgtcttacaaacatcataaaagtcttacaaaaatgcagcggaaaacaaaagataactggagctaagccttgactaaactttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctagagtggctcatttgcataaagcgagcatttataaacggaaattgaaagatttaaacagttgtaacaattaattaatattaaacatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtactaatccaacattaccattagaaccaacagtctaaacattaatatgattttccccattgtgaactagttgaactaagcatggctaagcaattcctagtccaaactctaatcatgttataacccaagctaacaaaggagcatggtatcaaaatagcatggctgtaacaataggtaaacaacccatagtaatattataaaacaatgcagtatttgaaagaaaacaatagagcatttgcaatttaggatcaacatgttcaagtgacaagcatgacttgccttgctcttctgctgggggaacctcggcgactatctcgaagtacaccggagcgtcggagttatcggaatctagcgacatacaaagcaaacattgcaaacaggctataacactactgaaacagagaacaaaaccatttttaatggattctacacatttttcttgatttactgagacttgaatgggcttaaacggagctcggatgaattagttatgaattttagaagattcactgtgtttattactatacaagaaaaaccttaaattatttattgcgcaatatattccagggctgacgtcagcacggaggggatgcggcgccgacatgcggggcccgcatgtcagcggcgcacggatggccggtctaccgtggaccgggaccacgcgggtgatccaccgccggtccacgggatcgacggcccggatcggcccggaaccgatcggacggtgcggcggcggccaggctaggctcggctcggcacaaagccggccgaccggtctcggcgacggcgcgcgcacgcgcacgcgcgttgccgacgacggcaaccgccggcggagacggcagcgcaaggcggcgccgaagggcggtgaggctaaagcgacgactaacgggcggcgacgctaaagcggcggctaggagggagagggaggggaatagaagggagagggcgcctcaccgagggtggccggcgcggaggaagacgacgatgaacggcgacggcaagccacgggaggacgacgtcggcgggcggacgagcttcggggtgccctaaggaaggagaagagagggattagagagagggagatggaccacggcgaccggaaaccatggccgaacgcggcggtggaggtggtgctcacccgagtgcgagggaacgagggctccggcgacgaacctcgacggaggaggggtggacggggtggatctcggccacgcgaacccgacggcggcgacggcgcggtgcggcggcgagcctagcggcggctagcggcggccggagcagcgaaaatggcggcggcaaagggttgcacggcgcgggagcgatgggaggctcgagagagtgcggcgaaatggggaaaaagcgagagggagcgacggcgatgcttaaatagggggagagggaaccggacgtggccgggagaggcgggaatcgccggccgacttggggagtgggggaggagagaaa

SEQ ID NO: 30940 - DNA, 1924 bp, Oryza sativa
gcggcgcgagcgcgagatcggcgggaggagggagacgggcccgacaggtgggccccacctgtcggcgaccccgagagaggaggcggcagggcggcctggctgggcctcggcctgcggccggcccagtaaggggggggggggaaggaaggagggaatgggccggcggcccattcggaaaaaggaggaaaaagggagggaaaagaaaaagaaaaaggaaaaaggattttccccggaattaaaatattgcttgctcaattttaattggttaaaattatttctagagctctgaaaattccactaaaaatcctgttaatgagtttcgacatgtagaactaaagaaatttccacatgtcaaatccgattattatttgcattactttcttagggttttctcctgatttcaccagcattttcttagggtcatttatcaaaattacaattttggcttgggaggaaaacttcggggtgtgacatttaccttttgtataacatggttcattgcggagcaccagactgagaagtggcggagataagcccacgggggtcgctggggagtccatgccttgttttataagggggtgattatgatccaggaaaggtgcgctgtagtggattgtgttgtgcaaggggtattgtcacagctcctttccgaggtaccgtggtggtattgaggcacatggtgacatgttgtggggctgtgtcttgtgggtacagtggtacacctctggccagagtaaaaactattcgaatagccgtgcccgcggttatgggcgggttgagcaatgtttttcgtgattagtctcacacctctcacaataattatggatgttatacctggtaataatttgcttagctcctggtttggagttagatctatacagccgggtatggttgttcggaatggttgggcctgtgcagcatgggtgtgctgttcagtgttgattaaaattcctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggggaagacgtttggcttataccccagttgagctgcctgtgggagtggagccggagcttcgctagattttattttccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaggcttgccccttgcctctttgggaaaaggaagaggggagcgggggcgacgcggcagagggaggagggggctctgcctccgccccttggaggctagcaagcggagtggcgggggccgggcgatgacgacggcgatgacggcggggctgtgtggagcggagcggcgacacgggcgacaggcgcgggcaggcgcggcagagggtgacggcggcggcgaccaggcggtcggccaccacggcacgcgcgcgggcgggttgcaacgggaggcgcggcggtttgagcggcgcggctcgggcacgcgcgctggcttgcggggccgagcggatgcgcggctgcaggcgcggcagggcagcggggccgggtgacgcagacggcgcaggcgcggcacgggcggcaaccacgcgggcgcgcgcgcaaacaacgccgcgcggggccgatttcgcgggcggggagctcgccagggatggaggcggggagaaggagagcgaggggaagggagggcgctcggcgcgagcggctcacgcgcacgcgcgcgcggcgcgcgggcggagca

SEQ ID NO: 30941 - DNA, 8494 bp, Oryza sativa
  unsure (1)..(8494): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattgtgctttgagagcctcatctcatcccctttataatctctctctccatgggaagcaaagtaaggtgtgaaggcacctgagaggagagagcttgacaaagagcatcatgcatgatgcccaactaggcccacagtatggatggtgagggcgtgtagcaaaaaagaaggcataacctttttgggtgaaaaagaagaaaaggtcagggagtttgagacaccaatgaaaggaagagaaaggattagtcacttttgaaggcagaaagattgcactactaaaagtcatggggagaaggagaaaagagctcctgtcttttaagatgggctaattgcgaagtgggatgcactctgcagcaaagatgcccctctttgcataaagggagcaccccttctttctgtttgctagggaggggttttttggccacttaggattccttaaaaacaaatgtgaggtgccaagggaaagttggagccccataaaaggggcaaactccggctttgtatgaaaagttcctcaaagcatttttcgcagtggcttccccctttttctttttattagtcaagcataacaatcccttgctttctactgccaacacatttgctcattctttgtactagtaccaaaagaattttatgactgtactgcctctctactgttccatgtgttcataagcattaggtgcctttttttccactcaaggacttgcatgcattgcatgataacgaaaagattctccaattacaaaagaaggggctctgaactgaagtgacatgtgcaaaagcttctttcagcaacgatttgtgtcccatttctgataaacgaaaaacaatacggtccatcataagttaatgactttgtagataaccccttgctattggattgtgtttgctactactaatgaacagcccaacataagaggcagaaacaagataaaggcccagaccatttaggcctcatttggaagggccttaatccaggcccatccacatgtgatgggctgggattttgtgccttaatccaggcccattcacatgtgatgggctgggatttcgtcctatccaaacaaggcattaatttcgtactgtgcaacagagggatcagaaaacacacagaaggtgccttggaaacaagggttgcaagttgcaacactcaatatccagcaatctcgatctataattaattgagtacatataattgctaaaggcggtttaagtaacatgctggatagacctaacaacagtgattgacagaaacacggtataagcaagtgatgaagatattccacttcaaggaactgagaagcaagcagctatgcaggtacatgcattacatggttgggtcgaataattacagtgaactcggtaattctagcaaaattctgataaacacacgatatttgaccatttttgagcgccgtaaccgtaagcggggtgagtaatagatatgacatgcctgtggcctcacctgctgggaactgcactgcacgcgagctaggtttcgtaattagtagttctccacaattctgagtaccgacgaatatgttccaagagcagcgcttatggtgcccaatattattataccaatacttgcaacgacctgagattgaaacaaaaatgtcaaccacggatgtagttgacaaacaaaagaaacaaaaaagaaagagagcgatttttggtgttggtctaccacgcgatgtgcattttacctgggcagtcgttgctttattttgcctaatcttcaagaagcacagtgcaggcattatgacggcctgtaatcataaaaaaaaatgttgaaatgagtatgtttgttgctccttgttcaagggtttatctgaaaacaagattctagcaaaaaagagttcccccaggtattctcaccaaggatccattaagagccctccgagccttgaataacgcaaggcccaattcagaaatccaaggcatacgcagtgttgccaccaacacagatttataaggcccattccccattaccaggcttctgctatgccaggtttaaatttaagatccggttaaaaaaagggtttaaattttggttaaaaagcataggaaaccccaaacgaaggttttgatttaataactggatttaccatgccaaacaagtatagttaattgcacattagacaacatattttgactgggttgcgtaatacaaaggaattagcaatctttgagcatagaaccacctaaactgactccacactccacagaacaccagtttttgaccatttgatgggaaaaaaggtttagaagaaaaaaaatatcgcatctcaaattgcataaagttggtattttttcgagctaactcttcaaatgatcaaaacccagttttgtggaacattttaattatagagggagtgtctggaggtgtaagcggctaacccacaaatccaccggtttattttggcctataagtgggttcgcaggttagtcacttacatctttagtgtcatgcacaaaaggtacttataagtacatgatgttttgagaactcaagtagaatataggtggttaaatgagcaatttactaaaaaaaattctttctgagagaatgcagctaagagagtttcaggaaaaatgaagcagaattaggtacatatgccagaaaattgtgtatacgtaccgaaaaatggcataagaaacgcaatgcacacggttgatgcaacaagggcagtcctcagtataatagagcagattgtttcgttcaaaaatccttcagggcgcaactcctctaaactccgagccaatgggtttaacaacagggcatatctgttgtggttaaggatcaagccatatttttttttaaaaaaaaggatgaagcaattcctatgaataattaggcaggcacataaataatcacaatgtaatcctagaagccagaacactacaagttttgatattcaaaaggatacttggtgaaagggttgataacctgaaacacatgacaattcaatggtaaatattaagaaaaaaagaacagttgcagtttcaaaaactgtaatcaacaattctcaccgtggtccacagtgcgaccttggaggcaaatgaatgtttaggaagattcagagttatttgcgagagagttttatctccgaacatgagatagccaatgatagcaaacgagccatatattgctgtgcaaattgcaaaactgcacgacatgataattttagaacattgaaacatttaattactcaacatagttaatctgcatccgaatgaagttcacacataccatataaacagtgccttagtgaatttcgtgcggtctgacattgattggtaaatatttggaaacactgagtgcccagagtagcagaaaccataaatgccaatagcaaacggtataccacctaagtttactgctttcccagtcaaatgaaaccctacgccatcagtagcgccaactaaaacgacagagaggaaaacaagaagagttgcaataacaccacccgctgcacaagaaattcaataaaccttgtcaattcaatttgctgccttaatatcattaatgatcgcagtgagaaaaatacttgaggttaagagtgttgagaccagaaaggtaggagagaacccgaagatctctcaaccatactgtaggcaagactattagagcagtcaacactccaaagaaatgtttcccatcaatatggacgccaagccaatcaaaaccaatatgagagaaaattgatgtcatattatctccttccaaaataatgaattccacacaatatgactgcatccaatgaataacatatataagataatattttttttagaaaggattgaataagataaaagagtgctcagttggattgatcaataaaaataactagatgaataccccgccgcattgctacggaaaattaagttatataatatgtacaaataatatgtaatatgatcaaaactaaaacaaattggtacaattttgagcctaaaaataattaagattgcatagttttatgagagaagaagaagagacaatttgaaccatagatgtatcatctaaaggctaaaaataattgaggtgatgtggtttaatgagagaagagagaaatagcattaactacacttagtggggatgaactatataggattagatggaaaactttgcaacataaagccaggtgaaagctacttacatatagctcagtatagagtataatctgcaaaaacattaaagaaaaagaatcagccattgtttcttctctaccagaagttaaaattagttgcacaaaaaagtctgataaagatcaatataatatgcatttcatcagtcatgaggtatcaaacattgaaatgccatattttatagtttacaaatatgccatatgcactcctttttagtgggagtcagcattttagaaaaggaaaaagaaaatccagagcttgagcaggcaggtgtttctaccagttactgaaccttaagagagcgcttttcataagcatggatcatatcatcaataatcgcatacaagcaaggttatacaaaatagaaaactaatacagcttgcacagtggtggtgtctccattgtccaggttagtcttactctttgatacacttgcacgaattatttcgtttattaccatcaatggttgttcttacattgcaaaaaaaaaaaggaatagaagtttctacagattgtcattcttttaatttaatgaaaatcccagattattaaaaatgactttgattggtgctgagatattcggatgcaatcttgcatgcaatgcaatacaattcacttgataggaaagaaaccaggacttacagagatcagcagacgaccaatcctttcaaaagcagcctcgccaatgtctggatatgtagaaataccatctttgctctcaaaacagggtttcatcagaactcccgtataacagccaacaatagcaaacatagctaggaccgcaaggcctacccatccagctttatgaattgtaaatggagtggaaagaagtccaacaccagcaagtacattaacccctaccaaaagaacaagtaaacattaagcatttcttttatcttaggcaggtaattgagcaatctaacatgttaatgatagtaccattgaacaccgtctgtgtcacactgcatccttgagcgatgtagacttctccagtatgttgcgtaagtaacgagcttttcctatctattgctgaaccaagagtctttctcaagctcttgacagagtcttgcttcccatctagcttatcagacaacaagggcaacttcaggtcggatcccagactactacgaccaccatcaaggatcgagtatttgcttgtagagggacccaagtaaccaaagctcggagatgcagcaattgtataggtgtcagttgtttctctgcaaaacaaacagcatatcaccatcataatgtttgcacataacggttgggaagaaaacaaaacatgtggtttaacagctggcattcatcaagcttgggtattagattgccagcaaagcccttgtcttaatttttttgagacaaccaaaaacaactatacgatgtgtcagtacaaacaatcccctgatcgacaaagcaaaaatgattttgtacatattagtttaccatgatcagagtcagtgttaatgaaagcaaccaagtccacatcagcacagaactttcactaacaacagttggaattggcagagcaacaccaccactaaccatggcgcagtagagcacacaaatcaaacgatgtctgcacgaggagtcgatcaaacaaagagtgcagccataaaatgattttgtacgttaatagtttaccaccagcagaggtttttttttttttgaactagggcttgaaagcccccatttctattatcagaaatgcaacagtagtactctgctaaaacaagagaaaggaaaggagattacagcactcaggctgtgaattttttatagaccatagcactgtgtttcttaagcaaaatgagaggaattccaccccacatcccaacctggggacacagcaagcacagtttaccaccagcagagttagatagtgttaatggtcaaagttagtagtatcagaactagcgcaacaatatcccatcccaatcatcaggaaattgaaaacacaaccgggtccccgtcaacatacaattttcacaagcaacagtggaaactgccagagaaaccccaccagagcaaaccgcccccactaagcactaattgaacgcagtacagcagacagatcaaacgatgtctgcacggctgtagtacgagcgaggaggcgatcgaacagtgattgcgaccgcgcacgttgcggtttcagacccgtgctgtcggagcactgtcgaatcaatcagatgttctacgagtgctggtaaattctagaatccaggccactcggatcaaacatgaactgtttgcccgaactatcccaaccaaacacgtcaacgatcaatctagtattatccgaacaagcgctcagtccagtcccatcacgaaactcacaagttattccgtccagtacaattcaacgaaatctacccatcaacatgagatttcacaaacagcggttgaaatcgatagaactaccatgaaccatcaccaccaccaaaaacaaaaacaacgcagtaaacgaggaggaggatgaagcggagaatgcaacgacgtaccggtagctctgcggccactggcgggactggaacgagcgaggcgatcccaaaccttcgccgtcgtcatcccggtcgtcgtcgccgctcccgccgtcctcgtagtcgtcgtcgaagctgcggcgcgggctctcctcgatgtcgccgtcctccagcgtcatctcctcctcgtcctcctcctcctccttccggtgcttcgcctccgccgccgccgccgccgctgccatctcgcagtacgttcacagcagcgggcgaaacgcacaagtggaagcacacgaggttggaattggattgcgtgtggtggaatcggggggagagagagagagagaggaggcttcgggagagatggcgaagcggaggcaggtattgatggctgggattgggttggagtggcgcgaagccggaggaggggggtgaaatagaaaggcgggggagcgcgcgtcgcgacaagctggcagaggcgcggattggtcgaagaagccaaggtgggcgtgggcgcgggggtttattgagacggggaccccagtccacgtacgctgacatgtgggggaggttgcggtggggacgttgggttgaggcggtttcggcttgtgggggcgcgtgggcgtgtaagggcccgtttagtttccaattttttttcttcaaacttcaaacttgtcttttatattgaacttttttacacacataaattttcgacttttctatcgcatcgttttaatttcttcaaatttctaattttggcgtgaaactaaacacagcctaagagcaagtttaatagtatagcccactactaactccaattcatctatagccaatctaatatccaattcatacaataattacttactatattattaatacatggtcccacctatcctatatatattgtgtcttagagtctgtgctgcagctggctatagttttatagcacgctgctcttctctctcatcatttatctcattaaaatatgtttgtagctagctaatagtctgctattgtacatgctctaatccttagggctgacatgtggggccatgtggagactgaattatcgtagcgcagttgcagaccgatcagctgatttggcaacagtgatttctagagcacggaccattttatggatggaccgagtccctactaggatgggccctaaatatcccggggaggtccatactagcagggttcggctggacgacaaatggtagacatttgaatcagctgcacatgcacaaatcagtgaagtaataggctaagggcatgtttagttccttaaaaacatcacgtcgaatctttgaatatatatattaaacattaaatatagataaaaagaaaaactaattgcacagtttgcatgtaaatcgcgagacgaatcttttaagtttaattaggccatgattagccatacgtgctacagtaacccacatgttctaatgacggattaattaggcttaagagattcgtttcacggttttcaggcgagtcatgaaattagtttttttattcgtgtccaaaaacccctttcgacatccggtcaaacgtccgatgtgacatccgaaaattttcatttcaccaactaaacaggccctaagatagcctaaaatatctcgctgatacaaccaaatcacaaattgcagtgccagtgtccagtgtccaatttccag

SEQ ID NO: 30942 - DNA, 637 bp, Oryza sativa
ggatcgatgatcgatctgttccataataatagacgacgattatgtacagtcttcattacgcatgttcgcattggattattgctccacgattatgatgctcatgctgagtcattcacaaatcgcaaccacgatgcctatcgtcttgggctcttggccgacatctccggggtaaaaaaatttgtaccagagcattgaccacaagctaaattaagttccgatcggttaagtttatcccagatgtggttgatgtggttattggggaccacttgtacgaattatcttttatagtggagcctgacaatgggtctgacgagcctgtaccaatggatatggagaatctggatgatgggactttggagaaggaggaggggaatctgaaccaggatttggggaaggaatctggaggtgatcctggtaacaattccttaataggttctggtggtcaggttagtgagaggggtggtccttctataccggctgctcatttgagtctgatacctgaatctgatggcttgaatgtatctgatgaggaatttgatggcttagatgaggattctgtaatggttaagaaggttaatacccagcaaagtctaggggaaaagctcgctgctattcttgaagcagtaatttctctctc

SEQ ID NO: 30943 - DNA, 6293 bp, Oryza sativa
actacaccccgtgaatcaacaagtatattccctgcctatgatcgaaacaaagaatgcagcaatataacatctccataaacaactaattcgagaatatctgtgtgagatatccatgcatggctcaacagccatacataagaaaccagctgtggtgcaaaatgttcatttaccttcacatcacgatgtatatgcccatgatgatgaaggtactccaaacctttcaggacttcacgaagtacagttgcaatgacagcttcttcaaaaccatctggatagactgacttcattatgtgaaggcaagaccctccagccatgtatggcatgaccacccacaacgagtggttatttgtaaatgaacaatgtgccttcatgacgttaggctgatctatgagaatcatcgtctgagcttcacgcatgatgttgttctgcgtcaagcatatccgtgttactatcattttagacagatcaagcggcggtacgtaaatcgcaacaatccgagtataacctacttgcattacaactaaccactgcaacaatctgacatgaatgcagtcagcaaaaaaaatttgagctataattaactgtaagacaacagaaataatatatgaaaattttcgatacgatagtatgcgactcattggaccaaccgaccgttggacaatatcatccacaagtacatttgtaaaaattaaaatgcaccggaggataatagtttaattaatctgcaaatcaaacaggttaattaagcgagacgatggatctctctccctctacgcaggattgggcccaacaaacgaattggagatgatgtacgcgcaaacgtaccaggtcactgtttgtgcgctcgaagtcgagcaccttgacggcgacgatctcgtcgaggggcttgcagagcgatcggtacacgatggcgctgaccccctgcccgatctcctcgtacagctcgtagtcctccacgcggatcgggtacttgcgcctctcccccgacccacccaaccccgccgccgtcgccaccttctcccacgccttggccatgctcgatcgatcgccccttccctaccaccaccacccccacccgcatccaccgccgatcgacgaagcgtacggggacggggcgctggaattggaggagggatttcgaggtggaagtggaggcgaggagggggaggaggaggaagagcgggaagagggggacgtgtgaggtcgcgcgttgcggaggggagcgagagagagagagagagagagattgggggaggttggatcatggcggccgaagcgggaggccggagatttgtgtcgagggagcgcgccacctgggccaaggcccaagggaggcggcacgggggctacgtggcgtcgcggcgcggcgtcggatcaacggccgtgaggtttggacggagatgcctgtatcactgtgtgtggcagtattgggcattcttgcgtattagaacagattgaatttgaaattttgaattctaaaattagctgatgcatggaacggaggtgcttgcatgtaatttcgaatcggcctcgtttggtatgtgtattcagcacacaaatactaacggtactacatcggttacttatggtccatcggtcttagcgaaaatttgaattttaaaacttaattttagagttgattttaagaagtttcgtagtttactttttcaggattgtctttttaaattgctaccaacatataaaagtttctcatcaattatccttagctgcttcactcaatttatttattttttatatcttatcagccgtaaagaaaatgatggagttgtgattttgtaaaatgagagagttgcttgtacaatttgtattttgtttcagcgattattaatcatatcatgcaggaaagcattcatatgaagatgacatagatggcggtattagagaaggctcacactgccccaataattatcctcatagttataggaataccttgcaaaatgttaacttttaataaaattatgaaatctattaaaccaggcttccgtggtagtctacctgggtaggatactcggctctcacccgagaaacccgggttcaagtcccggcaccggaatttttgtgggtttctcgcccttcggttttatgcgtttggacccccataaaacgggcccgatgttctgttaccttcagaagactcaaatccttctctgatttcaaacaagacgatgtccgcaccacctgctacgtttgcatgttctctagttctccacgtatttttctggttcagagttcagagtgcaattttgcacagctcgtccatgtaggacgacaatacttcacacatgcactactactctactggagtacattggcttcctaactctgaagctgtataacacttctctccgacgaaacgaaacgaaccccaaccgaagtggtaaccggcgaggtcgccttcctttggattggattggattggattgcgactgaaacccccatcagagttcagaaacgccacacgggatacgctatgctttgctttgcttcagacgcttccgatatcccccacatcctcaaggaagcaaccagacaagcaggatccaactgactggatcattggaggcaggagaccttgagctggatatgaactatgaatatgcagtgaccccaacacccatatggagtactgtactatcttatctgaagaagagaacactcacctggacgtgggctcgtggcacaagctggatatgaagaggcccatgcttcatcaatcatcggagtcttgcattgcacgtcctaaaccttagcttcagttacaggtcactttaacttgacagcaacgaccaatggctttaggttattttccctttacaggttcaagttggagccaagtgtgtaaatccaacagagaccagtacattactcgtatacaacaaaacaagatcaagtgatcaacctaaacaagttatttggctaaggccctatttgttttagcttaaaattattgtaatctaaattattaaatcagattactctaaactggattataataagttgacataaaataagctgcaagttgtttgtttctctggattattagaggcatctaaaagtagtaggtctttaaccactcaataatctgaaaaaagctcctctataggagattattggattatactaatctgacttatagattataataatctagcataataatctagttgtttgtttcagcttacttctgataatctagattataataatcataagctgaatcaaatagggtaaaaaaaaacaggatgcagttgggcttaaaataggtttcagattagcaaagcagtacactttttccgtcgttgtcctcttttattcctcgcgccattgcactctgcacgctgcgctgcagcagagcagcgggttttgttgcttccctcccattagatgggtgggggcccgacctggccattagcaacagcgagcgcactagtcctccactgcccaaagtaaagtgctccatgtcaacaggtgaggccgtccgggagatgatcagatgaatcacaattaacttctacttgtatttttattgctatcatgaaacttgtcacgactcaccaccgcacgaggcctctgatggatgcaattactgtagatatgtttatgttaatccttgtgtacgtcaaataaatcggcagtacgccagtacgtagtagggcaatgacaacggacagtccaaaccgacgtcgaatactctatagtatcccggtcgacgggtcgagagcccgaaacggtgcaggcacagcacatttggtttcaggccttttcaggttgcagatgcctcgactctactacacgcgtgtcagcgtcttgtttgcctttgcctgggttggcgcgacacagaatcggagatgccaccggccaattgatcctggactcgtgcaacccgatacaaaatgccacgggaagctcgggtttgccgaaaattcacgggaccttgctccactggtcgcacatcccgatttcacaccggaatagtagccgttttactcgtttttcccctatcctgacgtagtgcaagatcatcatttctactgcaatgtgcagagagcaactcatgctcgggttgcaaatattaattcaaaacgatgaatcatcaacggattctcttcaatttatttgctctaccagatttacaattaacagagtttggaatacaaatatttttttattaatcaaatcctgataattagaagcgcagctcatgagggtagatctcaagaacaaaacacattcttattccctatgcaataaagaaaggcagttcgggtacagctcagaacgacgagaggccaccgaccgcgttgacgggcccacccatgtggtccaacgtgggtttaggtgggccccaccccgacaatcccgccccacctccatccacagccacagacaggtggtcccacctgacgccataaagcaacccggccccaccgcccagtgccagcgacgcgggccagctggcgaccacctcacgcccttcgaggcgccactcgcttttccccttctctctctctctgcttatcttatcacattagaaaaaggcccacggttggctcatatttacaggagactgccactgcttctcctccttcctatttcttctcgcattctctccctcgtctccgggagaaaattttgcgggcggcgaaacaaactagtaatcgattcgaaatttaaacgcattgttgttttattgtttgattagtttagctcaagaaagattcatagctcagctatgaccagccagattacacacaaaaaattcgagggtgtgaaacgttatggagaacgaaatttacagaagagcatggagaagataaagggaaaaggaagagaaaaatgctgctctccattgctttcttcttcctccctcccctcccccaagaaaagaattccccccagtattccaaagaacatcctaaaatatttcccccaaaaaaaaagtcgaaataagaatgttaatgttttgatcctggagtggaatcgaccactggatggccagagaataagaagaaaaaaagaagaaagaaaaagaaaagaattagcagaagaattagggcggattatagtcacaagttcttggatcccctggtgtagccgtagtaggagaggtaccacttgacgaacttcttgagcccgacgtcgaggttggtggtcggcttgtagccgagctgctgcctcgcgagggagatgttggcgtgcgtgaatggcacgtcgccattgccgggcatctcgaccacgttcttcttggccttcacgcggaggtgcttctccaggatggacaccaggttgggcaccgtcaccggcgaggtgttgccgaggttgaagatcctgtagggcgccggcccgcgcttcttgcccccggtgccggtgctcttcccggccgtgtcgagcgagccgaggcagcccttgacgatgtcgtcgatgtaggtgaagtcgcgggcgaggtcgacgcggttcttgccgcggtacaccgtgatgggcttcccctgcaggatgttgcgggtgaaggagaagtaggccatgtccggccgcccccatggcccgtacacggtgaagaagcggagtccggtgatggagaggccgtagatgtggttgtacgtgtgggtgatctcctcgccggccttcttggtggcggcgtacagcgacgccggctggtcagtgcggtcgctctccgtgaagggcaccttgtcgttgaggccgtagacggaggaggaggaggcccagacgatggccggctgcgggtcggcgtccttgcatgcctcgaggagggtgacgaggccggcgatgttggagtgcacgtaggacgccgggttctccatggcgtagcgcacgcccgcctgcgccgcgaggtggagcacgtgcgtgaagggcacgacgtcgaagagcttggcgaggaggcggccgtcgttgatgtcgccctcgatgacgaacaccccgtgcgaggcgagcagcgacctgcgcgccttcttgagcgaggggtcgtagtaggagttgaagttgtcgatgccgacgacgccgtcgccgcgcttgcggagcgcgagggagcagtgcgtgccgacgaacccggcggcgcccgtcacgagcaccgacatccccgcgcccgccgccgacccgggcggccgcctcggcgcggcggacgcgcggatctggcgctcccagtgcagcccgccccaggaggcggcgaagtacttggacgaggtgtcgacgaaggactggaagctgaggtacgacgcggtcatggcgacgaggaagagcgcccagaggaacatggt

SEQ ID NO: 30944 - DNA, 19911 bp, Oryza sativa
aagtacttggacgaggtgtcgacgaaggactggaagctgaggtacgacgcggtcatggcgacgaggaagagcgcccagaggaacatggtgctggtcgacgcgaagcagcggtggagctggcggttcatcgccgtcgccctctcgatcttcaccttccccggcgtcgacgggaacatgtcgtcctccagcacccgcatcctcctcgcccgtctagaaccttctagattaccaaaatcggcggtgccttttggatcgagggagttcttggggggggaattcggggattggaaaaaaatattattattagggtggggaaaggaggggggcaggggctagatgtgcgcctgcctgaggaaagggtggagatgggacgaggccggatataaatagggggggaggagacgcgtgagcgccgccgcggcagctgctcgctgacggtggcggccggccgcctggctggttgggtgggtggttggttggttgaggggagggtgatcggtttccgtttcctttccttccttttctttccttcctctctttgttgtgtggaagggagtatttatttatagtagtttgttgctatttttgatggatttattttatcatatattgatcgattgggaatggctggttttgtgtagtaatttgtgtttccgcgtgaagagtgtgtgaattaatctgctgtgaatggcattgcgtcgtgcggtaataatggtggtgaaatgaattcacgcgtgtggagaattcgacgagtttaatggaggaagcttccattgactgggattttatttatttttggataagttgtttttggaatttatttattgggggggggggggggggacaataattctgcccgtagaaatcgtgtcacatggggggtcagatttgtgtgttttagtttatctggaagcggtgtttaacgtggtcatgcaatggcaatagcgtggacagtgtgattcatcttattatttccaggtcttcaggagcagattattttacggtgaatagctaattcggtcattaaacttttgttacgtgttaaattagttcttgatgtttcacatattctgaacaagctttaaaagattctcgtgtggcttaaaacagttctcgaacaccattaaaaatgccacgtggtattaccaagttattttgcacataaaagtcagcatttaaatctccatatttacctgttacaactatgggtgtgttcggaaccctggttcccaacactaagtgcccgcacggaaaacggagcaacgattagcaggtgattaattaagtatttgttatttttttaaaaaaatggattaatttgatttttttaagcaactttcgtatagaaactttttacaaaaaaaacgcaccatttagtagttcgaaaagcgtgcgcgtgaaaaatgagggaaatgagttgagaagagagacggctgaacacagccatatatggtgcacaatgtttagctttatattttgagtaggaaaaaaaagtgggtgagagaagaaaaaggagacaccgaacataaaacaaaggaagatgtcacattgtttaattaccaatgcaacatctgtttcgccaatgaccaaaaactgaagacccaaagggcaaaagtatctgccaggcagggagtccttttgattcaactatactaagaataacaaacccttggcgacccccaccaaatggttgggcaaaatcaatatggatggggctttctcctctaatgaaggaaatggagcaataggaattgtgattagaaatattgacgggagagtaattctaacgtcctagagatttttcagaaaatgtgtggcagcagaggaggttgaattatttgcttgtcgtgaaggcctaaaatgtaccaatatcggtcgagtattgagtctgactgtggcacggtaattggaagtaagcctgctaatggattgagttggaatggcttaaatggactggattctagtttggattatctttgattgggtgaaaatgggttgctatttcaaatggattggatcggttttggtgacacataagtggattggtgtggcctggatttgatttggtgatatcgggttgaaagtggatttaacccatggatggcaagtggattcctttaacagaccgagtttgactactccttgttgccgtcctcttcgtctcgggagaggtcacacatgacctggacttggtggcgacagtcagcggagaggccgcgcatggcggcaccgtattcgtgggagtcgaggcagttggaacgtgtctcgttgcatctcttcgatctcctcccgtctcgccgctagagctacccgctcttgtgccgactaggcttcttgttgttgccccactgctcccacatggcgattggatttccttgccgtggctggtgatggcccgtgctgagcctagacaacatctactacggcggggatggtgccgctgggcatggtcaccatagctaactgcaggtgtgcgatatgtacaaagggagcagttgtgtcgtcggcccatcgctcaccgccgccaccgccgaggagacggccttagcgagctggctggcctcacgatgctcctgcgcctacgtcgacgtgaccgtagctgagaacggcgctggcgtcatgtcctctgccgtcaccacgacgccacagttacatgcatgcaacatttgctctatccagctgcgtcgccgccggtgagtacggcatgactattgaaggatcgaagtggatttgatgtaggtttaaatggtttgggaggtggattgaggccataaaagaagaataggttggttcggtttagactaatgaggaaaatggattggtctggtttggattttatgggatggctagtggattgggatggtttgggataacattgctagctgttgtggattggattgaatatggggtggatcttgcccaattggtaggcttaatttgggaggttattggctagagaggaagaaagatcaaggtggacctttctgctgcgcgcaacgaatgatacaatgtcatttgtttaagaagtgtgatctgtcacactgtaaaatagagtgtaataggttagctcatgatattgcacagcttgcaaaataatcaagtcagaacgcagtttggtgtgagactatcatggcttgtgttatgtatatgggcagcatgattgtaatccagttacttatcgataaaactctcttttccaaaagatatgccgttatgttttgtttgtttgttcttcattgtttttccttttttttatgaaaaatgtaatagtagaacaaatattaaatgctaaatttgtatgaatggatgatgtggaatgaccattggcgtttctagtaagcccgaagactatattaagccacgtcagggaccaaaatgacgttgaagtgaaagttctagggttatcaaccccgttattttgtccacggcggatgacatcttttttctcgttttcttgttccaacttccaaactcacacagagccgacagaggttgctcatgcagtcatgctccagtgctccacgctagtcagtgccatcgtggcaatggatctgaaggccgggggttgaggaaatccaatttagaattcatattgttagacagaccttgctagttgcctttcttgttggacccataccgcacgatcttctccgtgtgctaatcgcctatcactgaaaccttcccctgcgtttgtttgctccagcctccaggattttatggcgagtactcattctatcctataaaaaactaacttaatagctaatggcatgtatggttagaacattagtccattagtccctataagagaagcttatagggactgagttgtttctttccacctgctgcccccactcacaaccctatcctctctctctctgcattgttttagaggtaacatgttctttttacagtgcaattaataatctttagtctttttttaatccctgtatccaaacagacatggactaaagttttttaagtcctacgactaaaggatgcaaacaccaccctaagattgatatatcctactaaaaatttagcggtttttttttatggaaagactacatgcgccagccggccggctagatcgtttgctagatttgtgtctcgcccacgatcgtgtacagttggaagtcgcccacgatgcgttgtcgtaaacgacctcatctacctacgcgcagcccagcaaccgatcgagagagagctcacggttgatggccgccgcctcctgcattcattcaggtaacagtagtagtgagctacctagcctccctaccagcagcacgagaaaaaagaagagaccacatataatgttgggttgttggagagaagccttggattcacttccaaacaaaggatccgtcccaaaattccccaatccaatcaacacagaaccagccagaacccctagagggatcatctcatgtgcgtcctcttgacgacctttccacaccccccaagccaccattgctgccaaagtggcaaatgtttgcatcccaagcctgcaatgccaagcactggctgtgcacggatacgtactgcccatgtgacgcctcctacccaaccctgctgcaagtgctcttgctgagtcgctggtggtggcctagtgcatgcatgtctcagcctttcttactgactagtctctctgtttcataatataacaacatgatatgaaatgagatgcatcatattgttacaaaagtgattcatcgtactaggataagtttaacacgtactagattgttgtattatgggaggtggcctagcgcatgcatgtctcagcctttatcactgactactctactctgattatataacaacctaatagggaatgagacatattctaatattacaaatgtgaacatgagatttgcacagattcatagtactatgatatttttttattttatactaaattatcactccctccgtctctaaatatttgatgccattgattttttttacacatgtttgatcgttcatcttattcaaaaacttttgtaaatattatttaaaaaattgagtagtagtagtatatttaacaatgaattaaataatagaaaaaaattaataattacttaattttttttaaataagacgaacggttaaacatatttaaaaaaccaacggcgttaaatatttaaggagagagggaggagtattatactataggatagaggatggagggaatactcccctagctaactgggtgtccccagcctaatcaacactgcgtcaagcgaccgtaatgtgaagcacggggggcttttccccgtgtttgggtggtcaaaagctggcttgatctgtcgttgggacgtgagtgcccacatggagtaaacagtgggacgccgataggatcacttgtgaactctgatgcgtgcatgcgtgaatggatgcttttttggagattgcttccttatgagtggcgattaattaagccagtgatatactccgatgagtgagagggtgacgtggcactaaccaggaacatttgtagttgtaggtggggggaaagaggagaagagcattggtcatcatagctcggtggatatggaggccgatcgaacttattcttctttttttggttcggttctgatttctttttcatcattcctgcgtgacacatgagagctacggtttttttttttcaggaaggacaggtccaacgatacgatggattagtgcgctagaagttggtttgatcgagtgcgtaagcttcaagttactgcaaacttttgctaatatgcttatccaaaacaatgagccgtttctggctagtctttacgaaaagtattttgtattttttggtcaaaaatttaaattttatcatctacagttggtacagttgggtgctgttaccaaatctgattggttcatctcgatcaaactaatctaaactcgctctcgccgtacgacaccggacacacgggccccttttcactttgttgggcgtccaaacaaaaagaagccaattgatcaggacagctataacatgggtagcttgcaaatgaaaccttcaactgtgccgttaaatgacaagaaaggctttaatttccacgcgctccaatctccgtcgcgaccgcaacaaaaatatgcatatccatccatctccgatgatagtaacatcgtgacatgatgacacgagtaataaatttctgtgaggttatccctctaattataggttagccaataataatactaatatgacttcaattaaaattgttaacaaattagtatttgcaatttttgaatctgtacataactataaacgatttcgggttaaaatttttgcaacctatgtaactataaacaactaaggtcctatttgtttcaacataagattgttataattcagattattgatccacgttattataagctggattataataaactatagtagaataagaataagttatgagttgtttatttctctggattattgggtttgagctaattaatgtttataataccataagctattgcggagtgggaggaggatgagacggcggcggtgatgcggctaggggaaggagcggggcacaggatgggtgtcggtgatatgggtctggaggtatcaggaccatcgggaggaggctgcccccggtagccacgtgcaccccgccagggggatcggcctcctccgcccacctaaccgcatttaaggcagtgtgaacgagcgcaccatgctacattaaatgcagtgcgtggtgcgccttgttgtattgtgaccaatctgggaccagtcgaatgaccgatgtggccagggtagtacgcctgtgcactgtcacattgcgtatcacagccggagacggtttgcctaacccggtcagcgtaagatttctgtttcccggcgcaagtggggacccaaaagtcttcactcattaaataccgaatggcatgcatgtcccccgtgtcaactggatagatttgatgggccccacgccgtagcaacgcgtgcaatagacttccaaggcaagcaacgagacatgcatttaatgtgattatcctccctggataggctgggtgggcccatgtagtaaccccttgagatataaaaggaggtccaggccggaaaggctaagggacgatcgatcgcccctagcgcggtcccccctccctccacgtggtttctttttttgtcaccgtattactttcttattttagtaaatttatgcacctaaagtttatacatctcaagtttacacatctaaagtttagagatccaaagtttataagtcaaaagtttatatatctaattcaaatttgaatttgaattcaaatatttttttatatattgtatttctatacatctaaagtttatacacctaaagtttatagacccaaagtttataagtcaaaagtttacatacccgattcaaatttgaatttgaattatatccaattcaaatttgaatttgaatttgaattcaaatattttttatatatagtatttctatgcatctaaattttatacacctaaagtttatagacccaaagtttataagtcaaaagtttacatatccgattcaaatttgaatttgaattcaaatattagtttataggcccaaagtttataattcaaaagtttacatacccgtttcaaatatgaatttgaattcaaatatttttatatatagtatttctatacataaattttttcaactttatttttttatttttaaaaaatgtatggtgtagtaggaagagaagatgggaggaggaagggagagagtagcttataagggatgggggtgatcgcctggagcggtcacccgcccattagccacccccggttcaggcctatctagggagggatgagcctttttcactaaagcagtcttctgccctcatcatcaacagcttctactctaacaaggagatattgtaatttctcacacaatcagctaagcacaagagtagagtattatgcttcttagcggcccgaacatgtataaacccctattatctcattgttctcgaggaatccgatctcactgagttctcgaatctcacccgctgcctccggccaaaccaacaaagtggggcctcactgtcccccgctagcggagttcaccctccaacaatggggcttggggaaggatttgcgcgcagggtttgggtttggagaatgattcgcgcgtgactagggagatagaaaggaaacggatgcgttgggtttgatagcagtggtgggtaatttacataaattttttaagtgcagtgggtcttcgtgtccgttgcacaggattctggaacgtcaattttcttatcttcttttttttttaagaagaaagatattcattacttagcttggatcggtcaaagactcaagcgtcgtaactttctgaagtgagatatacggagtactatttacatacgcaaatccgagcgatggcgactggcgagaggtggtgagctaaggtatctatccgtacctgcgccgcgcaattgactttcccggccgcgcaccgcacgtcgtggctgcgtttcgtttctcggtctcgcgcgcgtggtgtcacgtcttgacccgccgctccgacgatctcgcgcgtacgtacgtacgtacgcgacgacgactgaatggcaacagcagcagccgtacgttgccgtcgccgtcacgcacggcgcgacacttttgccctcacctcctacgcctacacgtagtacatacatacatacacgactaaaatacacgtacgtagtacgtaccacgagactaggacgtctctcacctaatgggccggcgcgcctaccgtcatcaaggcctgaaaagcataagttcatgtatatatatgggctctctcatcgaggcccgattcagccgaggccgaggcgacacatcgtaacgggccggaaaccttattgggcttcgtccttgggcttagaaaatccagtttccttcttccaattccggccagccttaacacacaaaacagctagcgcccgttgtattgcagccgtggactggacacgctggaggaagcatcaaaaccagtattttacgcagaagtaaacgcccagaacgcccaacttgcccaggactttcgtcatgctgcagatgtcaccacctataatacactgcccggatgaacattccaaacccccaaccatatctcatcgtaaaatttgcagctcgtataggacagtaaacgaagaaaccatcgtcgtacgtcgtccatgtctgacgcccctcccatggccgagaaaccaactgtaagtatgccaatgtctgcactttttccctctcttagactgtgtttagttccacgctaaaattagaagtttgactaaaatcgaaagcttaaagtaaaaggtcggaagtttatgtgtgtaggaaagtttcgatgtgatgaaaaaattggaattttgaagaaaaaattggaactaaaccaggccttattcgattcttgcatctctcgctgatctgatgagtatttgcagatcaaggtggagacgacgccgggagactggaggttcccgtcggccaaccagaccaagcgatgcttcacgtgctacatcgagtacaacaagcaagttcgccatcgatccttacctatacagtaccccctatatatatatatagctagatagattgatagataggagtacagtacatatatatagcgatgtttcatctgcacgcctagtagcttatagcacgcatgttcatgaagctgaagtaaccacgatgactcatatccatatggtacgtaaatcctatctataattctgtatgcaggtgcatagaagccaagggtgaagggtccgacgagtgcaccaagtatgccaagtgctacagatccctctgccccggggaatgggtacgtacttatagctaatggaaatattttacatcttcggcttctgttataaaacacacggtaataatttgttaaacaagaaactgagacataagatagtttacatgtataagttattctatatcacgtactctgaaccagtagcagtacacaatacagtaccagagagatcgagatcgatcaatgtactccttcctacttcctccgttttaagttataagactttctagcattatattgcccatatttatatagatgttaatcaatctagacacacatatatgtttagatttattaacatgtatataaatgtgggcaatattagaaactcttataatataaaacggaagaagtatctctcaaatggcgacaaagaaaaatatgtatcgcatatctatgtgtggtccgtgaagatgtagatgtagatatatatagtcaagacaaggcatgcggctagtgtactgctagtggttcatcctggacagaatatatgcatgcatgcacaagccaagcaatatgcaaagaagcaggcatgatacatgcactctagtaggtctctagccatacaagtagccaagtagcatgctgacgaaaacgacgcgagtagcacggccatttatttacacgccggaattgaactagctatagctaataaactcgccgtgtacagagagtgtacagtacaatactcgatcgcagcttggtcctggctaccactgtgcagtgccatttttgttcgattagtagcactgttcctcactggcttgatcgttcgaaactgtgcttgattgcatgcaatattccctagctaagctagctgtttgcgaagacaactctgaataattctcacatgcgtgtttcttgtttggcgttgggattttgtgtgtgggtgtgtgtgcagatcgagaggtggaaggagcagagggcaaacgggactttcgctgggcctctctgaaacggggacagcgaccgatcgatcgaccatatctctacatatatcgatcggctacagctaataataccaatcaatcctgtatgcaatgtcgtctcgatcgtcagggtgaagcctcgtcgtgacactcctagctagtattatgtacactcatgacagtgtcagttattaattggttgttgtgtctaattgcagtattagtagcgaactagcgatgcccctgcactgctgtacagtgccgtgacaagctactctgaattttttagatagtacgctagctgcacccgtcataaatttggttgtctttggtttcggttggctctgcttccatgttgctctactactagtctactactaataatgggtaattagctactcacaggtcgatcagtacgttgatgccacatatatagttgtaatagtcatatggtttgggtgaactagctaggtagttctatatgatacacgaggaacaattgaccaaactaactaatcagacaaattaaattgctacatggagtgcaagtcgaccaacgacctaaatcatgattgccagctagtagctaattaagacatacagagtatgcatgcatatactgatcgattgacttgccaaagactcaaaagtactatgaagctggtcaatcaagagtaaaaccacacacacatgaagcatgcataagtagagtacacgcgtcgacaattctcacgtccttaattttcaattttaatttctgggagcttaatttttcatctagacgagttcctccgttgcataggtcgttgtatatatcgccatcatctgcctgtgcctcgcatgcttctctttcgctatatcttccgacacgcatctccccatccctatcagctagatttatttatttttcgttttgagttgagatgaactagaaaatagtaatatttttaatttatcggctaaacaattaatattactcctagtcaaaatgcatggtgtgtggtagaaataagccctagctatatatagctatatataaatatataaactgaagactactgatcactactctgactactgtacgttccactgatcgctgccgctagtgttccggataaggtttaggcaattgtaatgtgaacagcacagtgatcagttcattgaataaacccagcgaatcatatcgatcagatggcaataagagtcaagcatgtcatcagccttcaagcttcaactactgtactggactgtgggtaggctctgactgtcaatggacgtcagaaagaatattgtaattagggcatgtttagatcctctaataaaaattttcaccctatcacatcgaatatttagacacatgtatacattattaaatataaaaaaaataactaattatagattacatgtaaattgcgagaaatcttttaagcctaattgctacatgatttgacaatatggtgttacagtaaacatttgataataatggatcaattaggcttaataaattcgtctcgcagtttacatgcggaatctgtaatttattttgttattagtgtacgtttaatactttaaatgtatccgtatatccgatgtgacacgctaaaactttatacccatggatttaaacacccctttagtgaagtgagagagcatcgactctctgtcaggtgtcagatagctaaatggagaaaactgaaaagcgattatgcttgtcttcagttatagttggctgacctggctcagctcaagcacttgagtagtgtcacgcagagaaacacttagagattttttggctagctccacaagacattaggctagatgacttgggttcgaagcctcacctcttctaattatttgatattagatcattccctaatattcgtgtttttttcaccaaaccaagcagtaaatggagaaaaatataattaattgcaccttaattaatggattaatgtttggagtattgggagtactgtcattcttccttttagcttagataattgccgtactctcaacagaacaaatgcattacatacagtcatacagtgaagagacacttgtaccaaaagaactgcttcattaattgcacatacgttacgacatcctttatacatagctgttacgtacgtagacatgtatacaaggtttgcatgcaatttgtagaaaagaaaaagatcgaatcacctgacaaatatgttacatgacactatacttacatatgcacattaccctcaactcgggcatcactcatgcatgatctgaaactctcagtgctaattaataaagaagaagtgatatatatatagtagatagagaaaagaagaggaggggaagttaacaacaactacatatgattcttacatcaattgattattgatcatgtcttcctcactgcatcttcttcttcagtactactactgttacatgaaacagcagttactagctagctagttacctgcaaattaacaccaacacatgcatatccatggctcagttagttcatgcatgggtgtgtgcaatgcaagcacggtgaggaaagtttatgagatcgagtagcttaattaattaactaattacctgagtttttgagtttttgttcttggagagtcctcacaagaagctgcattacatcgacctgagctttcagagacacggcatagtctagggtttcccccagcaacgcgcacatgtcgagagctttccctcccggcacgatctctttcagcacgctcgccctcttcctcaccatggccctcgggacgccaccgccgccgccgccgccgccgccgtacgcctttgtggtggccgccgtggtgttgttcgccggcctgatcggccgccgccgccggcggatcaggctcctcctcacgatcttcctgcagatcatcttcctcggcgacggcgacggcggcgaacggtgctgctgcggcgcctgcgcgagctccgccgccagcgaccggctccagcacggcgcggcgcccctggcggcggcgagcgcggcgtcggcggcgcgcttgatggcgctcttcctctcgtggaaacccatctccccggacgccacgccgcccttcctgagccctaggatgaggttccggagcagcgcccgcttgaacctccccgagccgccgccgccggcgccgccgttgccgccgccgccagcttgcactctagctgaaggcatggtggtgaccaagcaagctcaaacagctgctagctatggtaggtgtacgtgttgcagcaaagttgaaatggagcaagaattaatcctacaacgagagaaatggaaatggatgggagggagtgtatcagaatcgaaggagcaacatggacatataagtaggcattggcatgcatacgcatcaattatgcgtgcacgtactatctactcgttgatcatgatgatgatcttttcgtacatgtatgtagctaggttcattggataagatctctggaatgtgagttggagagaaagggaaagagagagaaatagagagatagagctatctaactatcatcacgagaggagaggggagcccatgtctccattatattggcttagctatagggaaagagaggaagaagaagaagaaggttagctaggactaggaggactaggagaggagtattggctaggaggagagatcgatcgagaggagacaatgcacatgcatgcacatgggtggctcgcgctcgctgcggcccacgcccacgcacacatgccgcactgagctagtgagtttaataccactcgatcgcgcgcgtgtagagagagagagagagagagagagacaatgcaagcagcgcagtggcagttgcacagtgcaacgcccctgaaggccctgttcggttgcacagtgcacagttgcacagtgttacgcggcgggaaatgaaaagtatattaaaaaatttatgatagatataataagagatcgaaatcgaaatttattctgggccgagaaccaatttactcatgatagggacaataaaagcaggtacaatagcaggttataagccagctgcaaacatattttaaggagataaatgagaagagagaagagcagcgggctacagatttgtagccagctgtagcacggactcaaagacgcattgtgtgtataacaggtgggaccatgtattaatagtgtagtatgtaactattgtatgaatgaactattagattgactatagataaattggagctagtagtcgactgtactattaaacttgctctaagagaccagaattagttccacacctcttgactagtggattgattcctgatcttttattattcctatcataaataaattggttttcggcccgaaataaatcccggtctcccattgtatctatcataaattttttactacatttatcattcctggcccggattgaatccaagcaacaaggccgaaatgttgagagtagtgtgggggtggggggaaggggtcccttggctggatatgagacgcggccgtacgaacagtgttgcaagttgtaacgtagtcgatgggtagcatgcatgaatcttacaagtagctatagcacgctctcgtgcctgcctgccttggcctggggctgatttgtgcacacacttgcctgacaacttgcctgatctgtcgtctgaaaatactatctgaatcgaccgtagaacaacctagctgcagacatgtatatatatccgatgccctccatactccattcatccttaaaaaaaaatcggtttctaactacgaatctagacatcggctatgtctaccttatagcaactggttaatcctatatatgttacgctcatgtctactcgttaattattccatttaatccctgatgctcagtaatactatactcttaaaattgatagccaagtgtgttttgttctgttttggatagcgtagtaactgtagaattactggttaatctatatgatttatcttagcttttaatttaggtgatttttttaaggagttgggaactagtcccgtcacttgatatattgtttttgttttcttttctatccctcaacgcgaaaagcctaaaacttatttactgtgtatctattgtaactatttttattatacaaattattttcacgaacacgtagaaagattgtatattaataccattgtaaaaattacgtccaggttcataattaagtgtttctttttgcgcgggagagggggtgtgttattgtgcaggtagcaaaaggacgacgaaggcttgaccagaattaactggcggaaggacctaacgactactgctccagattaattaagcttcagtcgtctatggatatggccatgataagctacacgagttagtacacgtgtaggcagtacgacacatggcccggccggccccctgattagcgggatgctttgtttgcttatcagttatcaccctcctcgtattacgacgacgacgacgactagtgcgtttggtggcgagcatgtgatgtgagtagtgttcatatatgcatcattgttaatttcgctttggttcttccctactctcttgagacgagctagctagattaattgttgatcagcagctaattaactgtgtgtgcctattagtaacacgtatgcaagctagtagcattgttctcataattgatcaatgatctctactggctactgctcatgctgaactgattaaactattgcatatatatattcagatagcagcacacgtacatgctgcactgcaacacgatcgaccgatcgagcatggattgaaagcttagaaaccaataaacctatgatcgatgatggatcgatcgatcggttggtgcacgcatgtggtttgtgtccttttgtcatgtgaattaattgagcgaatcgatcgaagcttttgctgctacaaggcaagctttactggggatggattctaatagctcgagtggacgtccacccgtttattgcatgtcaactaaatggctacgaaaaatttttaaaaaaattggcaagatagatcaatatgtaatatatcgctctataaacatgcaagttaaaattcaacttctacaagttgcaacaaaaataacaaatttaactgtaaatatacatatagtaatttgagttttgtttgttatttttgttacaatctgtagaagttgaattttaacttgcatgtttgtggattgatgcattacatattgatctatcttattcatattttttcaatttttttcataaacatttagatgacatgcaataaacgggtggccatccactcgggctgttaaaatagtttcccagctttacctcgttttcgctagaaagggataggcagcttagtatagtgcaggccggggccgggctctggcatgatccggaaaacatgcacgcaccagcgaacacgagcaccaccccatctccagcctctgaatttctcaaacgccacagcaccaactgctagctaggagtacatgtgcagtgtcgtctgttcgccaatttacctaagcgatcgatcgactgctaaattcaccttcacatatacagttgtgagtattcacatcacaggtaattaagcagaagcatatatagaattaagtaggaccatggtggtgtttgaaacttatgtagataaagataaaaattaagtgttttatgcaaaacgaggtggtgttaatatgcgattaatcgagttttaattattacaaacttgaaaaatatatttatctgatattttagagcaacttccatataaaaaattttcatatgaaaattttatattgactgaagtgccgtttagcagtttaaataacgtgtcacgaatatctaaatttcctttcaatttttgttggaaaaaagaacaaggcctgtgtcggccacgagatagataacgcctggtcgcctgctgccagtgccagcacagggggccggatcggaggaaagctcacagttttgatcatctgatcaatgccatggaacgggttaaaattcagagagaaattaaggaaactcaacggtatgccaaaaaacccttctcaggatcaatcaaatcatgatatcatataatcgctcaccgatcaagagatagggggtcccaagcacacaggcacatgcatgcaagaggtcgtagtagtggctgtagtacgtcttgtagccacgatctcctttcacctcaacaagacggagaaagaagtagtaacagcacttgtcacatcgaccggcgcgctgctggcatttacaatagtttcccgtggatgcagtagtcttttgtcaattgctcaatgtgcacgcacagtcggtagtattactctctccgttacgtaaaaaataaatctaaaatcgattgtgatatattctaagctcccatcaaatggcctaataatcagccaaagaaaaaaaatataaattttaaattttcaaacttaattttaagattgattttaacatattttaaacgtagtttctttttccgcattggcttttaagtcaacatgaacacatataaaagtttttacctacaaaaatcatttttaagttaccatgaacccatatataaaagccaaacgatgtgaccgctagtattataaacctagacagatgtatatctatattcgtagtggtaagatgtgtcatattcggtattaagggagtacacggtacgtgcagtgcatcaccgtgactgggttgctttttctgcataagttgtgtgcatgtttgcaacaaccaactgcttacttccaatctcgcatgttacttctgcaattctctgtatatccctgaatggtggcatgttccaaagtcacacatatactccagctagctagcactggcccaccatgcacgttgctaataacagtacaacagcagaagcagcacagttaatttccatcatcatgaattgaaccctacatatgtctgcccatgatcactttcccatgaaccttcactgcctatatatagtaatagaatccataaataaactacataaaaagttagctggattgggccgcgcttgcgcgagccggcagaaattgggctcctggcacgcggccgctacagaaatttcgccatattgggccgccttagtccacgagccgtattgggtcgttttaggtggctagcccacgggtcacgagccggccagcttcttctccctccccatggcgatcttgcagagttcattgccagctagtagtagctgttggaaatcaaagcacccacaagggacacggctaaactttacgttgtcattttatcaggtgattagctaaaataactcaaactgagtagcaacaaagcaagccaactgaaacttttgcaaactgcagaaaagagtagaccagtgcagttggcatggacagatctgtcgcatatacccttccattatcgttgtcctcctgtcgatgcaatgtccatctttttccagtccgaaagatctgcttcagagtatcttgatgcagagaactcggcaataaacaaacctgtactacgtgaagagcatcacatggacggttattggaaaccaccaaaagcagcagagacacacacacacagaacatgcagggttgtactgtaccagccacaacacatgataccttcatgcctgccactaacagaatctgaatcattggtttccagcaaaagtgcagagaagaaaataattcaactcatccgcatttcatttcttcatttccggacaatacacagcaatacaaaggttatttacagacaagagaaaggagtagttacatgctgctactgatatcaacaaggaattgggaccagcaagttcatctcacatcggcaaaaaccagaccaatgcaaccaatgaatatacatggtaaacctcaaaatgggcacaaaactgaggaaatatcaggtatcagctaccagtggcagcaattggatcaaaggttagaggccatgctctcctgctactttctccttgggaagccgaccgacgaaagctaggtccgaaccttgagcatcttattaggcagggatttgtatccatagcacccatacaaaacgacgggttaagcttcatcgccggcaacctctggcagctcaaggaacggaaggaggatgaacccataggtggcatgcgtgcacactggaattcagtccggtacagatggctggcgattgagggagtagaatcggagttcacagctgggcatgtggtgcaaaatgacaatgaaa

SEQ ID NO: 30945 - DNA, 8643 bp, Oryza sativa
taagcagacagcacatgggtcaatacatacaggtgattggtttaagtacctccagccaaatccctgcaaaataaattgcaatggaactatcagatgttaccaacaaaagcactgcactatggttaaattttaaaaaatggaggataatacttatcaatgctgcacaattagagtaaacgaattggtctaagcatgtcatagcaaactaataactaagcaagtcaatgattacaaacatgaccagtactttagtactactactcatatatgtaacggaaaaggaagtaaagatattttagcagcaaccttacctggcaatgctcatgatactcataagcgggaggcacaaatatggagaaggaacagtgcgtattcgactctctggttctttgctaagaatttcctcaagagagttcctatgccatgagcgagctaccatcaacggggtccagctgcataagggaaatgaaacatatgcttttaactactaggttttaaaattaacagaaacagtgatagttctttcactatgccccgtgaaaaaagatagctctttaaccatgtatcaaaacttcagaatcatacccgctagcattctgtgcagaaaggctagctcctcgagcaataagaagctgcatcaaacagcttctggttagatatgttgataaaactagacaaacatttaaattatgaaaaagccttcagactggcagaacatacttgacaacagacagcattcccaccacatgcagcataatgaagcggggtgctaccagctcctggcagatggaagcaacaaaatattacatctagatatatgagaatataaacagagtagaaagctggaagaatcaagaactgtagatagtatggacaacttggtgatacattcaaacatgttaagcgctacatgccctaagagtgtgctccaacattatcaaattgaaaaacaccaagcacagaaaggaaagttaaagttgcaaaaaaatacctattaagtcaatagttgttccatcttcaatagtggcctcaataacagatgctcccaagtccagtaacaattgcacacactctacatgcccatttaacgctgccatatgaagcggagtcagtcctccatccgccttctgatttaccatcttgaacaaaccactgctaacacagacatactatttgaatgattcatggtcggtttaacaaccaataaaccaatgggaaacaatcaaggggctctaacatactcttcatcaagatcagcagatggaccttcttcagataggctgtccttcatcgagttccagaagtttggcatgctgggaacataatccgcaagcacaagacgaaggcaccgggcatgaccatgtagtgcagcaaaatggagagcactaccgccattcaaataatctgtcctatgaacctaaaatacgttccaatgcctcaggattagatatccaagcgactagaaatttctcagtgaacagcaagcaaaatactcacatttgcattgaaaagcatcagtgtctgaacaacctcccagtggccatattgacaggcttgcattaaagcagtctacatacaatgaaaatttatagcatattgccatagcatttcgcaagtgaaacttaaacgagtaaatgtaccagaaatcttggtttacctggcccctgtaattcctgaggttgatctcgacgccggattcgagcaacagagaaacaatctgaacatgcaagcaacagacaatgtgaatgcagttcttttacccatctatacagaagcactgatacttcagctacatttttggcagacaaatggcatcacctcatggtgaccctgcgcggcggcgtagtgcagcggcgagttgcggccgccgaaagtggagtaccgggcgagccgcgggttgtactcgagcagcgcgcgcgcctcctgcaggtcgccgtcgcgggccgccgagacgagccgctcgccggaagccgagcacccaaatgagttgcccacaaggctgaggaaccccatggatgctcgaagctgaggatctcctctcttagcgtgcacgggaaggcctcgaatcgaagacttcaccctgaaatttcccaatccacgaggccgcccaaaccgcattcgattcaagaatgatcaccagacaggatcaagctcccgactttaggcatgccgacgatctttaaccccaaggttcagaaagcccaaaattttcctgcaaaatcgtcaaattcatcacgggaagcggcaaattgacgggaaatttcagcttgacgcctaccaattgcagcgagactaccaacaattcgacccaaaaaagccaactttccgcgctacaccaagaaatcagagtggaactcactcctcctcgggaatcgcccagggtcgtcggtcccgagctggaagaaatgcaaaaccgagaccgaccgacaacgccctctaaatcaggcccccaatcctcgcaagaaaacaagggacctcgaactcgaagggggaatcctcggaggcgacctgccgcctcgaatcctcagaacccaccccacacccacgattccagcgaggggggggactggatggatggattggggaatcgcggggtgcaaacaacgccgatgcgattcacaagaaaatgcactcgttgttgcaatccggcgacaagggacaggaaggagaaaggaataatgatctgatggagacggcgacgtggagatgcaggtagtggccaaagatgatgtttttctttcttttggcccaaaatcttctagtgctacaggaacaggaagtaattaaaacaagagccaatagataatcagttgtataaactacctcctacatcccaaaataataactactccctccatcccaaaatatagagagttttagagttggatacagttattaataaagtacttcctccgattcacaatgtaaatcattctagcattttccatatttatattgatgttaatgaatctagacatatatatatttatattgatgttttagaagtaaatagaaagagaaaaactaaaccacggtatcccgtggggacgggatagcgctcatccacccgagccccatctgtttgtcgctctctcttcagataatttccatgcctcgtcaactcagctccctaccgacatggccagcggcggcgacgacgactccgcctccgcgctccgacaacgccccgcacgagctgttcatcttctccacgtctcgcaggcggacgatgacttcgcctccgcgctccgacgaagcctcgccggtggagccggagcgggaggcggcgggcgaggtcgaggagcataagcggctcggcaagcgatgcgcgcagcgcgtccaccagcggcgccgccgccacgagcgggaggtgcgccgacacgagctttctcgaaggtgtggtccaggtgtcgcgctaccgtcgtcttgcctccatgctccaccacgcggctgccttatcctctctctcctcctcctcctcctccaggctaccaggtaccaggtaccacgggtaccaggtatcgtgggtgtcgacgtttgatgtcgcgattccggtatttgcatagtatggggatcgttggtactaggatatacgcgagactgaggtaaaagagacgaagacgaggatttttatacaggttcaggcccctgaattgtcaggtaataaccctacatcctgttggccgaagccggtcattgctcttattcaccataatcacaccagtacaatatttggggtagtctatctaactgttgtcgacatggcggtttgaaggtctgactcgtagtcgacaacagggtagtcttcctcctcgagttcgtgcccggtgagatcagagatagcgctttcgtctctcctgacagtatccggagacaccgtaagggactagccgtgcttatccctgaagtcgatatccggtgtcttgtcttggcgtatgttggcttgtatgttgatcttgtgtcttgatctatgttccgtgtcgtctatggtgggtgtgtcccctctcctcctagggggtcctgtatttatacccataggtgtccccttgtccaagtagaactagggaaaccaatatggatacaatccgagtagtccttgtcgtttccatgtagaactctggttgtctttccttatccggaactcctcctatatccgcaggctgtttccgtataggacatggtatgtggtgggtcctgccaagatttagtcgactactattaggtatgtggtatccataaccatgacaacgggtaccaggtaccacctggtacctagtacccggtacccgtgatacctggtactctaggtaccatacttggtacatgtgagtattaggcttgatacctttcatcatcgagatggccggcggtagcggcggcaaggtacgtagtgtggttgtacatgacggcagtgtattgcagtagggaagggaacatggacaaactcgatgtgggcgacgtcctcgacgagcagctcgaagtggcggccgacgcacgtcaggaagagtcgcgtggcttcacagctttgttggaagcttgcatgtgggggtgaggtgcgcgacttcggggatatatgcggcgttatgctgtcgccccgagtgatgcgaagggcatcccgttcccacgggatcccgtgaggtagcagccctcaaatagaaaggagttgtgattggttgagaagtcgagataggtgggaaatgtgaatattggagggttacgattagttaggaagtgaatattggtggagaagttatattttgagacaattcataagtgctaaaagctgttatattttgggacgaagggagtagaactaaatgagacattttctaatactagcaatttggtccattcgattctaaattattatattttgagatggagtgagtgtcgacgtttgatgtcgcaattctggtatttgcatggtatggggatagtcggtgctaggatatacgcaagactgaggtaaaagagatggagacagggatttttatacaggttcgggcccctgagttgtcaggtaataaccctacatcctgttggccgaagccggtattgctcttattcaccataatcacacgagtacaatatttggggtagccaatctaactgttgtcgacatggcggtctgacgatctgactcatagttgacaacagggtagccttcctcctcgaatccgtacctggcgagatcagagatagcgctttcgtttctcctgatagtatgcggagacaccgtagggtattagccatgcttatccctgaagtcgatatccggcagcgtgtcttggtgtatgtaggcttctatgttgattgtgttgggtgttgatcctgtcgggtgttgatcccgttgggtgttgattgtcttatcccccctctcctcctaggaggtcctgtatttatacccataggtgtccccttgtccaagtagaactaggaaaaccaatatagatacaatccgagtagtccttgtcgtatccatgtagaactctggttgtctttcctaacccggaactccctcgaggtcagtttccatataagacatggtatgtagtggatcctgccgaaatttagtcaactaatattaggtatgtggtatccataactctgacagtagcccccgacttcgatgcaaatgaacgagttcatattctcaaccgcagactttggaggaactgttatcgagctcacatgaccgttctcggtgagtttagagataacgttagacttcctttattagcctcatgcgggcaccgaaagggtttgtctaagtcaatctctgatgtcgaccgagaaagtacagagcgtacgactaagtctcccgtcttgctgtaatcgagaatttggattgaagtcaagaaactttatctcggcgggtacaccatctcttcattccgtattctttgtcgagatccagcaaccgttctcgagtgatcgagaaggcgtagagtctgcgacggagccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaattctcaaagggtgacatgttataatatggcagactagtgaattgaatgtacagaccagtgctttgtatatgagcgtcttctctcttaccgactccgatcagtcagtttgtagagtcatacactctccctagcccccagccttgtcgtcggagaatcgttctcagaagataaggctcttggacctttgacctgcctcggttgaacaagcactgatcctagcccccagctgtgaagttggaaaatccatttccgattacacagcttggttaatacgcacggcgagaactcttacatgaccagatcttacatggtctttcgtctctgaaggatccgacaaggccttatcggctctgggcgtccccaaccgaagttcccttaggttcctcggaggccttgtcaagacggcgtaaagggacagtaggataggtttcaacgctaggtgtcatctgggtaagggatctctgggtaaaacacttggcgatcttatgcacctgatatcaactttgttgaaagaggggtaatgggagaatcgctacatcgctggtcgaggaccaggcagtagtcgtaactcgaccacttgaagtggaagtagtgggagaaacgctacatcgctggtcgaggaccaggcagtagtcgtaactcgaccacttaaagtggaactagtgggagaaacgctacatcgctggtcgaggaccatgcagtagtcgtgactcaaccacttaaagtgaggcgagagagatcactatgttttactggttcgagaaccagaagtaggagtcttttaatcacctataggggcgctaaagttagtttattacatgtgcatatcatgtggccagcatgactcacatacccaacttatagcatatccggatgtccgctcgcaatcatgtcgggtgattaaaccgacggcgtttgcgaggaattatccgttaacgaccttttctcgagtagtccagccatggccggtgttatgagataggtcgtcggtcttcgttggtaagttgggtgcgacgactccgtatttgtcgagaatgttctcgatagtggggtgtactcgaccataacctactcgagtgctcaaatgttgctgaaaaatattttctagaaggcaagacatatagcagagaatatcgagtatgtactaaaaactgcatggatcttctagtaatatcaggatataacgagcagatgtaaatatcaggcattatgtaacaagcatgacttatacagaagaagacagagcgagcccccacctttagatcgtagtcgatttaacatcagggacacccgcgcaacagatattattgtataaaaagcgtgctctgggtaaacataataaattatggatctgacaatactgtatgatctgaataggtacgataaattgcagataaaatattgtgtacctttgtagatacatgccggatgtatctacgaaattagtagatcaattttaaaaaaccaatctaccaattaccttgctgcgtactcgttcgatatcaggcgatctgacatcttttggtacgccgcggagcttgaggcttggatgatctcgatagaccaagttgtcgatgacgatgatggttccgatctagtcagaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtcgcaattctggtatttgcatggtatggggatcgtcgatgctaggatatacgcaagactgaggtaaaagagatggagacagggatttttatacaggttcgggcccctgagttgtcaggtaataaccctacattctgttggccgaagccggtattgctcttattcaccataatcacacgagtacaatatttggggtagccaatctaactgttgtcgacatggcggtctgacgatctgactcgtagtcgacaacaaggtagccttcctcctcgaatccgtgcccggcgagatcagagatagcgctttcgtttctcccgacagtattcggagacaccgtagggtattagccgtgcttatccctgaagtcgatatccggcggcgtgtcttggcgtatgtaggcttctatgttgattgtgttgggtgttgatcctgtcgagtgttgatcccgttgggtgttgattgtcttgtcccccctctcctcctagggggtcctgtatttatacccataggtgtccccttgtccaagtagaactagggaaaccaatatggatacaatccgagtagttgttgtcgtttccatgtagaactctgattgtctttccttatccagaactccctcgaggtcagtttccgtataagacatggtatgtaatggatcctgccgagatttagtcaactactattaggtatgtggtatccataaccctgacagtgagtacttagcacgccttaagatgagttgggtgtttggattcttaattaacgagggagaaagcagatgacagccaatgg

SEQ ID NO: 30946 - DNA, 2117 bp, Oryza sativa
gacatagtgctctactagttcttacttttgtgcctagtgtatatctgatttgttataatgaattctctagatctgttcagaatatttattctgacttacgatattgtattgttgtttttatgtatcaagctaattatttcagaacaatatacttggaaaactgtaaatatgactcatttgctcttttctgtttatatttcaatacatcgaaacccatataagactggataaatattaataagacacttctgcctagataaaatcctttgctctgtctctgacaagctatgaaaaaaattgatcgaaataatgtgtaaaaattatatttatgttcctagcaattaaaaacaaatgatagaaaataaactataatgaaaatcatctataaaaaaaattggttgtaactgataaggcaacagcaaaagataagaggttaaacgattatttgattggcggagtgataattacatggtaaattttaaccaaaataatatctgacaggaagaaactctaggacttgtttagtttattgccatttcaaaccttcccaaaaattttgtaatggcaaaatatggcatttgttattttttggtaagaagttactgtttagtttgatgccaaaaatttgccaagtgcttaggttctcatttttagggcatgtataacggtttttattaatggtctctttattgtcatgcaagtaaatttgatgacatggaagaaagagaaatgagtatggttgttatgcatgacaacggttcagagtcgactcttagcatttattagagcaaattttgttgcattgtggtgaaagtaaggaaagaagagaaagaaaacgtatttttatacattaatgattagagaccatattgtctttaactgttgtaagatgttagtctctagataacgtagagctcatatctgactctacctttgtacatgcccttatattgttgtagtgtagcaaccaaatacattttttttggaagggggcattgctttttttttaatggtaattttgagcatcaaacaaaatatgcccctattgtcgcgagtcatgactcgtaataaaaacactattgaacaaacaatctcgctagtaaggaaactttttttataaaccaattggcacgctttattaatatgtaaacatagtcgcatcgttttctagaacattcagcaagaaaataggagccaaaaaacccaattacaagaaatcttcaactttaaaaggatgattagctagaacatatgccacacaattttaatgctcggagagtcggagactttaacaaaatcatatatcaaaatatagcattcatgtaaaatcgttgctgacgttattgttgaaacgcctccatcttgcatcgtctccaccaccttgagaattttttcaggaatttattactcccttcacttcatttcaaaatgtttgacaccgttgactttttagtatgtgtttgaccattcgtcttatttaaaaaaattaattatttatttattcttttcatattatttgatttattgttaaatatactttcatgtacacgtatagttttacatatttcacaatttttttaaataagacgaacggttaaatatgtgttaaaaagttaatagtgttaaacattttgaaacgaatggagtactagttaatatggcaacttgcttttacgttccttccagtcattttcaatttcaataaatttataagttgtactactttggtacaaattcaatattggaccgttccactagtaggccaacctaactgcacctaaccaaaaataggaccaggttttggacggaccgtttactttgttgtcctgatcttagaataagatcactttgactccctcaactaaccaccgaatctaaatcgtatccctcaagcgcactaccagaaatcttaacccccgaactatcaaaatcgatacaatttgactctcttggtggttttggatagcggattcgctgacttggcacacacgtggcagtgtagacttggtgttcatcccacatagcattgacgtggcgcttatgtggcatttaaattaaaaaatatatgggggtgccaattggtattaacacacacaaaaaatgagggtgccacatgt

SEQ ID NO: 30947 - DNA, 20276 bp, Oryza sativa
aggcgcttatgtggcattaaaattaaaaaatatatgcggggccatttgttattaacacacacaaaaattgtgggtcccacatgtcatcctctctttatcccttcttcctcctccctctcctcccttctccatctctccctctttctcttcagcgtggggagcggcgtccggatcggcagcagcgacggtgggcggggaccgaagctgtggcagcggcgggcgaccgctggagttgcggacccggaggccggatcagcccctcacttccttcctcctcccgatagaccgcgccatggccgtcgctgctgcgccgccgacgatagccgcttccccatcctcttcggccgtgtgctacaagcgggtgctttgctccattagtgcgtagctcaagacagggggcctggacgccatggccgacctcatggacgcggccgacaacactgcctcatatatgtcgttatccccatcgtcttcctcgtcagcatcgtccgacgaggactcaccttatgggcgtgcgcggcgtgcaagaaggtcttcgtcgggaagcttatggtggaggtcgatggaggacgtcgccacatgccatgctgggagctcgctggtggcaatcatggcgtaggctcttgcgcaccgagtcgggtacgtctgggtcgtcgacgaggtcagtggcgcgctaactggagtcgtgagcttcacagatgtacttgcggtgcttcgggagcatccatcaccactcctcgctttgcgccgccgccttgaggctgagacgtgcccaccaccaccgcaaaatcggaggcggcgcgcaaccttgagcgcccgctttgcatccgcaaggaggacctgctcccgcgcccgtcgcccgaggtccaccgcctggcactcgccgccgccgcctccactcgagcccccgcctgccgccggctcatgtcaaggggagagagagagataagggagagaggaggaagaagaaggatagagagagaagatgacaaattttgtctgtgtaaatgacaaatgggccccgcatataatttttcacataaacgtcacgtcaatgccacgttggatgaagaccaagtcaacactgccacgtgtgcgccacgtcagcgaaaccgccgtccaaaaccactaagggagtcaaactgtactgattttgacagtttgggggtcaagatttccggtattgcgattaagggatacgatttagattcggtggtccgttgagggagtcaaagtgatcttattccgctgatcttttgggaagtttctaccaagtcttgggccgggctgaaaggctgaaagcttgaaatggagtactacttaagccttccagcagaagacacaaatcacccttaataatgcagttaatgagatgatacacaaatcttttgcgtattccttaaagaaagacagaaatcacaatcaatcagacactatttctccacagaccattttgtcttatctccttgtaaacactatacttttccatgttaaaaaatatatatagtttatcctggaatgatcatgcagtatatactattcccttggactggcatgatttggctgcaactccttagaactgcttgcaagcaatccactcggtccctgcgctctgtgaattgtgatgcagaagagaacaacactagcagctaacaaagccaattattaagccaccaaatcacatttaaatccctcctgtgaaggtgccaaaacaccaaactaatgatcaaaagggctgcactgccactaaccacccttttttgttgcctactgctaattattattccaaatcaaatctgtgtcacggctaatggtcgttgcgagctagagctgtggcactttagcataaagtgatatatcagcagatactgaacctgaacctgaagaaacagaagtaggagtagcatgcattactatcactttgttggacaggcataaatcttgcacacaacctgctaacaaccataataattatccctataaatatccaggtattaattttgatgctgaatttccatttattcagtaacagtactctccttctagtaaaaaaattgagaagaagacagtctgaaaatctgaataatctcaagaaagaagaagacaatctgaagagagtagtagagaatcccgaggccattaaacccattgttactcttcagaagaacaattagcatcgatgcaaaacaaggttctcacatcccaaggacccatgggtttccatcaagctcgaggagagaacaggagacttcggaaggttcgatcgccttggtttctaggccatggtccatggacccccgtttttgccggcatgagttactgaattctgaatttctgatggcctcaacactgtaaacaaaatactcattccttcttgctatgctactgctacagctagtagtgctagggaatttccaatgtcaacaccccaaaaacagggaagaaatttgtagtacagtgcttaggtcgagattcgagaagctcactttgttgttcttggtcagctttgacaagttgaggtggcctgaggccctgaacaatagcaccgacattaacttttaaattacttattccgtattttaatgtatgacgccgttgactttttaacaaacgtttgacttttcatcttattcaaaaaatttatgtaattatcatttattttattgtgacttgatttatcatcaaatgttctttaagcatgacataagtattttttatttgcgtaaaaaaattgaataagatgatggtcaaacgttggttaaaaagttaacggcgtcatacattaaaatacggagggagtactaaaaacacacaaatatatatatagctgcgttacagcttataatcaaggcatgttctaaactacggtttggattggttaattactcggtatccattagcacacttttcaaaccgttaaacggcacatttcctactaaaacatttttataactttttatataaaagatcctttagaaaatcaaataaatctatttttcagtatgctgcactagtgctaatctgctagactgctaccactactctgtgatgtggctactacctgtgttccatgccagattgccagctaatgctgtctgccgatggcatcacaggccagatggctcattttgtgcactctgcagtctgcactgcgtttggtcatgcatccactcatcatgcatccacggatcaaccaatgcaaagtgagctcgactagtttcctctcattgttgatatgattgatgcaggtacatacaccactgtatcactaccttcttcaacagtgaacacacatgatctatgctggagatatcttatctgtaaatgttagtaacggtctaattcgtgtgtataaactgcaagaattgcatcaagcagtaacatcgtggagatcgtattaatgacaataaaagaaatatggacgacactgtagcagggaaagtgcagtaaactgaggtcactcgcactgtagtttctgtccacatttttcagtttgaccgtgaattctgggttggaccatgcgttgacttaccagtggtcagcactcctcagagagaggatcacaagagcagagagaaagctttggcatcgcatgcacaaattgcagcagatcaccatgcacttgcaagctttgcattgcaggttgcagatttgcagcctgtttttatgtccttttgcatggacaaggaattaatggagggcacttttgggaacctgcttcgccaaaagccttctggaaactggcaaaagtcaaattcacctcctaccgtcgagtactacagtagaaatcctcatcaaaatagccatcacgatcacgagcagcatggagtactgaagtatctggatctgaataatctgtgcctcgtgattcgcgccccattgttcttgctccctgatctcctgttgcgcttgtgcatcgtcgctctccctctctgcctcggctaatctcacctgagagagagtgaggccatcaaaccattcacaaggtcgtagtggatagtgatgatggcggccagcaccatggtctctttggaagcttctttcagaatcaaaaacttattaaacagtttagcttttgatttaaattctgaaaagttattgttgtagaatctaaaaaataaactataaattagaagataggaacttagcttttctaaattttaaaaaactggctatcaaccaactctttctcagccgtgaaacatatcgtgtagccattaattccgcctgctgcgtctgtccgtctgtatgcgtgtggcgtcggtgcccagccaacgatcagcaccagcggatccggcagattgcaaatttgcaatcttgtgaaaactgataaacattgccatgatgtgaaatcacataatcacagagagctagccatggatgttggatggaagggataaaaacagtaagaaatggtagcatctctacgtaaccgatttttaagggatcaactacaattatagagactacttatgtattttatcaatgaattttttcttaaaaaattgttagatataagtatattacaattatagtgtagatacattacattgtaatataacttgtacgtaacttttaaaaatcgtggtaacatatcgtgttcgtgaaatgaaagtcgtgggggtggggaggagggaccgaatcccctcacttgtatgatgtgtttttttttcttcctcatttacacgaaacttaaaacaaattttactatttaaaattacatgaaagttgcatacaaattacaatataattacattacaattatactaatttacgtttagcaaatttttggatgatagaatttttaggagaaaaaatatccataaatatatagcaaaacagttttaattattttttgataattgcaacacaatagtaagagaaatcaaattctacacatgattagagtcgaaaacggccagaaacgttacaacttttacgatacttcgttaccaaattccttcaccgttctcatacccatgtggatatattcttgcagaatttcatggctaccacctgcctagtacctctccgattactactcgctctacaatactccctccgtcctacaatataagagattttaagtttttactggtaacgtttaactactcgtcttattcaaactttttttcaaatgtaaaaaacaaaaagttatgcttaaagtaccgtagataataaagtaagtcacaaataaaataaataataatttcaaaaaattttaaataagatgagtggtcaaacgttgaaagtaaaaaatcaaaatcccttatattatgggacgaagcgagtagaattttagtactactagtactccactgctgtataaacagttactgaattactgatcatacgatggttcgatttgatttttagtagtagtactaaaatttttcccaaaatcatcacattttagacacatgcatgaagcattaaatataaataaatgaacaaactaagtgcacagttaggatgaaaatcgtgaatcttttgaggctaatttgtccatgattaaccataagtgctatagtaacctacatgtgctaataacggattaactaggttcaaaagattcgtctcgcggtttatagtgaattatgaaattatttttttattcgcatttaaaaaatatccgatgtaatacctaaaaattttcttttcacgaccgcatgtagtagtaatactgtacaacgtagtggtagcaggagccggaagggtgtagaacaatagccagtcaatgcaacctgagtgcaagaagaaagtacacgaggctacaaaaagaaaaacggccagaatcctccacacaagtactacacgttgaacgggacactgatggccggcgtatgcatcacacatcacacgcgccggcaatttgttaatcctgcaaaagtcaatgaagattaaaaataagccccaagtttagttactcgatcaaaacacctcaaaaaaaaaaacaacatcatgacaccgacaaaaccagcaaagaaattaaatgtcgaggacgaaaaaacagatgctcacataaaaacagcttactaattacctgtggtactacacttgctagcgaatcagctacaagaacagcgatgccacagattaattctttttaatacccatttttgtttttttctctggctattgttgcaatccaaatgacctcacattacagtgacccacacctttgcatgtcgcctcatgctttggttgctaacccttcacctaaacacacctaaagctaccccatttcttgcccattgattaataagctaagttaatccctccttgcacattttagtactaattcgcctacgacttctcacacacaaagcttcccttccccctaaacctgcaactgctactgctcctctttttcttttctttttcttccatcgccatcacctgctgctgtgtgtcctctgtccttcttcatcgccaatggctgccatgccaacaccaagatccttctcctacccctagctcatcgcaaaacaagctagaaatcgtctcttctcccaagaaaattcatctttggatcgtagagcgtatttgaagaatgagcaattcgacgtggcagccgtcgccgccgcagactccggcggcggcggcgtcgtcggcgtcggggattgacggcgtggagaacaagataagcccgagcatcgtgttcatcgtggccgtcttggcgatcgtgttcttcgtgtgcgggctgctgcacctgctggtgcggcacctgctgcggctgcaccggcagcggagggcgagggaggacgccgagagcgcgacggcgttcgaggggcagctgcagcagctgttccacctccacgacgccggcgtcgaccaggccttcatcgacgcgctcccggtgttcctgtaccggaacgtcgtcggcgtcggcggcgaggatggcaaggacccgttcgactgcgctgtctgcctgtgcgagttcgccgccgacgaccagctccggctgctgcccaagtgcagccacgcgttccacctcgagtgcatcgacacctggctcctctcccactccacctgcccgctctgccggaggagcctcctcgccgagctctcgccgacgtgcacccccgtcgtcatggtgctcgagtccgagagctcccgcgacatggtccacgccgccgacgatgagccagccgacgtcggtggcgaagacgcgccgggagcggaggaggtggtcgaggtgaagcttgggaagttcatgtgcgtcgaaggcaacgtcttcttcaacgtcaacgccatcgccggcgaaggggatagagccggcacgagcagcaacggcaatggcgacgccaatgccaaggctggtggtctcgggcaaagacggtgccattccatgggatcctacgagtacgtcatggacgcgcacgcctccctccgcgtgtccatcaagccgccgaggaagaagccggcggcggcggcctccaagtcgcgccgccgcggcgccatgtcggagtgcgagttcggcgcctccaagcgcggcgagtcctcgctccgcctgccgccgttccgcgcgacgccgcgcaagaaccccgacgacgacgcggccgcggccgccggcgcgaagctcgccaaggacagcttctccgtgtccaagatctggatggtgccgtccaagaaagagcccggcgccgccgccgagaggcgcgcggtgtcgttccggtggccggcggcgaaggactgggacgtcgaggccgggagctgcggcgggaacagcgccgtgtcgtcggtggcggcggaggagcgcccgtcgttcgcgaggaggacgctgctctgggtcgtcggaggcagcaggcagctcagcagagtcgggagctgttcatgatcaccatttcgatcatcaaatctcaaaatgaaaccaaaaaaaaaaaagatgattcttttgttcagttcttttaccccctccttttgcttgctaggttattggtagcgaactagcgattgcatccaacagcaagagaaattgtaaaacccatatgctacgaagagaagaaattttcctttcatttttaactgcatttgagattttgagtccgggttggtttcaattttcagcaaagtgactccctgatcattactcgaaagaaaacattacctattaggacaatcaaacaccacctaatcactcatcaaactgtacactacagtgtgttaatctcattacaaattagtccattcgattagaccagagaggccaagaacacaagctgcgatggttgcaattgatgatggtgatgcgaaaccgggggcaaaagcaactgtgcacagcatggaaaggaaattctcttgtttgatcccatcgtctgatcggccggcttgttggctctcggcgaccatcaccatgtgagcttgctgtgctgcaccaccaccaccgcactgtgccactgtgcgtgtgctcttttgtttgctcctcgcattcggaatttcgccaggacatctttctcttttcagaggtaaaaacaccacgcatgccgtcaagtttgggaagggatcttgtctgatctgtaaaggctcatcaaagattctctctttatcctatcctttttcctctatcagtttttttctacttaacccactgtgagtccaaccatgagtggatccaagtgtctcagctccagtacttcggttgcaggtacaagatctgagtgaaaggtttggtttcactaataattgacttaatgtagtagaaacaggtaaataagctggagatggaccagcatgtgaaaaggactggtccagctcctctgctactgctactgctacactttctctgctacatcttcacttgagaaaacgagatcttctcacgagtcacacgatctacactctgctgtggtcagtgagctgttctcccattactgcagcaagtccaccacaacgggaaacggtggacacacacacccctcacgttatcacacaggctgttccaacagctcatgcactcatcaattctttgagtactatactccggtggaggagtaaagtttctattcatacgcgtatgatgtacgaagtatatatctcatgaattttatgagttcggacagagatttttataactgcagtctatctctctgagattgacagttcaccggtgtgtggggagatgcaataattgatcggccatactacctgatcggattttactccttcagaatttggtagcttcgtggtcaccgtcgtgtcgtcgtcggccagtgtctgtggtcgtcccgggcgtttggttttctcatggcagccgttgcggtcggtcggtcactaatgctcggaggaagatgtgatcttcttcttcttttgacatcaaggaagatgtggtctttggtaaccgaagaatgatttagggaatgtttgagagaatggtaaaacaaggcgagtattagcgtataatcagctcctacaagatgaccctttccggtgcagcatatgggataaatttggccagaataaatgcactggcgatgaattttcaccaccgatcgccgcttccgtatagggatagatttgttttgcagttgccacttctactcccatgatgaagatgttgagcacctcttcctacgctgccccaaggtaaccagagcatggtcatccattggcttcaacgagtaagaaatcaggctgctaccatcgctcgagaacctctggtttattgagccccccaacacaacacaccacctatgtcggattcggcgcacaatactcctcgcgatcagttagaatatttgaaagtgccgaaacaacaaaagctttcaacagcatagatgaaaccgattaccttctccgacattgttgatgatcttgaagcctaaacgaacgctgccttactctgtatttagccggtgacggtgaagttaggcaccggtgatgaggagcgtagaaatgtccatggcctcgtcgccacgaacggcatggcaccgagcgttttcgtcgccgccgtttttgggatctcggtcgtcggtgcggtcgtcgatctccggtcgtcacgaggtatggcaccggatcgccgtctaatcgtaggccaatgggccccgtgcctcctatttctatttaatttgggcttgaaatcgtttatttctaggcccagttgagcggctttcattgggcttggcctatttgtgtgagagctcgacttgactaatcagtaggcctgagcgcttcaggcttttaccacctccagcgtccagtttgataggcccaccattcgaggcccatatatctgttattatatccttttctttttgcgattatctgctatttcctgctctagcttctccaataatgttgtttttgtgtcattagttgattacaacaactaactgttctaaaaaattacgacaactaactgaactaggccacgttttagaggaaacagtcgacaaggctgccataccaaccaaacaggtcaacctaaaactctccacgtagcgacctttcttactgcgacacatatgtatatagctagtacgttggagtgcacggttaaaattcagtaaccaaaccgagtgctcttgtacaacatcacgtcttgttagcccagagccgtcgttgaactcgtgcacgtccaacgctgtcgctttctcaagaaagtgcatgtgggcacaccaacgaagcaaggttgtagcaccatagattcttgagagaatataccaggccatcgaggcaccaaaccaaccgtcacgcttaccaagaaaacccgaactacttctcccattaaataaatagacgattatgttccattccaatctagattttgtattgagacgagagtagctaactagctaggaaattcagtgattttttttcattactgaacctttttatttttaattttaaaaataaactcttccaaagtttaaaacttattttcaaaatctgaatattttgaccacgctaaacagacgtaacagttttatcttgccataccagtcgatatgatgtggccaaataattgtcagccggacatgaccacgttttgcctactgacatgatcaaaagttcagttattggaaataatttttgaaatggtttctttttaaaattaaaaattaaaaggttcaaggaaaaaaaactcaaattcagtgcacagcacaaaactacaaacgcgcaccgaagggaataatcggcttgggcgcagtgcaggatcaatcaaccggccgcccgcccaggacgcacctgcacgcagcgacgacacggcgcgcacgtcgtcgctgtgggcgggcggagcatatgctcgatcgatcactcctcgatccgcacggatacgacacggggaaatcgtccaaaactagcgagacgtgtgacgactgtgagtatttcttcgtcggcacacatgcttgttgaattagaccaactctgtctatctctgctcatgaacaatgctggcgatgttgataaagttcataacacagtagaatatataatctcattggaagcctctagtgtcgtgttccttggacggacatgatgcttaggtatatgtatattgtgcttgatccgggggaggatttcttggccgattgatcgatgccatgcatgctaaagaagattttttccagctctgatcgatcgagaagcaagcaaggtcatcggatattctcttccttggttggctcaattattcgcacacattgcaccgagccttctgctgccttatcgacgatgcgccggccggcctgcctcatctcttggtcagaacattcggcgtcccatgccatgcatacagttgtttgtacccttccatccagttcagatgatcagatgagatcaccgggaaattaataactcggtgtgcttcatggctcatgtcgtgtcaccaacaggagtcaggcggcaataatatgttggaatttatggacaggcagatgtgccaatgggagagttgataataatagtccaaggcctaatttggtcatatccaaaacttgtcctagggtaggagtactagcaaacacaattcaatatcttttgacagggaacctatctcgatgagaaccaactgtattcgaggatatatggataagaagcatcatcgactgtgagatatctagctttattttcatctgttcttggttccggcaatcttcagatacgagataagaccatgaggatgtggattttttttttcatgtctcgtgatgcaaaaggatagacgaaactaaacagaacgaaacaaaacacttttgggagatagcaacgtatagcagtagctgcttctacgacctactacgatataaaactacctcctctctgaggagagaattctccacacgtaatttatcaagaatactgaatataaatggtttcagacttcacattgccctttccattccagctaccatcacaaaaaaaaaaagaaaaacttaagaagtgattatactcttgatctccaatcaatcaaaaaatatgttcatgtttgcataagttgaagattacattggcgtatgtaaaacgagaaaattattagcatataattaataaagttttaattattataaacttgacaaattgatatatttgttatttcgaagcaacttctatatataaaggttttgcacgaaatataccatttagtagtttagaaaacgtacaaaaatcgaggaaaaatctaaatcttaatgagaaaagaacatgccctaattttttttttgagaactcatgccctaactcgggtcaagcatttctgcctagctacagcaaaagcacgagatgccattcatggcacgatcagatccatgtagctgagccctaccaaaaactactagcactgtagtatcatttctctgaacctggccaggaggagagcagacggcacacagtccagacagacaagccatcggcgcgtcgtcatgcatccgatcctctcctcgcggtcgccctacgccatctgttacctttgatgtcacagtcttgcatggtaggccacacccatgaaaatcaaacaccgttcatggtaggccacacccatgaacttagttttggacttaattttgatttctttcaatcatagtttgtttttcagtattgattattaagttgttaagaaagcataaataagagctttacccgtaatttagtttcggttttggttcgttcaacggctaatcagctgtaatcaaacgatgagactgctccacatgctgaaatgcagaatggacacaagccggatcgatgctagtacagtgacctgacctaaagtaatttaacctgagatggcatcctaggtagtaagagagtttaattggttagtagcgttatggcaagccatgtgtccatatacctccatatcaagattgggtagtagcgaaaagaataagaaagctggaggttttcatgcatatcgtctccttatccttggctacctttgttgacttcagtattggtagaagcctgcccaaagctagctagctatcactaggaaagaagattcgtgctaccctcttaggccagccgggtcaaagcagcttgtcatttcgaccacagctgctaatatgggcgatcacagaagtttcatcagtctttgatccattggaaaaacaaacaaaaaaaaaagaacagcaatgacttggttcaggtttctgggtaaactcctactcctagcaacttcattaggccatagaattctctcctaatccggctgctagttgcttactcctgttcatcagcgacatgaggagattaaagatagatgaacatccacggttgccgacagagtgtggcgggtcagccggacatctgaattatttcggccaaaagtctcttgccggtgagatgaaatgatggatcgtctgtcctttttatcatcagcgttgtcctccacagcctctcgtgtaccacatcaactgtgcctactaacatcaggaacctgttgttccgagagaaaatcgttcccgccataatcatggcaaaaaaaggccttactttagtgccttttttttaaaatctcccaatccctcgtaggagatgtctgcgtccattgaactacaacttggcagctggcgaggctcccgtcttggtacagaactctgaaaaaaaaaaagaaatcaacgttttcacatcatttggattagcaatgtgcagcaattcggaagggggaaaagaaagaattcccagcgtcgttttcacagcatttggatgaggaatgtgttgcaattaaaggaaaaaaaaggaaattcaacgtttccacagcattcggatcaggagaggaatgtgctgctgctgctgccaatatcggcggcgatcctccggtcagcgtcaggcgccggcaagagaaaagagtggagacgtagccggataaggaggaccaaggtctgcgacactggcgctatccggcgtttgggcatccatatcggtctgtaataatgcagcaaaggtgaaaagcatggccaaaatgcccgaacgagacggccactggacggagaagggaagcaagcaagagacaacatgaagaaagaatcatttttccttttttttttttttggttctgatttcatcgtcatcgtcaactacatatacaaggtggctgaaaccttctcgcatatttttatcatacggggcatatacaagcatggaagaaggctgaaaatgttgaaagaaaaagaagaaaaaaaaacaaaaaaaaacctgtttatcctgtaacttctgcagctaacccctaaaccacacgaactgaatcatcatcatcttttccatttgttattggaatttcctccttggtttttatactgtgcagaataatccctgtctccgtcacagtgagccttcgaacgagacccgcagctgcacttgccttggccgctgcgatggcgcattggcgagaccctgcagcatcttgatcacgtcgaccgtgtcgtcgaggtagtacttggccatgctcggcttcttgccgaccgtgcaggcgaacacctcgctgctcgccgggagcttgacgctgctgttcgacgggcaaacgatgctctcgaacatgtcctcgtccgaccggtcgtccccaatgcacagcacgaaatcgggcgccttccctcggctcaccatggatgacaagaggttgtccacaaccacacctttgctgatgccctgcatgacatgaaagataatttgtcatgagagatgattttagtatgttatcactacagaaatttcgaggttggtggtttgggtggcgagattgagattgagttggttcctaacagggataaatattaaaaagaccggggactcttttcgcgaattttccagtccacacgggacatggtccatgctgattcatatcctatttgtcgagcagatatagattgtccccaagtatgtggtggatgaagactggattggattagagcaatccttatccgttgcctttagtttgacagcgacatctagttgatcaacatgttgtgcatacaagtctacaaccagaactaatcaaacatatactgtcaaacaactagaggaaggaaggaagatggcaggcgcttacctgtggatttacttcgacgatatgctgggccctcttaacaacgactggttcatttgcaagaacgttttcgaggtggtcaagcagttcctttgcctggcatgaaccaaaatctggatctgcctcatcgtggtgccaaactaacgcgctttccttgtcttcgatggttgaaccatctgttgcctccttgtaaagcctcatcactggttctgcagtcttcttccaatcaaagtccacggccaacccgcaggtctcccaagctgagtccctgctccacctgtggtatccatagattagtaaaaatcacaaatttcccagaacaaattcaaacgctcctctacctgtcttgtaactgaaaatgacactagataaatacgctaaaacctatgtttagcttaatggcataaatcaaaagcctcctcaagattatcctagtacaatggacatcacagctgcatctagatatgtttatgaactcaatattttgcttcatgttattcgataaatgtactggttgatgtactgtttcatgatttatatcatcctacagatttaatccaaatctaaaacactactaatatgcaagcaaagcaacttcgtaccaacaaggagaatggaagataagagattactaccttgtgaagtaaccatgctctgcagcaatccccagcttctcacaaggtgcaaaccatctgccaagttcatccttccctctaccgctcacgatgaacactctgttcttggggtcctcgcacagacgattcaatacagagatgacctcattgctcggtgccttatcaattgaaccctctggcatcactgtgccatcatagtccaagagaattaagcgattatcagacttccggtatgacggcacaatgtgatcgacagacagccgcctgaaattcgggccaagtgccaccaccttgaaactcatcccaaacccaataccccaatgccgccgcgagaaatgatccttgcaagctcgctgcaggtcctggtcgaaagatttcgcccagtaggcaacatcatgggtgctcacatacttgtagtgcttctcatgtcgcagccgctgctctggctcaggcatcctcagggctgcattcatggcctctgccatagactccacactccatgggttgacccggattgcgccgctgagcgacggggagcacccgacgaactccgacagcacaatgacgctgcgcttggccgcatcatccaggccagtgctctcctgccggcacaccgtgtagatgtagggtatccggttgaggccgtcccgcacggcgctcaccacgcagcactcggccgccgcgtagtacgccgccttctcgtgcaccgacacaccgcggtcgatcagcacgataggggtgtaccccggcgtgccgaaccgcgcattgacgcgggcgctgatcgccctggcttctccctgaacctcctggatgtcgcgcccctcgctgcgcgccgggttcgcgatctgcacgagcaccgcgcggccgcgcagctccgggtgctccaccagcagctgctccatcgccaggaacttgagcccgattcccttgaacaggtcgacgtcgtcgacgccgaccatcaggcgccgccccttgtacgactcggtgagccgccgcaccaggtcccccgtctccggcgccgacaccaccgacctcagctggcccatgtcgatcccgacgggcagaatcttgaccgtgacggtgcgaccatagtactcgatgccgatgtagccgcgcttggactggtaatccaggccgagcagccgcgagcaggcggagaggaagtggcgcgcgtagtcgaaggtgtggaagccgacgaggtcggcgttgaggagggcgcggaggaggtcctccctgacgggaatggtgcggaagatctccgaggaggggaacggcgagtggaggaagaaaccgaccttggcgcgcgggaatcgcttgcggaggaaggtggggagggcaaggaggtggtaatcgtggatccagacgaggtcgtcgtcggggctgagcacctcggtgaggcggtcggcgaaggcccggttcgccgagaggaaagaatggtagagcgcgcggtcgaacggcaacccgcccagcgacgacggcgtgagcggcagaaggtaatggaggagaggccacaggtagtgcttgcagaatccatggtagaatcggcggtggagatcggcgggcaagtacaccggcaggcaagagaagttcgccagcaagtagttgcagagctcgtcggaggccgcctcggttgcgggcggcgggagcgtgccgatgtggaggacgggcgcgccggggggcagccccgagcggagctggtacgcgacggcgtccgagtcaaccgtgaaggagaacccgaacggcgacgccgcgtcggccgcggcgcggagcgggaggcggtgcgacacgaccaccctccgcgcgggggccggcgtggacggcgacgtgggcgaggccggcgacgccgccgacatgacgcgcgggaggcgcagcgacgcgggcgacggcgccgcgtcgtccgccgcggcaacgaggtcgaggaggttgtggcaggagagcgaaggcatcgccaaaacaaaaaaaaatcaccggttcgtgcacccgacgaacaactcgccgcctccacgtcgcatcaagagaagaagaaaacccaacccggcggcgaactactccgatgaagcggaaggatggaaacggccgcaagcgtgatgggcgtggaggtggataagaacggacgagggtgggagagaagagaggacgagctataaatacggtggaagaaaatcgaacgaaagatcgcggggtgggaacgggatagatatatatcgcagcagcagagtctacagagttgagaggaggaagatggaaggggaaggaggaggtgaaggtgaaggtgaaggtggtggggtgtgcttatccatccaatctttgcacggggaggaaatgacggggctgcccctctcactctcgtgtaacggccgggttttatctgaaatcttctcgtgcctcgcggcgtcggggatcgcggaggcgcttacgggagggatacgtcgcgtggtgcgcgcggctgcagacgtattctcaccgaacggttctcacctttgggtgcgggtgggagacggagtgggagacggacggtgggggtggataacgccggggctgttggcaggtgggacagatggggaggagtactggagagccattacttgtgcacggtttttccaaatagtttttcccattattcttttaatcatacggcagacgtatacgtacgtacactataagagacatatatctgttcttgataaaatcatgttgaaacctatctacaaatgcatactccctccttccaattttaattgcaaccacgtgttttcatatccaactttaatgattcaacttattttaagaaaatttataattagtatttttattactattagataataaaacatgaatgctattttatacgtgttttattttttaaataaaatagataattaaaattgggtatagaaaactatggttgtacttaaaatgagatagattaagtaatatttgtgggtagcaggatttgaatcatgaataagtaaagtcatgcacacatgactagcaaaccactagggctttcctatttcacaagatattttgatctgctgcatcggaacgtgaattacgtgggtgatagtaatatggtggtgttgtttgtcatgatgtttatgtgaaaatgaaaagtcgtaaacgaacttccttttataatggtacagattatcactgttctgttgcatgtgttttaaattggactttcatgaccatatcattattgttggtgttgaaattactcctggttgctacgccaaaagaatgtgttatggtgctttcaaaaaaaaaacaatatgttattcggcgtggcaggctccaaatcacattcaacaaaatttcagaatcaaaatcttgcaatcttttagcttctgtcatatatgttgtctgtataggcgagtataaattaaattgaagtatattcttgtcagacgcgtagcatagataatactagataatattgttaactaaccgtaatttaatttataaaacaacatcataacttttttacataagattaaaaataaacacatatagcgcgcgcacagctaagagattcttaaccaccatgacaatccaatattccaagcaacaatacataccaaaattgttgccacaccttatgttaaaaaactattaagaaaaatgtttaagaacatgtgaatattgtgcgtcttccttatcttatacggaaagaagttgatgctaacaattccataaaatctatcaatgcaataaacatgtacaaaacgaagattccgtatcctctcttttttttaaaaaaaaatacccaccatttcacttatcgtactcgcaaacttagaaggaactctacaatccaatcacaacttaaaaaacgattttttatacgagagacaaacagactgtaatatggcgcgtctccaaaactcaaacattcaatttcacgtatggctccttacgaggcccgcatacaaaaatttattttttttaggcgatgcctcttaggtggccacatacaaaaataaacatattttcgcatgcggaacttttaaagtccgcaagtctgatatatcccttctttccctctaagcactttaaattttttttcaagtcattcttatctctacttggctcccaccccctcattactcatctttatctcaaactactatatgtctcaaaatcctctctcatttctc

SEQ ID NO: 30948 - DNA, 17278 bp, Oryza sativa
catatttcgcatccgaacttttaaagtccgcaagtctgatatatccctcttttccctataagcactttaaattttttttaagtcattcttatctctacttgtctcccaccccctcattactcatctttatctcaaactactatatgtctcaaaatcctctctcatttctcgcttctctcctcccgagctggcgaggagtggtgaggcatggtgaggagcacgggggacgaccttcccccgctcgggagaggagcggcaaggggcagcggcgggcgacgccattcccctacaggtggcgcgcgtgggacggcctttccccgcccgataaaggaggtgaggagcgataacgacgagcgcgcggctctgccgtgctcaaatccggctgtggcccttcctcgatcggatccagcgccccctcccctccccgcgtggatctgttgacggtagggcgaagtcgaccacggcggtggcgacgggaggatgaggaggacagcggctgcgacgacgacaggattttcggaacatttttcttcacatttattccttttcgcatgcggtcggcttaagtgtctacatgcggaaaacggattttcacatgcggttgtgctggttgcatgaaaaaaaaacgatttttgcataccttttggtgcatttgggccgcttgtccacatgcagaaatcggtttgagcaggatggaaaaaatgtttttagtagcggaatgtatgtgcaccatataaaacgtgtttaaagaaaactaacacttgcaactgttggaaatcgagatagagccaccgattgaatatgatattataccaaatattattaaaattttcactataagctaattaaccatatcaaattacgacaggacaataaaccaaatatgtatctgctatcatactaactccgaaaatttcttttctgaaaaactacactaagttggaggaaaatcctttgggtcgagcgttcgatgcgcgccaaaaaaatcgggcgcccgtgcccaccacagtgttacaagtgtaatcgtgatgtttcattttgttatggatcaaatgttgcagtggattttgatattgtttaataatgtcatcttgatggacacgtgggttgctgatgtacatggggtttaagtgctgcaatgacttcaaatcgtttgttgtatacgttgaaccaagttgttgcatctagcgatctgaccttgtttcacttttttttaagaattgaaacattattttgctatttgctgaaacattatttttatatagggtgaaacatcgtctaattttttgaaaaccattgcgcagagttaggcacggcggtggggcaccatggtgtcggttctccgcggctccagcgacgggcgacggcgtcgccagatctggtctccccgcttggccggggtgatcggcgacgggctcggtcgtcgccggcgccgctccgcggacctggcagggaggtggctagcagcggcgatggtggcggatgtggcggcgacgaagttggcgacgacggtggcggactgcggcgcgtgccgcgacgccggccctcatcaagaacctcaccaccacgagggaggcgcggcgccctcgtcaatgttccggctgtgaacgccgtgcccgtgacgccttcctccatgatgccggcgacccgcgcttcgtgctacaccttcgatccgcgccaccccggccggatctggacggctggcgtttggcggcgctggctagcaacggtggcggctgacggtggcggctggacggtggtggttggacaggggtgtccgtggtggtggcggtggcggctgtcgacgatggtacctatagcggcgatggttgaaggccatcatccggctgacggtgcgtcggcggcggcggcggtatgtggaggcggggaaggggtctagcggcagggaagaaggagtccgggtgcgggcgcgccgtcaacggcgggaacaacttcgggcggtggccttggccgaatcgctgaaaggacaatgttgttgaccgacgacgatccttcttgtgcggattggtggtgtgggtttggacagggaatcgcgggcgaaagccttgccgagccatttggctggctgacaacggcgacgccgtttggcgtcgttccccttcttggaggcgttgttttagcatacccctttcctttctctaccatattctccgggtgaaaaccttgcttcggttccgaacgagcgatggcgacgatccacgtcgcatcctccttggggcaccgctttggagaaacctcttcgtgcaaggatattgtcattggtctatgcattgacttcgaacttcagtcctaggccttgcaaggccttctagctccaccttttgtttttcttttctcagttgggtcatctcttctcttgtttggtgtgttcaacttgtcttgaactacactctcttctggagtagatttttgtaataattggctgtaattctttttgagcaaaggccgggatattatattttattatctaaaaaaatttggtgtaagagcatctataatatagtacaaaagtagtccataaaaattaaactattcccattccattcagctacctagcgacaaaagcttcgaaccaaatactcctactccgcgaccttcattctctttcctgcaaaagttcagtatcgttggttttaccaatgaactaaacaaagctcgttaggttaaagttaggtttacctttggggacagtaatcctgaccagctgtagaccccgtgagaaataacacagagacgtgcgaagagctgtgaccgcgttgccggctcagctccacagctgtaaggccagcacacaccgtaggaccggcacgtggcggccagccacgacaggataagccgatagactgccccggtgccgtggcgtccaggcttaagccccaaccaaaatctgccacgtaacgtggaagctcacgtgggcagccagcactgcagggcccaggcggcggcgccttgccgaccttgccaaagctgagagctccccgcgcctcgccgccgtcgccaaccggcggctttgaattgaggccccagcaacgttcaaacgtgtatccataccaaccgcagccgagcatctgtggtagtatatgcccgtggcatgtcgggaacgcaaatatcgcccagcgcctaacatactagtactaccaaccaaacattatctgatctgatcctgatcctgatccaatctaatctcacatggcgcactaccgttctcgtcatgcagatccagggaggacgcagacggattagcagaagatcagaagaatacgattttcttttatatagggtattttgtagtagttgtagctctaacttgtgcagttgtgcaactcctacaagtagatcggtacggattatgtgtaagacagcaacaaaacagattagccgtcaacgtagccagccaagctctttaaaaagcattaattaaaaccactaccaacagtcaaaccccccaaataaacggaggcgcgcttctactgcccgtgaggcacaacagatcgttacgatttcgaaccatctccatgtcgcatgtcgctgacgacggcagctggccctttttactgcagtcacgggtgagcgaacggccgaagcgacactggcgactgggccgtcccccaccggttgccccgccacgccgaagcatcgcgtgcagacgcagacacagtcaccacgtagtcaaacacatgcccactcgaggtgatatttttccctctgcgttgcacttgtgtgtggcgtacacgtactactaccggatacagtacagtcgtagcgaacgtggctgagttatgggcgtacacgtgggtgtcgcgaggcggagccgcggttgcagtgggaacttgggtctcctccaacctcgtatggtcgacacgtcacggtcggcagcgagggttgacgtgaaggggattgcgggggggactgacgcgtggatggtgactcccggtccccggcacgtgccgctccggcgggtcagtccatccatctggctcactcgtcgctctgtccacgtcggtcggttccaccacctgggtcagtctttttttcgtttttttgactcgtcgctggcttctaaaaagtgtagctaaatttaaatttcaaaaatatttcttttttttgttacgagtactcctactcctatcatttcgtttcacccttagggtgtgttttgttcacgccacaattagaagtttggttgaaattgaaacgatgtgatggaaaagttgaaagttcatgtgtgtagaaaagttctgatgtgatgaaaaagttaaaaatttggagaaaaaatttaaaactaaacaaggccttatcttcgaaactgttgaaaacgaaaacgcagtaatataaggtatgaatgaggtattggcctgttcgactgctagcaacagtatcggcgatacggtatcgcgcacacgcgacgcaaacacagctgcccatctgctgaacaagcttatttatgtgaaaaaaattgctccaataaaaattgatgttttaaagagacgagttaggataagcactcaacatgaaataagattaatactattcgcacacatgggtgcagccagtaatgaagtctactctctttaataaaaaaatataacttaatggaggacaatccaaatttattgttttatgtctcatttctaattaagatgattttcttttatggaggaactctatctatgtgaagctaggcattcaacgtataatcacctgcgcgtgtatgtgcgcgtgagcacaaaagtggtgtgtttactcagttaaaagaaacttacatctataaatacattttagtctacacaagagtataaaagtggtatgtctaaattcgtagaaatagataattgcttatttgaccctgttttaaagcataattatcaatttgaccctacttgtttttagtttacttatttggacctgtttttcaaaatggaatgaactatttgaccatgttccgttaaggcgggttaacacggttaaataggggccaatagtccattttacccttacttatttgacactgttatatcaaaatatacatatatttggaccttttaacaaatctaaatcaatttgacaaatttaatagacagtagctagagctcggaggttgatgctgggtgccgctgtggaccaccctttgcacgccgccaccactccaccgcaagacagcacgcgcggacgtccctacacgcaccgcacggtggcgccgacctccatctgcacgccgccgcccccgaagccgtgcgccggcgccgcgcgatggcgccggcgccgacttccctcagcacaccgccgccgccgaagcggtgcaccgctgccgacctccctacgcatgccactgtgatggcgccactgccgacctcccaacgcgcgtcgcgtgacggagtcgccaccactcctccctccggtcctccgccagccaccgtcgcctgcctcaccgtgcgccgccgccagtgctccctcccttcccacagaaccgccgcctccccatcaaagtccgccaccgctacaccgccttcgctgaccgccagagctagatccgtcgtgcgcgtgcctcggcaccactggatccgtcgcctcatcgccgagtacaaaagtggtctgttcaaattcgtagtactataagactggctgcgttcgttcattggagataggggagattgtcactcgttttccgcgcgcacgcttttcaaactactaaacggtgtgttttttacaaaaattttctatagaaaagttgctttaaaaaatcatattaatccatttttgatgtttaaaatagttaatactcaattaattatgagctaatggctcacctcgttttgcgtatcttcccaatcctctctccctcgaacacaccctaaatgttttattcggttgtatgttcttatattttagaatcgagaaagtaattaactggaatagttatttagggcttgttagtcagggatggaaacagttaaaatgggaacattaattataaatgtgggccatgaatggatcacggacagtagccacgcgttgatcctatccaatagcgtagcacggccgggggaacggtggtccccagcaaaaggagtacgagaagaaaagaatggagggacggcatggcaggcacagtgcaagattgtggggcgccgccacattatcctctctctccccccggcccgtatttcgtgccgcgtaagccaaccgggtgcgtgcccctggcccccactcgcaacatggcttttgctacagctatagagtagttgtactccagtgggccatgcctccatttataactccattggccgcccgtacggatttgctaccaacttgtggaatcaacaacgatatcgttaacccatacccgtaatagcttcgttagtttagtgatcatcgtcacattttctatacttagttaagtttagttaagtatacgggttttttaagttaagtatacgggtttagaaatgaaaattaaagttcgttactcggatacgcttacatcgttttttaatatatagtcgcaataagtgaaaccaaggtaatcttttagcttgttaatgttagcataagagatcactattttttttatataggccttgtttagtttcacactttcaactttttcatcacatcaaaactgtcctacacacgtaaacttttaacttttccatcacatcgttccaatttcaaccaaacttctaattttagtgtaaactaaacacacccatacttaatattttttaacttagaacttaatcttttaagtattttagctaatatttaattaattatgtactaatttaacgttctttttttctgcacgaaggattaggtggtgtttggattcagggacttaactttagtgtctatatttatacactaatttatagtattaaatatagactacttacaaaactaattacatatatgaaagctaattcgcgagacaaattatttaagccaaattaaatccataattaaagaatatttactgtaacatcacataggctaattatgaattaattaggctcaatagattcgtctcgcgaattagttcaagatcatggatgggttttattaatagtctacatttaatatttataattagtgtccaaacatcttatgtgataaggataaaaagttttagtcccatctaaatatggttttagttccaacccacgtaaaagaatacagcctaataaagtaatagtgctaacttagtagtattatcttcttctctttttttgcccagctactagttgctgctagactactgctgctgtgctgtacaagcttgacaggatcatgaagagaaggttagaatgtactaagaaggtgaggtgttattccaagtcttgatcagaaagtaaagcacgcgatctgcaaaaaggggaaatcctcggacgggataacataatcaaagcaatgtgcacagtgacttttcgcgcgaaaaaaaaacatatattagtacgtactgatcctgcatctggtcctggtgatggaattaggtatgggaaagagataaataatataatgggcgaacagtattataagggtggacccggcgctatcaagaacgtgaaggcagtgttttaggatataataaaccaaccaaatcttgacgtactggtagatcattaaagagatggtcctccacgcggccaattcattaagaaatcgataattaaagaagggattaccactacgctagcagtagcagtagtagtagtagcaggtaggagtaattgttatccggataaggttactgcagctggagctagcattatggtacttagtttgtttaggttaatcctcttctgcgcccgcactcagatcggaaaactgcaaattgctgtaatgctgaagctgtcatatgctgtgtctatgtggcccttttcatttgacccgtcttttagcaattttcacacgagaaattccgacgttttcacgctgctagtcgtgtgctcgtgccgggaaacagccaggcgcgcgccgcacagatcaacatcgtgtgctgcacgccgcgggatcggggcacaccagtgaaaatcaccaccgccagagtcaaccaaaacgtacgcgtcgtatgcgcgcgattcgtcgacgcgtctcgtcggagcaggcagcctctcgctgtcgcccgcgtcgcgctcgtcgatctcgatccgttgctaaactcgaacgggaatgcgagctaattacggggtttagcatgtgtaataaggtgcggtgattcgatcgatcggcatcctcgtgcatgcgagccgtacgtaccggcctaccggggggatcgaaaaaaatcgtgtgggtctctagggtcccaagtgtaatcgcttccatgatttttttggtgaggatgatgtatgatgttgacgagcaactcagaaaactactatctcctcaccatcaccacttttatcctctccaaaaaaagagtacgaagtagatttcatcagatggacacttggacggatggtggtgctacgatcacgatagatctcttggggccccttcccaactgtaccagattgcttaaaaaggatggcactccatgtctcacctgaaaggctgatgactcggagctatttccagacgtgctagaaggtgaggtgtcgtccaacgacaccaccacgcaacaatgctcgtcagaaatatatcgtgcgatttctgctgctgctgctgtgtgcgatgcgaacatttcgctggagaaaaagaccagcgcactcgactcgaccaccatgcatgcgctgcgctgcgctgcgctgccatgtgtgcgcctcggctcggcgacagcgcacggcgcgtatgcgattcttgccttggactccatgccattgcagcgccgtgccatgtcgcgccgtggccaggccgccgcgccgcgccgcgcccaagtctttgactcgcgggacgcgccgcgcgcgcgcttttctgcgccggaatgcttgaaattttcgaccgatcggggccctcgttctcccgacatctccgcgccgacactgcccggtaatccgcttgcgttccggtcaactcgtcgcattgctcgcgatggatttcgtcgcggtgcgtacactggttgcattgcatggccacttggccagcaacggcgacgtcgtcgtactcgccgttttttcactcatgtcgttcgaccacaacacaaccactacacacgactacacgagtcgcgactcgcgagtgagtacactacactgcacacgaaaggaacatgacgtagccgtagtatcgcccggtggtcgagatgtcgaatgattggtcgcatccaacgatcggagataagaatatcgtatgctactcgatcgtctgtactactgctattatcgcaaaggctaaaagggggattagctagctagcgacatactcacattggggataatgatgctgtggctatagtgcggcagctgctgctgggatgacaggatgagggcagtgggtacaggtgttgcttttgctttctctgcagatcttcttcaatccatcgcgagatctttgccgtgattgtatgggtttgaccctggcgaatttcggttggcaattgcttagacagttcgatcaggatcaattcccttttcatttcggcgacgtcgtcgttgtggatcagatcaaagagtaggttatggtataaaaacagtacggattcattggaccatcctatacttgattagcatgttcaaatcctttactccaggaatgtttggcagcattccggctcagcatgtttcaggccaccaatgccatcgaaacatgggtacttttttgcacagaatacgccatgttatccggggtatagggcttcggtttgttgatggcgatcttatctcttcccgttttgtggcgaactaattgcgaattatatattgcacgcgcgagaccgtaccgaattagaagtccattaagaaaataaccgaagaaatgaagttgttggaacgtaggagtaaatctactttaattcatatctgcaaatcttgctccagaggcaactaccagcacatttctgtgcctaatccataacaatattaaattactggcacacacgtatgcactactaccattgtagacttggtagtagttgttggcaccactactacctttcgttgctgatctgggtcatgaccattctgcccctgagaatgctatacattcacaaagtcaacaggtcatttgtaagtgtacccgtatatattggtcagctcctgtggtctccgttaatatcggctcgttttggcatgactttatcgaataaattaaatcaggtcaaaccaataatcgagtttgctcgaacaaaataggtgtgtgtgtgtgtgtatatgcaggatgcttaggagacaggtgctgggatgcaggctctccttgcatggtctaattggtatttccatgtcgtgcagaaataattgggaggagatcgtacggctccttgcataattgcattgtatattatattgggtactgtactaatttcttcatctagatatataactagatttagcatcgaccaatgaaacggagtaactggactgcacgcaatagctagctactccagcttgtagtttggtcacacaagctaggtgaggaccagggacaaaaggaagcagagagaggacactgcatgcgtgtcttgtgtcgtgcataatttggggttaaacatgcgttcctgctgctatcaatatgcacgaatccaaggcaaaccaaaacagtagcaaccgataactaactccgaccttaaattaccacggcaatttgtcacgaaccaacacaatcacaccaaatctctcacataaatgccaccgatatattacaatccactcaagaatataagtgtttagggatacaaaattgaggagaaagagaggtatagtttgagaagagagatcagacaagaggaagcaggagattgggactagagagtaggaattgagaggggaagcagcagcaaggaggaggaagaagctatcgtctgaggcgttctggtaattgattcatcgatgaccctggctgctggctgctggctgctttgcctcttttctagtctccttctccctagccgaatgggcccaaagccagcccacttgtctagcctcctggaaagacatcacagcaggccatgtacatgacattcttcccccgttaagaatcggcttgtccccaagccgatgcaactgactcgccagattaatgcccccaagatcccaaggtacctgcagggaaatgccttgttgggcagaatcccagaacaattgtttgatgaccttcgaaccatctgatgtagaccctgcccactgttgaatccacttatccaacatacataaaacctgagcattacaaccacactctctaccatgcttttgctgcctcaaccaccaagccttcacgccttcttcaccactactatcagcatatactccatgagagcccagatgtaacatgcaaatattgagatcagtgggctgagaaacatgcatatgcttctttgtctgaatgagagctacttctttgtttgcaaactcccaaattgctaaaaattgtatggttttaccttgatcaccaaccaatcttgcatcaactaatttaaccactcgataggcccatgtgtgcaagactatgctgtcctcacaaactaaacaaatgaggcatctctctgaacatttaaccagttctattccacgagaattcttactgaaagtgctagcttccaaactgagatggactgcaccaagtttcagctgctccctttgtaacaatagctcatgtgtctgcccatgttaattattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttgcaagttgaccaactttcttgttgaaaccctaaatgcctcaccattgtttgatccaaattgagtccaagaagtatcatctagtacatcattgttgttactctgaacctgaaatgaaattggaatagtatagaaccgagcatggcgatgggtacgtctctcatgtgacttgcaagtgcaattaccatcaacattagctccactgaacaaacaatcacaccatgcatcgggtgatagatgggaaatcagcatcagcagcaagaacaattcatgatccccatatgcccaaccataggttgaatgatgtgtgtgctgataggccttcctaaaggcaccagagagacatatctcataccaaatacaccatccaacaatcagattttgcagcaagccctcagtggaattaattgttctactcatgaattgggcaacgctgtagttcaaggagacttgatgagactcaccatataaattcagtgtttcaatttcagctcaaacacttgtttgaataagtggcggccagggttgtaagagttttaccaccacgcctccgctgccttgacaaagctgtggatcaagccatggtaacggccgagaacctgaggtcatctcagctttgttccgtggaattgctgctctccaaggtggtactggtggagggctagctgtgtattctgagctccggtcaaagcaaccatagagtacttccaatttcaatgaaacgaaagagaggccgacaactccaaagtagtcacggctcaagcaccaactccagttcctgggaggaattgcattgatgattaacaatggatctctgaagcataaatacatagtggtgaacttggtatctacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcgctcaacgctgccacatctctagtggaatccttgctcaaggataaatccaccttggtgtggcgaaatgcctccagcatccgatcgatcttggtgcacaggtcttgaatggtcttgtctaagttctctaccgccttgtccatgtcagtctcagccttcttggtctcgttgaaaggaaccgatgtcaccatggctgctgatgtaattgagggtatagatgaagctgttgtagcagggaacacgcgttctggtgtagcagcagtactcttggccgctggcctggcggtggcgctacttggtaccattgtcaaacaggtggtgtgcgtggtggtggcgccatctccagggaacatctggacgtgctgcacatccattaagcagcccccgtcgtagatgtcgcgaccgtgggtggcggaccgagccctctccgcgtcatggctggacataaatgacacaagagccttgacttgccatgtgctcactgcaagaacctgcaccgccactgctccataggtattgtacacttgatgcaacacctcagatgtcactggatatatgatctggctcacggtgacgcgaaggacagcagctgaatcgcctcttggacaggtcgacatttcatcgaacaggtggtgggcatctcctccaaagacaccaccaccaagttgttggcagttcctctgaccaccagcgctctcccacttcatctccacaccagaaaccccacgaattgactgctctgataccatattgtcacgaaccaacacaatcacaccaaatctctcacataaatgccaccgatatattacaatctactcaagaatataagtgtttagggatacaaaattgaggagaaagagaggtatagtctaggaagagagatcagacaagaggaagcaggagattgggactagagaataggaattgagaggggaagcagcagcaaggaggaagaagctatcgtctgaggcgttctggtaattgattcatcgatgaccctggctgctggctgctttgcctcttttctagtctccttctccctagccgaatgggcccaaagccagcccacttgtctagcctcctggaaggacatcacagtagcccatgtacatgacacaattccgggctagtacgggaccaaaagcatggaaaaatcatgctttctccaacgaaaggataaggctcttggaaacagctactcgatcgtactcccatgaaacctatattcaaatacgtagtaatagaatacgtcacatccaatactatgttgttatattatggaacggaggtagtagtatcgatggtgtttttaagaacttctcccaaaaaaataataataataaatctctaaacagtttttctttttatttcattatgtaaaaaaatagttattgaattaaaaaaaaggtaattttatcatccttaaatttaccagaatgtatcacactttctaatgtaaaatttgataaaaattagtctaaactttaaatacatcgaaatactttttctaggatcataaaatttctcactaaaaaaaactaaaagctaaaagctggctttctcatcttcttcaaattgctaggagctaattaccgatcaataatttgccataatcttttgcggatctaaggagttgttggtacgaatatcgccgacgaggcgcgccaaagatcacccacacacacaacacgcacctcacctcacctgccctccgctgatcgaaattagagcaagcccagcagagcttccatccggacatccatcccatgtttggcgtatggaggtgaaaaaacacggtccagcagagtctccattacacacgccattttagatgtcctccaaaccaagccctctccatgccatatttggcgtttctctctcctcacgccattcccccaactgcccagctccgacgaactcgcgccaccattcgaacttgtgccaaggggaatagagaggatggacataccgggtctgcagttggagatcgccggagtggaggccccgccgtccgcgccgccccactgctcccgccattggtcctccgccgcgcgccgccaccatccggactccgcctgcgccgcccccactgcaggcgccgctgctccttcgctcgtgctggagatcgccggagtggaggccccgccaccatccggcctccgcccgtgccgcccccactgcaaatcaaccggcgtcgctgcttcttcgcttgcgttgcccatcgcgactccgtccgtgtcgccgcgccaccctgccacctgcaccgctgtacctccgcccatggcgccctgcccccgtcggccgcgccatcctgccgcatcccctccgtcgctcctccgcccgcctctcactatctgttggtctcccaggagcgatggatttggtggattttgttttgttttgttttgtttttagcgagaggataaggtaaatgtggctgatgtggttttaaaagaggattaaaggtggtacacagtgttctcaaagtggtaactgcaattaaatcgaaccaacacctattcaaaccattgtaaatatatgcctcttaaaaaatcattagatatatatgggtagttaaaaaatattagtaaaatatagaatagtgtgatatgaatgctgtaatatggatgatttattggagtgggtaaaggtatagaggaggaatcttttttggatgaccattcaaatagaaatatagaagtccaaatttaaatgatctgctgggatgctcttaagcttcttctactagtcctctgttgcgtacgagcaggacgtccaaaggcttcgtcatttaatcgcgtctcgccttgcgcgatctccaatcgagctaatggtggataggtgatcgatgtgttggatattttctggtccggacacgcacactaaaccctatggttggtagcaaaacgcgctgcacggctgcactgcgtcgcgtcgcgtagcatcgcagtgccggtggttatgcttgtgcctttgtcgatggcgtttactagtacatggaaagttggaaacgggagttggttatcgatcatctcgccattattagcggtgatgacacttggctccatcaccatgattcacgattattcgtgtcatcgtgtgcgtgagggcaacagaaaaaaaaggagagaaagataggagtagtactagtagtacacgtgagtagctgttcgtggcatggatgaggtacggctttcaatagtggccggaggttgtggatttggagccttggaggacgtcctacaacggctacaggagtggagttcgtattattggagggcaatggaacgagatctcgacgacacgtcgatatggacacaccagcgcacagtgcatcgcactgccatttgagatgttgtgagtgcatccttttaaccgggagtccgggccattcgattgttctgcacgaggattactgtactgatgtgggccaggacactgctgccaatgtgggtacgtatgggcctctatggcccattaccatcatgtacttacatgatgtgggtcaggccactgctgccaccgtgggtgaatatgggcctccatggcccattaacatcaccagcaactgtatatggctcttactccactatttggtttctggactatgaactgaactaatcagcaatatgttgtgattcacgtcatgtcaagattcactgggcagaagttaaaatataaatggacggaagggaggaacaagtacaagcattcagataagaggatagacacatattgctttcaaatattcatatattctcactttcatagacatagggtgtgtttggttgcaagccacactttgccacacctaaggttaggcaaatttgacaggtgtttggttgtagccacagttgtgacaagattcccctccaacaaattaggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccataaaaacgcagattagttacaactccagtcccagaagagattaggtcttcacccagaacgctatcgtcaacatttacaaagagtacaccgaaacctagttacaactaacaagtattacaactccagcaatcttcacaaagagtactagtattatcaacatgcctgcttacaccaaaa

SEQ ID NO: 30949 - DNA, 2184 bp, Oryza sativa
cagtagattctcccaccatgatacgcaaagcaaaataagactgtcagtgtaatcgtctattggctaaactgaaggagctgactttcatgggtgttgccaccaccagaggagcctcaggggagtcggttgttgcaaatttctcgtgcatgaaacggctgtcaacaatggattcgtctttcaggacaactttgtaacaatagcagctcttgagcccttcctgatcgcggtagcactcatggttgctgtccttcacctgctgaaagttccaaatgacactaaatttgccaactgtcgcaacaagatgcttttcttgcttcccattctctgttacctgggaaaatcagaacatatagaggaacatacataaggacatatacttaacaaattgaataattatgcagcatgtaggcattaatttagcaagaaagttaacatggcaaatgccaaatgccaaatggacataacagaactgcaggatgaaactttttataatgcacgattgacgtaagtgaaacaactgattgccactagaacaaaatcaacatgattgacgcaagtgaaacaactgatttactgcaattacttcatacactcttatgacaaggtcacaggttgatccgttaaaaacagagctagggcctaaggtgcagggttctttactttagttctactcattagccccttgacaagctgagaattggaacttcaagcaaccaaatgttccaaacaagcagtcaataagcttgtttttaatttaacaagcttatgtaaatattgaacatacttgctaccaatgaattaactgaaaacatatttattagccgtactaccctaaactgggatggatcataactttaccagtttctcccaaaaggtacagcatgattatttcaagatattaatgtgtcaattaacatacataggagatagagacatagagtgaacacattttcctggtcagattgtattataggcacagcaaattactgacaagcagccattttggatatgaaacgcttgcactgactgatcataagtgaaaacaaacttttactatagacaagatagataagtgtagatggtttgctagcatgcacatatgaagcaacattctgtttggctttactagattacaaaataggaacattcactaccgtgtgttctatctcaattatgaaaaacaatatgctgtacaaaataggaaattcacacttacccaagagaactgcccgccatggaatttgttctcggaccctgccaaaattgaatccaatggggagagcttcagcaatcttggtgctgcaatcctatttcccatacgcccactgaatcctgtcttctctttaccatccttgtccttaaagatggtacagatcaagatcaaatatgtatcagtagtgcccagaatccacttcccatcataagtaacatcaacatgtgtgattggtgatccaagccctgggaatgctgtcttcgccatccgcatcgaactcttggaatagagcctaatcttgccatccacagaaccaaccacaatcgaaccatcccctgtacttgcaaagcattggaaattggtgccccttgagaactgatggccctgcgaccattgcagcaccggtgactcagatgagctcccaattgtttgcaccctgcccctggaatccctcatatcccaccggcatagccggttgtcatccaatcctaagaaggttgatccagagggttccagctgcgcgcccttactgtcgttggcgatgtctcgcattgtgatgtcagttccatccttctcaaacctccactgagccacaaccttgccagtctctatatcaacatgatggacgccattggaatggcgagtgccagtctctccagggctcatcagaagcatattcgtctcgccacgcataagcagagccttctgcggtgtcatgtacgcgttcccaccaccacggccatcagatatcctcacagagacgcccttgccgtgcacgccatgccggaaattcttgaccacctgtatccctgaccctccaaccaagaagctgttgtcaagcgcgcccagcgcgaggctctggatgctgccgtccccggcctcctcctcgaactcctcgagcaggtctctcgccggggtcgcaacgggaggggtgaaggagtcctctgcgtcggcccagacggcgtccgtcg

SEQ ID NO: 30950 - DNA, 12900 bp, Oryza sativa
atcggcccggcgctgcgcggggagcgccttgagctgtagcgccgggccgacgggggcggagaccctgggacccggaccaacctccagaacccacctcgggccgccacaatcgctgtcgcccgccgccgtcgccttgtcgacgaaggcgtaggtcgcccgccgctcggccggcacccagcgcgcggaggcggaggcgccgccgacgtggaggtacagcttcgccgcgttcggcgcctggtacttgagatcgagcgctttcagcttcgcgtcgaggaactcgagggaggagggggtagaggtccggaggatgtcctctcgagaggcggcggaggtggcggtctgggcgtcgtactcctcgtcgtcgtcctcgtcgtcggaggaggtgaggtcgaggtcctcgcggctgtgggcgccgcccatggcggttgcggtggtcgacgagaattccgatggatgcttctcgctgcgacacgggaggggggaatggagcggagatgaggggaaagtgagatcgcgggagaggggggtataagtacagaacgccacgtggccgcggtggcgccgtgatggtcggttggtgcgtgcgtgcgcccgacgcgacgcgcccggacgcggcggggacgacgaggtgagggcccacttggcagttgcttcgcccagggggtcaagagaaaagaaaagtaataagtctactttatctccctcgactcatgcgtctggttgaatcgcacccctcaaccgtaaaaccagaccgttgcaaatcgactccctcggtggtttcggaggcggttttctcttacctagcacttacgtgacgggttgacttggtctttatcctatgtgcatcgacgtggcgcttacgtagcactaaagtaaaaagaaacctaaatagaaaggaaaagaaattttgagcctacatgtcagttactcatctcctccctctttattctcgacgacgagcgagatgaagagagcggcgaggcggatggcgggagctcgccggagcgacgggacctcgccggaacggcgaggcagcgggagcggcggcggcgggacctcagtggagcgacaggagcagcaggacgtcggacatgagttgaaggaggcaaaatgaacttattccaaaagaaaaataggcaacctgttgggccgtgaagcccacggaaattcatggatagcatccgctaggcccatccgaggccacgcgtgaaaccagcggcccaatatatatcggctccgctcgaccaccacgctggccgcgtcactctcctccccctcgtatcgctcgggagcggaggtctcctcgcccctagagcgccgccgccaccgccaccgccgcggccgccgcggcggggacttgccggtgccaagtccacacgccatcgtcgctcgcacccttcccgcgcaggtaactccatgcaccttgaagtttcacctcatgcgttgagtgtccacgaccctcgatcccctccgctttcggaaccctagaaacccatctccactttgattccgtcggtttcgttgcttatgtggttcgatccgtcagccggttctagttgaggaaccgtaggaaagctcatctcgtgacgggatgtgatttttttttcttttttgggcggctctcgattagggctacttttggttgggctatttttggtttgtgcgcaagggtatgaaattggatgttgttagttctgtgttgctgtcctgtggagaatctgtgatgcttcactttaagcgatatatgttctttttaactcatactccctctggcccaaaataagtgcagttttagcactgttcatatccaacgattgaccgttcgtcttatttgaaaaaagattatgattagtatttttattgttattagatgataaaacatgaatagtactttatgtgtgactatttttttaaatattttttataaaattttcaaataagacggatggtcaaaacgccgagcacgcatatttatggctgcacttattttgggacggaggtagtactgattaaacctgaaaggtccgaggttgggttaaggattactgcaataggtaagaatctccaaagtcgatactgtggactattatggctgtttcatgttgtgtcgatcagcttcagatttctgacacctagctctttactactatgtggatgaaatgaattcagaactgcactcttagtaaaaagcttgaaaagcttcttgaattagcttgtagcaagtcatagtttatggtctgaaggtgtaacatttatcttttggtcctcttgcattcatgtagaaatatatttagggaagagctataattggttcctttcttacttcagggatttgttcacgatggcccgcttgtatgttggcaacttggatccccgagtgacttccggggaacttgaagatgagtttcgtgtgtttggagttctgcgaaggtcagtttctgcctaggcaatttttccacttcatctaattgggtgtttggtttttgcattgtgctgcattagtcttgtgtagtttttggatagactagttcattaattgtgtgccggaagggtaatagttcatcccagctgtgcataatgccataactgacttgtgcatattcatgcaactatattctgcttgcattataacatcagtcttatggtattttagtgacagaagttcattaatcgtgtaccaggaggaaaatagtgcatcccatgatagtcctacgtttggattgatgatatgtgttgttttaagtgtgacagaactctatgtccttttaccttttttttaataaaaaattcttagctaattggatggccatctattcctgactcaatatagtggtaccccttgtactataagttatttggacgttgcgggtatgtttgttgatgtaattttcaagtgtatttttccatgcagtgtctgggttgcccgtaaaccacctggttttgcatttatcgattttgatgacaagagggatgctgaggatgcactccgtgatttagatggtatgtaacggtgttttttctgcacactgtctgaagtttgtcagaaaattcttttgttctattttgatgaccttttatatgtcaaattagcaataccggtagacttcttgtcctttttgctctttttgaatcaagctttgagttaggggtgggcattaaaacagataactgaagaccaaacccgataaaaacagaaacggaaccgggaaaagacgtgaatctcttgggcatccgtcattggttgcgggtgtgacatctgaaagaccgaacaaactttggaaagattcggtcatcgtgccaatactacccgaagaagccgaggaccgaagaaaccaaatcaatacaatcactaagcagacaacgtgaccatcctatggaccaaaacagcccaacaacaaggtgaggcccaaatccacgtcaatgacccaatccccatgaccccaccattccattgaccgaagcactcctaaccctagttaggccacgcgccgccggcgcaccacttatctcgtcgcatcgcatgtccccttccttccacgccgccatcttctgcagtgctgccgcatgctgctgctcgccggcgtcgccgcagtgtcgcatgcaatcgtgtggtcacgtggaagccataaggaggccacaggctgctggcttgctgatcctgctgcacagccgcatgccggccgctgcgccatcgcgtgccgtctgcgtcgcgcggctgatttctgccgcgtcgtcgccttccgtcccgccagcacttgtcaccatgctagtggatatccgtcccatgtgactgaggtggagccatggaggttttcaggagcaagaagacgagaagattgaagaggacgcacgttctggttcgggcacctcggtttagaccgaagaccgaaccgaattttcggttaaccgaagtagcggttagtaatttttgcttaacaacttcggtttcctgtttccaaagaccgaatttttaaaagaccgaactaaccggaccgaaatttcggtctagaccgaatgcccacccctgctttgagtggccaggaaattttatctgtttgacaatgtctcttatctcgagttcttgaatttcttttatcctattgtattaaaatgcatcctgaccaatcatcttcataggttgtgcaagctttgtccctgtgtagttagaattaatttatgcattatcaggatttgttcaaatgcgtggttcctcttttaataggcaagaatggatggagagttgagctctcacggaactcaagtagccgcggaggtcgtgatcgacatggtgggtctgagatgaagtgctatgagtgtggtgaaactgggcactttgctcgtgaatgtcgtttgcgtattggtcctggaggtctgggtagtggaaagcgtcgtagcaggagtcgcagccgcagtcgcagccctcaataccgcaagagcccgacctatggtagaaggtaactttatagtgctcaatgttgtatataaatatagtagtatggttagtttggtgtcaactttattttccatgcccaatttttttttgatattttgtgttaaaggtggggacttacacatcaataactcttgtctcataatacgcttcgcgtgatccactttttacttgcagttaatccacttgttctattaaacacctactttgttgttgaatttattgtaatatatgatgtaaaagaaaggaactgagctaattattctgcgaacagaagctacagtcctcgtgatcgctctccaaggcgccgcagtgtttcaccagttcgtgggcgcagctacagcaggtcaccacgtggccgaggtggttctccttatgctgatgggtaaggcatattttgttaattttacaattctcgtcttgtatggctttataaatcatatattctttatcattcttatgcatgcctgcttttcaccttttttccagaagagatggtggcaggtaccgccgtagcaggagctagaccctgatgcctgtgcttgaccgtctgctctttggcttgcatgccatgaatgctttaagactggcatcaactgattgacttcaattaaggtttactactttatctgccttgatatttcagcctcttatttctgacgttaaaaaacttatgggatggatgtaatatgcaactaagacatattacctttctactatgtgctaaagagggatcattctgcttaagcgactcagccaactaccggctctgtctgcatggttttgttctgcactcttcattcctcgagcgtgttgcctgcttcatgtgaagttgcaagcaaaagagaatcttccattgtttcctgcctatgatgcctcgttgtggttggcactcttcgttgaagatgctgcatcgtcacaaattagtaacatatttcctctcataaaattgataacattttgagcaatactaactagtgattagtgcagctcgtgcaagtaaatagaccatttttttaatagaaccatgcatcaagagattgatacagcaaaataaatcttcatgtcagtcgttgggttaaaacatcgcattcatctgcagcctgtaattcagcgacaaaaggaatttgctgggttggcttccgcaagaggcagagactaccttttaagcggttccaccgactccaccccttggctttattctttctggtttttccttcactctgcgcatctgtcggccttcttcctgcactgcatcgccataatagtagcctctatatatgggaccttcagatgaaatattctcgttctgcattcttcctaccggcggccattagacaaaatatgttttttttttctttctgtttatgtggtttattacttttatttgtatctcaaccgttcagaacaagtggccagcacttcatgtctcaattgttgtgaattactcttttgacctagagctaataacagcctcagttcatatccatttcatatttatgtgctgtacgtcactcatctaatatatctgtactaagtatatgttgcttgtctggttctggaaccgtagagatccataccataaattagggtctgtttggggagcttatctgagaagcaactggttggtagccaatttctcagaatctgggaagctttgtttcccagtttctggtttctagtttattttctagattctataactatagcttctcagaatctggatcaaaaactagagaagctgtagcatcccctaccactagatgttgtgaaattcccatgttcggtgtgttccgtcctctctagtgattatatttttcctataacaaagttagctcaaaataagccaaagaaatgtttcctggaagagatttggatgtgagtttgctgttcctgagtcagttatggacgtatggtatagttaatcggagttcttgctgataactgtctgtgcttgcttccttttatttctttctttggtcaaatatgatattctgagatacctctcgcgtaaccaaatagatgtgttacaatacaacacttgggatatttcctcaagaagaggtaaaccctggtcggatttttttcatatccattataatttcttgcacgggcacaccacacgatagcgcacgcccacatgttctctaccctggcctctatcacggctctaatcagagttgcttttttttcgtatcaactactagtatcaggctgatactagtagttgatacgtttagcaaacgaagagatgctgtctagttgcagataaatcaaattaatctagtgaaggttggcgtgcaaatatgttaaagcagtcgtgctcttgtgctagtgactgtcagatgacgcgcttcttcgtaaacacaatttactctactcccctcatcacagtgtctatctgtcacaagatgctcgcctgaatatccaatcagcaaccaggcaacctcactgccaaatgaactagataacaagagatcgatttctaaacagaaccaacgagtgtgttcagtatgctactgcgccagatgacgattcgttgatttgtagtactccctccgtcccataatacaagggattttaagtttttgtttgtactatttgattactcgtcttattcaaaaaattttagaattattattttttttgacttgctttattatctaaagtactttaagcataacttttcgtcgtttatatttgcataaattttttgagtggtcaaacagtgcaagcaaaaatttaaaatcccttatattatgggacggagtgagtaatagagtaagtagtggagtagtactcccttcattcctaaggtggagagggattaaactttagttcctaattcctaaacaccacctaaatgatctacctatttcaccagcaaaagcaaggagcagttactaccccatcgatcaacataactttgtatgcagtgctgcttaatacgaagtgccgtccatgatttctgccgcttcctaacgaaatacgatgatcaaattggaacttttatttttggtaatacgaagatcatttaggaatggagggagtactagtttgtaccagatgacgattcgttagttggttttgaacattgtttaaccgccagcacgggacgagcgaatcgagctgcctccgagtgcataaacaacaagcagagtcgcccactcgccaccgccaagtccagtttctctattccccagctgtcgcgcgcacgaggcgccggtggggatcccgaggaaggagagcacgtcacgactcacgacgtggacgcgcgtgagatccctccattctttttgtgactcgtaggtggacttcccctcgtgcgcccgcgcgccaggaacgcgcatagccgcagatggccgcgccgcgtcctcggctcggcaatttgctcgcgatcgccatcacccctcccgtccgtgcgtccgcgggaaacttcccttgcgaatcgcgtgcccgtccgtcctccgcccgcggccccgcccgcccgtgtgtggcgccgcgcgttttctgcgcacgcgcgaggcgtttgctgcagcgacagtgcacagcgctcggagacgccgacgtaggtagttgtatactaccatgaaggcactgcttgtaaatatctgagtgactgtgtctatggcatctgcttttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgtttttttctctatagactatctccaggttagtagatagctttgctctctcttcatttaatctttttcaagtaggaaaatatgctgacatggatctcttgtagagagcctatagataatcattgcgggtgccctaatgaaacggaatctggtcccttttgctgccctttctgggacgcaccacggcagaaaaaagggtcaaaagagccgcgggcatcatgcagtagtactaagcagcacaaacctgtgtctgtgtttgtccgtccattcgctttcgttgacctctagctctaatcaagccattttgcggtgaccacttggggagttggggacaaatagctactgcccctccatttcaggttataagatattttgactatgtacaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctggaacgtgccagcgatctagagatggcaagacaaccaaccaaacaatggcacctcagtcacctcacggctttcctctgacagatgccgtcattgggggtccaaaccgttagcctcaacatgtcgccacccgttgtttccacggccttttctgctctttttttcttcagccaggacctgatggatgctgatgactttcgcctagtactatttatagtcttgtctactactactacacattcaaagtgttctttttccggtcagttaaatcatttcggatcagaaaaaaaactcattttatttctcatacccttcttcgcctcgacgaccacctaccacccaccttctcatctctcccttctgataatcgccaaagaagaaagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgatccccaccgctgcgctgaccaccctcctcgtgccgatgctgcgcagaagatcggtctttggccgcctccccgccagattcggccggtgaagctgccaaggctgctgcgcggtgtggttgacgagttcttgctcgctgactcgctgtagctgatgccatgtttggggcggggaaggtggacgatgagatggcgctcaagaggcagagaaccgtgaggtgagcctgcacgagcaaagcaaaagctcttctttggtctagttttagcttttcagctcttagagatccaacaggctctgcgacctgcgagtgatttggcatttgctgtgagctttttcttgttgttctaggaggaaggacgctttagcctggattgtgccagctttctaatttcctgttactctgcaaacaatttatgtatttgacctgttttttagagcatagactccttttaagaacccaaattaatccattcgatttattctatagcatggtatgatgaaggttttcatcccttttagttgatctggccaggaaagattaacctttcgtggataagaaatatagggcttcaaccaaaattgatattagaattaaattgtgttaatgtacaaaaactgttctaactgtcagttctttatgtgatttagtttacaatgggaggttctatttcattcccaacattatttttcttattttcactgttttggatggacatacgaaaatattcatgatgtagagttcaaacatttatgtgaggctgtaattcacaggttttatgatgagaaggcaaaaccaactataccaactcaccagaaacaggcagggttcgctgctagtaaacttggtgtggcaagctcaggaaagaacaaaatttttgtgccagaagaagagctgtggtacaaaaggattttggacccatcaagtgacttcatcttgacatggaaccacattttccttttttcgtgcttcgttgctctatttatagaccctctgtacttctacgtgccaaaaatctcctatggcaccccaaattcgtgtattgggacagacaggcatttagccatcactgttacattcttccgatcaatctctgatttactatatttcactcacattataataaagtttagaccggcatatattaatccgagctcaaccatgagggtatttggaagaggagaccttatcacggatccaaaggaaattgcgtggcaatatttgagatctgacttcgtagtcgatgcagtggctgcattgcctttaccacaggtaacttggcgctcttccttttattcttgtcaactggagtataaccagtattaatgatcattattgttaggtcgttttcataactgagtatatttgttagctctgatgttgtcttatgttcatttatctgcatgcggacataaatatgctactgtgctaatatcaatcgtgaagttctattgtggatcacctcaattaagtttctttacagcagatgctactatagtatcttgtggataaataatgatttgtaactgtgttagtgctgcccagaccacactaaggacaaaataattttcccctcgcttaatacaaaagatacgcatgttctgcgtattctcaaaaaaaaaaaaaagtgtcacttgctcaatcatcctgtctctaagtcagcatgaaaatcctagggaatcatcatgttcaatcttggcaaatattcttcatagtttaagagccaatcactaaactgaaacattttcatatgatgcattatgaatttaataactattattttaccatcagtgccgaccacatgtattgtctcttgatttttcttgtgaattcctgtaagctaaaattgaacctcatattaatgttccactggataagtttactacaatgggctccaaaatgcagcaacctgccatagcatctccagtttgtttgagctgattttcaatggttataatcttactcatcgggatttctaggttctctatgcttcatagggcaattttgtacatcgtcaaacctaaaagcactaaataactgaattttatttgtgcagctgtttatattgctctttccttcaaatggaggaatcttcgattttgactttgcctgctgcttatgtatctttacatttatgcagatcttaatctggtttgtgataccagctattaagtattccactgatgagcataacaacaatattctggtgctgatagttcttgctcagtattttccaagactatacctcatattccccttgacttatgaaattgtcaaaactactggagttgtcgcaaagactgcttggcaaggggctggatacaaaatgttgctttacatgatagccagtcatgtatgggattcgtaagcgtttacatgaaatgtgttctacatctcaaatattggtgtacagccaaagtcgtattagatgcatttgccagtctttaactccatagctataatgtctccaaattttcacgatctccattcatcttctttcaggtactaggtgctctatggtatttgctatctgtcgatcgccaaactgcctgctggaagagcaattgcaagaatgaaactggctgtgatattaaatttctagattgtgatgtgataccaaatcaaaactgggcaagcaaaactgctatcttcaatacctgtgacgcaactaacacttcaatcagttttgattatggcatgtttcagcctgcattgtttaatcaagccccagggcaacgtttcttgatgaagtatttctattccctttggtggggtttgcagaatctgaggtatttccttgtcaaaacatcttcgtgtcaaactacagcgctataagaaggaacttagtttacagtttccttgtgaaatgtgtgtgttcagaaatttcatgggaatcacggagatttttgtgtcaagcaaagcagtaaattaaatatggaagtttagcctagttcttttaatgggatcattactttaccaattttcaagatctatattcattttctaacgagctatatcctcctcttcctttgcaacagttgctatggccagactattactgtgagtacctatattggtgagactctatactgtatattcttggcagtacttggtctcgtcttgtttgcacatttgattggaaatgtacaggtaatttttaaatgtttagtgatcatgtctacactacgattgattcttttggcacttttttatacactgctactatttttccagacctacttgcaatctatcactgtgaggggtgaggaatggagattaaaacaaagagatacagaggagtggatgaggcatcgtcaactcccacatgaactacgagaa

SEQ ID NO: 30951 - DNA, 6748 bp, Oryza sativa
tattgtatatactggtcctcttctcttttaaaagattattagagtatatagttagttttagtgctgttttggtctcagtatatacctggagtttctcatgtactcactaaatttgccccttgacctacctcatcaatggaatatttactggttgcaattacttgattccttcatttatattagaattgatcttagcatcatatttggcaatgtcacaatgaactagaagtgattggattcttatatagcagcagtaactatttgatcctagttaagctagtggtgccgggttttgacaatagatggcccttgatcctaattaagtgtagaaataggcagtctgagattgttagtttgcatagttaccgcagggtccaaatattctggagattccaaacaactattttgaaactgtccaaatatacacttcttttttttaaaaaaatgcatttcttgggcaatttacactacaggtttgccttatacttgaccggtgtgctaattttgtctttacctaccacaatatttcaggttcctttcttctcccagatggacaatcaacttttggacgccatctgtgagcgtcttgtatcatcgttgtgcacacagggcacatacattgtccgtgagggtgatccagtgaccgagatgctcttcatcattcgtgggaaactcgaaagctctacaacaaatggtggccgcactggcttcttcaattcaactaccctgaaatccggtgatttctgcggcgaggaactgcttgggtgggctcttgtccccaaacctactgttaatttgccgtcatccactcggacagtgaaggcactcatagaagttgaggcattcgcactccaagctgaggatctcaagtttgttgcaaaccaattcaggcgtctgcacagcaaaagattgcaacacactttccggtactactcgcaccactggagaacttgggcctcatgcttcatccaagctgcttggcggcgatacaagaggaggaagatggcaagggacctgagcatgagggagtcattctgctccatgagatcagatgactcaaatggtgaagatgactcgccacctaagcagaatctcgctatgaagatcatgagtgggagtaggaaaggacctcagaacatgaaagagttgcctaagctaagaaagccggatgagccagatttttcagctgaaccctgtgagtaaggtctaaaatgcaacagccattgcttctgctaactctgctgctaccagttaaccattgctatactaccatatactgttggatcgacggcacgagttgtccaattgttgatgagaaagttcattaacttggaaactaaaaaacatggagaagcagcgaattcacgaagggatcgaggctttgagttgactagatgttttaggcgttggcaacttgtacatccagatatacacgtctgtgcttgtaacattcttgagatcttagaaacggccgcacccttacatttgactgcagagaaagagcgtaaaagaactgaagaaagatcaaacgtaaaggcagtctgtatttttgggagtctgtaaagcgttagggcggctattttttgcttttaactgatagacatttcgttgtattgtgcaatgtatttttgtggccaaaactgcaggttaacatctatactgtgcatacgttgtgcctcctttgtggctctctctcttgaacatatatactgtgctgtggtctgtggaatgaggagctgttccatttggtaacaaaccatggatacaatcagctgggctgcgtatcaaatatccgttgctacaagaaatttgataatttggcacttttatcgttgtcgacttgctttaattggtaatttttgagagtgacttgtgagatcatagtaaataaatgtagattaggatattaaatatttttttcttttttttaaggccaaggggaccatccaaatatattaagaaggaataaagtaaaaaaaatgacagaaaccacatgctaaccacgtaagcactaaaacgaccctgctatgcgtagtcgatcgtcgccaggtttacgacagcatcacaagaagagactctgaaaacggaagtgtcaaattatcaaatctccatacaagcgtggcacgcagggtggcggccggcgggtaggggagggatatgcatgtgggactgtgggcgactcatcagccgtcgctcgtggagaggcgccccacgcgcgcgcatggtgcgatgcgctcgttctttcgcgcaagctgtgcacgcggcgcggcggcctgggcaggacggtgccgctagttcacggggtggttcgcggctagcccaggtgaatcgcgggccgcggctctgcaggatcgatggcgccgccgccacgtgatggcccacgatacgatgatatgcaagcgtgtgtgtggcccaatccggcgccgcctcgatcagcctcgcgcctgtacacgttgccggtcgctgtgctgcgccctgccagcgcgcggcgccttggacgaacgacgtcgttgttacgctacgcacgctagctgcttgggcttggccagccgtctgcttcgccggcctttatcccagcacgctattcctcccttgcatcacacgctacttgtacggataattgagtcctactactatagtttcccaacccctcttctcgtttttcacgtgcatgtttttcaaactactaaatagtgtgcttttttaaaaaagtttttatatgaaagttgtttaaaaataatcaaattaatccattttttaaaaaagttaacaaatacttaattaatcacgtgttaatggatagctccgtttttcatgcatgggagatggttcccaacacccacctccgaacacacccttaactcgtactacaatattaccaaacggataaacttttctttagataatggaatgaaatagcatcccggcctttactcgaaagagctacagctaattattacaaactagctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaaaataaatagatgacttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcacttcactttatcttctcttcagggcggaggaactatatatatatatatttatatagagcaagggtgagtactttcgtactcagcaagtcacgggaacttaggtgtttaatgcaagcttggaagagaggcaaggtcgttttgcaaatcttttatttgaagactttttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttcttggactcccagagtccagctgcccagcagcaaagcaatccgcttccactcgggaagcctagtctatgatgcccacggacatcccgaatcacacagattcgtttctgaccactcaggtcatccatctgccacataggctgattctggttacgattcccacaccacaataacttttcacaaagcacaggcaaacaaatctacgcaatgggaaccacctcacatccgcccatgactgtgggcacggctgttcgaacagttagttaacctctgcagaggggtacactttacccacaagacacgaacttactctagacactggccggtgtcagaggttcgcgacaaagcctttcccaagccgacccagggatacctcatgccacatagaaggatcaaatcctcacataaacataggccattttaggcgttcacaaatcaaaccccaaccacctcgatcggtaattcagcaagcttctcgttcttgcattaccaggaacccggtttggctccaaccgaccccgtcccggcgttcccaactattggcatgcgaggtttccctgaaccgactagttacttggccagggtgtcccattccaccttgtggttgcactttgattatgttcgatgagtttcccacaggaatcggtccttatatgcgaatacgggacagtgccacataggcacaacccccgcatcgcaagttttcacaattcattttattttcaaacacaccgacaccacatgtcgggttttgaaggcttctcaaacccattccccaagttttcgacaaacagcggtgtatgtgggatatttggtatacgcgctcagagaacacgaataccgaggtaccacaagggtggagcgacaaggaatcagggtagtacgacctacgggaattagtgcgactactgggtaggtccgtcggtttggcacgcaaaccgaggccaagcaagttaagtgtgtgattctaataatgcaagttgcaaacaaaataataatgactttttagttataggggcaattgatcaaagggtgaattgccttgctcaaagtcttcacgaagcttcacgaatcttcaagaaaacccgcgatcgacgaaaatccggtaaccgcaactatacgcaaacaatcgaaaacctaaacaaaagaccaaaagaaagatcctatttagactaattagtagtgccattaaatagatctcaattttatgggaatactggaagttgagcggagtcaatcggagttgcgaattgggtgatatgaattttggaagtttaattggagtttctggaataggagaaatggtttatggaatttgtagaaataatattctcaagaatattattgacagtcactgtcatgcgggaccaaaggaaatggtttatggaattttggaataaggaattgatttatgggacaaaggaaaaaggatttattaaatccctggaaaaagaaaaggatggagggatgttaattggacttgggccgagcgaaggggcgcggcccgaagagatgcgcgggcgcggccgaggcgagcgggccggcgcgcgggagggaggcggcccaaggccgaacgaggcgcggcccacgcgacgcaagccgatggacgcggtccaccgagtcgggcgcgaggcgggacccacaaggcgacgacacggctcacgcgagcggggtgcacgcaaggcggcgcgttggatcggtggaccgggagacctttgaccggtctccgcggggccgggcaggtagatgtggcgtcctcgtggacagccacgttggcacgggcgagggaggaggccgggcggctcattggacggcccacggcgcgcggcgggatccggcgaacggcggcgagccggaaggggcggctagcactggcggcaggaggaggagaaggggaactcattccacggctcggatcaggaagaggacgcgcgacgacggccggcggcggcggccaatctcgccggcacgccgacgtggccgcgcgcgagaagagcgaagggtgcgcgggctcgggcttagccgaaccggtatggtgttgcgacgcgcacgcggtgacgcgggacccgatggtcaccggcggcgcacgcacggcagcgttatgcggcggcggaagcggcgacacggcgcggagacaagggagaagaccgacggccttggggcagccagggggaggtcaaggggatccccgggagcgtggcagcgagaggaatcgacgggagaggagccgacgacgatggattgcggcgcggcaaccaccggagagcaaaaaggggaaaacacgacgagacgacgagggttcgattcaaaggggtgggagcatctccggggttcaaggaatccgtttccggcgtcggattggacggagcggcaccgagattggctggcgacgagaggcggcctccgggacagagcaagagcgcatggcgagctatggcgagcggcggcgggcgcggcgcatcgcacggcaggaggaggattatggtggggagctcaccaacgaagaggaggcagcgttggcggcgcggtcggtgtcgcggcgaggtggtcgcgacgccgaggcggcacggcactgagagggcgcggccggggaagaagggagggagaggtggtgcccggagctcctcgtcacgcgtccacgcacgcaccggctcctccggtgctcggcaacggacgacaacggcgagagcgggacgagcagcaacaaggcggcgacggtggttcggcggcaatggcgcggtgggtgtgaggactgaggcgagtgaaaacgagagaggaaggggtttggggtggcttggttttatagcggaggtgaggtcggtttggggaggggagaactgaccttggcggtcaaggggagctcggctggcggcagcggcggtttcgtggacgatgcgaaagcggcgacggcgtggatgctttgggcgacgaaggcggtggatcgagcggcggagatcgaaccgctggagcgcgggctggcgtggtcaagtagatgaggcgggtggcgcgagcggtcaagcggcgcaaaggtggtgacgccggcagtggtcgggaaagggaaaaagaaggggaaaaaggggcttggtctcttgc

SEQ ID NO: 30952 - DNA, 1493 bp, Oryza sativa
accttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctatcagccacagtgcccaacacaaggcagaagctccaacaagtatcagtttgctctttttgtttatgactccctgaagccaatcatcaaaaatatgagatatgctagtaggaatatataaaccaaaagaaaactgaactgccctccaaataaactttgcaaaatgataatcaatgaacagatgttggatagtctcattttcgtacaaaagcaacatcttaaattaccagtccaattcggtcttgctaaataatccttggttaacacacctcctttaagcaaataccacataaagatcttgatcttaaccggcatcttgagtttccaaattaacttatttctgtcaatgtaaccattattaattaaggctaagtacattgatctaactgagaattggccattctgatgatagttccatctaaaataatcaaaagtattattcaattgaatatgaccaatagatgcacacaattcatgccaaagtgttaaattttgaccaactaaagctctcctaaaagaaacattgagcggaacagaagccatcacactagcaacagaagaacttctccttctgacaatagcatataaagatggatacttttctctaaaggccgtatttcctaaccatctatcttcccaaagtcttatgtgttccccattattcacaatccaagaacccatagttaagaaagttttttttgactttcatgagtcctgaccaaaaatgggagtcaccttgtttcctgtcaacttgggtgatagacttattataaagatactttctcttcaataagtcttgccaaacaccattttcatttattaacttgaacaaccatttactcaaaagacatctattttgaatctctaaattatgaacccccaaaccccccctgttctttgggttggcaaataatatcccatctagtaagtctatactttttcttatggtcatctccttgccaaaagaaacgagatctataataatcaatcttttaaagaacccctttcggaatctcaaagaaagatatcataaacatagctaagcttgaaaggacagaattaatcaaaaccagtctacccccaacagacatatgttttcctttccagctgctaagttttttctctattctttgatcgataactttccaatcattattacatagctttctaaaatgcattggaataccgagatatttaactgaaaaagaccctaacttacaaccaaagatattagaatattgcttataacactcctttgcctgaccaaagcaaaataactcacttttgtgaaaattaattttcaagccagataatttctcaaagatagacaaaatcaattttaaattctttgc

SEQ ID NO: 30953 - DNA, 733 bp, Oryza sativa
aagtttgtagaaaaaaatagtaacatttgtaacccaagaagaattattatgaaaatatatttaattattgatttgatgaaactaatttagtattataaatattactatatttgtctataaacatagtcaaacttaaaacagttcaattttaaccatagtcaaaatatcttataacctgaaatagaggggcagtagctatttgtccccaactccccgagtggtcaccgcaaaatggcttgattagagctagaggtcaacgaaagcgaatggacggacaaacacagacacaggtttgtgcaaagcgaatggacggacaaacacagacacaggtttgtgctgcttagtactactgcatgatgcccgcggctcttttgacccttttttctgccgtggtgcgtcccaggaagggcagcaaaaaggaccagattccgtttcattagggcacccgcaatgattatctataggctctctacaagagatccatgtcagcatattttcctactttgaagaaattaaatgaagagagagcaaagctatctactaacctggagatagtttatagaaaaaaaaacgaggccatgcattagagagttatagatacccatatagacatactattgagggaggttactttaatctagtctattgctgagatgtacatgtttatagagaacatcttactttaccattgggggtgctcttaatacttgaaggaggtaaggactactactag

SEQ ID NO: 30954 - DNA, 2466 bp, Oryza sativa
acattttgatcgtgcattagtattagtagcaaactagcaatgtagcatctattattgtatcattgtgtgcggtggcaataagatttggccccgggcttagcaaaatcctgggtccgccactggcgtctctgtccatatatacagctacatatgccagacacgaaaagagatatgttatatcaaataaagattcggcataatttatctttgcttttactgctaacagttattacttctgtacatacatcctttggattgcgcaattgaggccgaatttctcctcgaaaaagcttctctgtaggaacacaatttctcctggaaaaaacttctttgtaggaacacacatggcactagctgttgatgcatcaaatccaagagatcctgcatagctatgggcctatggctcagtgaagctttaagctccattgcctttttggtatttattatttttaatcaattttattttttcattttactacaaatataattacatatattttcagtatggtttattcaattcgtgagttaaaaatttactgcattggagttgtatgttcaaaatttttaagtcgttagtcataaatatttttagcatgctaattgctataaacttatatttttatctagcaatttccgcagcaacacgcggggtatcatctagttacaattaaatatcagacatacttgaaaaaaaacataacaaaactctgaatttgtgatgttctctttttttttacatatgtagatttaaattaatatagtatatttgtgaagcgatatttcacaccctaaaatatgatgtgaatttttttaaaaaaaaattatcatatagctaactattatatttaagaccacaatataacttttataatttagtttaaagaatacaatgaatcacaaattagatatataatctaaaaataatttaaaatatggtttagaaaaggttggttggatattttatatttttattgtagatcttagtttaacgacatatttatatttgtgtagtaatatattttttatcctattttaaagaccgttaattctttcccgaaggtactacatacgtatgtttttttttgctttgtctttttatctatatgctttccttcgcttccatcaacggtagttaagatagttatattgtagaaaaatcatattttaaagaccgtcaatttttttcccgacggtaccacaaacaaatattttcttaatctagaaataatttaaaaaatagtttaaagagcgttgattggatattatatatttttattatagaaattagttttaatgcatatttatacatatttatatttgtgaagtaatatatttttatctttatattgtagaaaaatccttttttaaagaccgtttttaatttatgttttttttggctttgtcttttaggtgttttccttccggtaacagtaggtaagatctttatatattgtagaaaaatcatattgtaaaaaccgtcatcttttcccgacggtaccacagacgcatgatttatttttttactttgtctttttttttttatggacgtgctttccttctggcaaggcggcaacagtatgtaaagctattgttttgttatcaatagtatacgtactcgtacgaacgtacgggagcagtagttccgattgtatcatttatacatgaggaagttattagtttttttataatactagcatgaatgcccgtgcattgcaacgggaagaaaaaaagaaaattgacttaaaacatagtaaatatatttttttggaatatttgggttttttaagtaggtaggtttatagttaaattaatttataagtaaagtaagtgctagaaataaaatgatacggttggatttaatttttattaaattctccatattaattacactctttgaaactttcttgaaaattacagagcttagttgctaattttgataatacaatcatcatttcagcatttatttaaataaaaatctatataaaaaatccttatttctctataggccattttcggcccattttcctcttcagcccgcaaccgagccggcccgctttcctcccattccacttctctccgcctcagcccaaaagcacccgtcggcccaaagaagtctaagtacgctccccttgctcctcctctctttgtgtggtgggccctaaccgaaagtttaaccacgattcggcctatcaagcccgcgcggcccgtcgatggatgccggcccgaagcgggactgatctgagccgttcattttgatggacgactcagattggttccgaatccatcaaaactcccagacaaagaaacctaaacctaattccttttttgccctcccatacccccaccgttggccgcttctccccttttgtcgatccctctccgccgcttcccctccccctacccccaccaacggcgcctctccctaccggcggtgccactcccatccccccaccgcgagctcctcct

SEQ ID NO: 30955 - DNA, 7535 bp, Oryza sativa
gtaccgccggctagatccggcggcaccgacggaacggactgcttccctcggcccgatccggctgtggcggcggctttccgcagtgaagtcgacagcgccgacgacggcggcagcttctcgtagcccaatctagcagcggcggcgtcccgcggcagatcagatggcaacgacggcggcggctgcttcccacggcagatccggtggtaccgacggcgccggcggctacccgcgtctagatccggttcgcgggccgatccgccggcgatggcggcttcccgcgccggaaatccgatggctacgacagcggcagcgaatccggcggcaacgtcggcgtcatcggctttcggtgaagtttttattttgttttctcttttactagattgtcctattggattttgtatctacatttgcaatgaagtttcgttggatcgctcgggcattaggttgttgatgcgcactctggatgatttatttttctttgtgttggactctcaactcagatgttgcggacgaaaacttcgcttgagtttgtttccttcttttgtggaatcggaaagacttgatttttttttcacacttttttcacagatggacgacagaaacaaaatcgaaatcggattgggatttgagggatgggcgaaaattcggacgaatagaggggatgacgaacggaaaaatactaatcttttaattagttaagatataaatctaatctagtctgtaaaataatgggttccaccaatttaattgaaattcgacggtaagattagactgtgccatgtggcggcttgagagcatttttaggagtgccacgtggtggtttaagagcctttgtaggaagtttaatagacttttagtatataatagataatagatagatatgaatgatatgtaaatttatcatgtgattattttttaatacttatagtaacaatagtaacagtccatgtaatgcatggtaagttgtgtaagagcgcaatatggctgtgtttagttcctgaaaaaagttagaagtttaggatagttgggggtgaactaaacacggcctatatatgttcatgcttcatcaagtaaattaagtagaggagcacggtatgagtaattaaggacgtacccaatttaatgtcttggcataatcggcggctccccctaattgccaaactgcttcgtttcccgtgtagttaagtaccgtgacgtccgtgtctccatgggacaaaagagcggcaacaattcttgggttgcaatcctgcaccgcgtaatgcagagcagtgttcccgccgttatctcgcatgttgacgagtttccgaagatacggcgactctaggataaattccacgaactccagatgacctttgaatgcggcttgatggagacatgtgcaaccattagcgtcgtaatacggagcatctggacaatgatgcacaagctctctagcaacactaacatagccacggtatgcggcggaattaaggagcgggacactgtccttattattacttaggacataccccaaggaccaatcatactgcagcaatgctccgagaacatgggttttaccccacattgcggcatgatgcattggagtatccatttcatcgtcgaattctctagccagccctggacgcttctccactaactctttagcaataactgaaaacaaatttaatgatatatgcaagaatcacctgcctgtggtcattttaacgaataatggagtaattattaatgactcgtcagacagcctagtatgcaattcttacctggattcccgtttctcacggcggcatggagagcattgcggccatgacaacccacgtgagcagaaccaggaatccccaacagtttccggaagatatcagtgaaatctctcatcacagcgatgtacatgggtgattccctgtacttgtttacaccttgtgacaggcctgcttctgctgctatcagttccaacgcaaggtccctgtggccgttgcgaatggcatggtgcagggcattacatccattctcatcttgtttcaagatagcttctctgagccccgcttcgcagcaccgtctgagcaaaacggaggccaaggcggtgcggccgttggttaccgcggtgagcagcggcgtctcgccgtgtgagtttgcaacggtgagaagagaattgtctaacatcaacacctcctggcagaattcctcatgaccattgatagtggatatgtggaggcaggtgttcccctgaggagttgtgcggagcaatatgcttggatccatggcagccaccagctccttcatcaacctgcaatcgcctgactttgcggcttcaaagagccgtccgtccatttttacagcttgtgtctgttatgtactgctccttctgctgaattaattaatgttggtacagatgcactggaattactagtgatatatactacatatgtactgtttgtcatcatgtagctcgttggactatatatctttttgtaggttcttgatagcaaatattgggagaaggatacacacacacacatatatatatatatatacttacactgaacattttatatatgcagagaattgtctgagcgcatttctatccatactttaagcaaacaactactccttcagggctgataatactcgttttagaaaaaggtgaggtcaaactttaaaatatttaattatgaattatttttaaaatatttgtctatcaaatatggtgactacatatatatatatatatatatatatatatatatattagtcttaaaaagtactttaataagatcatatatttgttaatatttttatacatattataatgaaaaataatggtcaaagttattttttagagaacatatccttgtccaaaacaacaagtattattaacccggagggagtagaaaggtagcccgtgcgaatacacgggcatgtattttacgctacgtttatacgggtagataatcaaccaaattatttatccaatgattaaaaggtaggatttttccaaaatactgctcaacaacattgtttacataattattctgaagctacactaaatagcttaattctaaagtcgattagatagtaacatagaatatattttagagcaattactccctctatcgtataataactttattttggcacatccccatttgtttctaaataagtttatttttagtaatcatttcatcgggatttgtgaaagtagaggataaatatactgggagtagataaaaatataggaataattgtattgggacttggattattcatacttattaattctatatctaattagtaataaatgtttgaaaactatgtatgatggggcaacctgtgttattaaattgttttatacttttatgttaaatcgcatgacatatgaaagggttgagatgttgtccctcaataaaatattatttaatatttgaatttgtaattttatttggataatgtagatttaatttgggtatgtatgtttgtagaataatatatgatgactcaatatatgatgtcatttttttcaatattttatttctagattaggaatgagattttatagcttgaaaattgtgatcgttttagtatataaaattaaggaaggaggagagagcatgaggtagagggagaagcaggggccgtgtgcacctcatgcgcatgcgagtgggaggggcatgggtggttaaaagtaatgagttcaccgatttaagtgagagtatgctaagttgattttcgtttttgttctcagaatttctaatacaattttctaatttattatatgtaccatgtggtgggttaagagcatggaagataatgtttaatggacttttattatatacacaatatttaatggatatttattactccctccgtcccaaaatatagcaatttgggactggatgggacatatcctagtccaatgaatctagataagggactgtctagattcgttggactaagatacgtctcatccagttctgagttgctactccatccgtcccataatataagggattttagatggatgtgacacatcctagtacaatgaatctggacatattcattatactaggacgtgtcatatccatccaaaattacttatattataggatagatggagtatattttaggacggatgtagtatttgctagctagaaaataaggaggccaaagtgagcaaggagagagggaacatgaaattatttggatgacatgatagtatatgttattaattttttgctatttataggagtttgtatcaaatgatgtatttcttatatatcaaaacatggccaatatagatatatagaatatgttgtaaaaaatataattatttagttatctaatcattattatttgttatctagaaaattggatgatagaagtgacgagtaagagagaggatgtgagaggaagggacgtacatatatgtaagtacttgtagtgaggaggagaggataccctcatgcccatgaggcaggggagccggagaggattttagggagatagtatttttttcatttaaaataaatctaatggtgtaaaataataggtttattatattaagtgaaaatcagggctagacgttttgttttttcttagaatttcttagatatgtctctaatttattagagtaccagcttaggagcgtttgtcactgtatactagattacattaagtatgaagaaataaaatatacgccaacgatgtatgagttttaattaatgactagtacatactaatcccttgatgttttggtctttccatcatctagatccactagtatccatatgaatttggatatatatatatatatatatatatatatatatatatatatatatatatatatatatatataaagagcacatatatggatttatatacatgaatctattcaaaacctaaaatatgttataatgtgaaacagggattcaatattgactagctactacctgcttaattacctggtagttgaatccgttttgtatggatggaaggaaatatgaccaccagactataacttggtagttgtaaacaaactaaacagctagcacagcctttatatataaatttaaacagcatcaccgtttgctgggagttcaagaagagaagccttaaatggaactaaacgtatcatgttcaaaggagaaaagggattgcatgctcagagagaaaagaacagtatcttctgagcccagctgtagctagcccctagaatcttcttctcctccttatttttatccagttattttagccgggttgatcgaagaggaggccaaccaaatggtccaaatcttatgggaagcgcatcatgtctgtgaagcccaactaaatcttatgatgagtccaaccaatcttatggaaaggccaaagtatcatgtccgtgatggtttataggatggcttgtttgactggtcaaatctagtcgatgacagtcttttatttagattcgacaaattaagatgacagctatcgataactcctgttggcccgacacagatgaattttcgcatcactgactaataatccgtgaataagtcgctcaccaacacatatgagagttcccgttcgacatagatgacctattccgcactagtgatcaattacaaattacattaattcttgtgtttctttatcacaaataagccagcagaccatcgtaagtagggaatggaaagcttttctatgtcggtctgaattccagcatgattttgcagacaccaaacatctattttaccgacatgatcccgggcaaactaattaacgcgccatgaggcaaatcattggcgagatgctttcagattggaggggattcatcgatgaaggaaacacgtccacgttgtgtagagctatgttcgtgaatggcaaggatgatagggaacaggacgcagaggactgattgtcattgtaccctcatttttttcaatcagtagataaatcatgtactccctccgtattttaatatatgacgccgttgacttttcgattaacgtttgaccattcgttttattcaaaatttttgtgcaaatatgaaaatatttatatcatgtttaaaaaacatttgatgatgaatctagtcacaataaaataaatggcaattgcataaattttttgaataggacgaatggtcaaacattggataaaaaagtaacggcgtcatacattaaaatatggaggtaatagtatttagctgcaacagatgtagcgagttatatttctctgggagagggtgaggaagatgtagcaagagaacatgcacaatctgcactttttgagactgagatgagaactaagcatgccaagggggaaggagaggaaacagcaacaataatgcagtggcttgcaaaagcaaaataataagtagaggtagtagaaaagggatcagatgtggaagaagaggagttataaagaagggttaggatgaagacaaggaacaaaaataaaatgggtgtgaagaactctgctataagagaaaaaaggtgcaaacaaatgatacaaatcatgaaagtaccgtatgggaacataagggatttggagaaagcatggagaagaaaacacttaaaagggattgtatatgaagagaggattgatataacactacactggttctagtcttccttaacaaggtacttgcatcaagctagaaatagcgaaattccgtcacaaatcgtattatgtgactatcttgtgatgaaagatttccagtgcaaaagctccatctaggatcaccttatctgacaaaaggctgcctccatcataataaatggtagacaatttttccattgccataaattagtgatgctctagactatcactcatcaaaccaaaaccatcaagaatcggctacttcagtgccgctatgtggacaacctgatggtgtgggtacgacgtgaagtaatttgtggtttctcacacactaaggtggtaaaccattaccaactacttattttgtcacaaataactggaggctcaacatataatagggtatggtccgaggaacagaacaacatgacctaacatttagtgggccgaggccaagcataattgtatgccatggcctagcttatggcaaataccttactcgatgactgtgcgccacgacctagcatatggtgagctaaggcccaataaatagactataggccacgaccattgtgtggtggaccatggcccaatgaactatgagccaccacccagcaaacaatgggccatgaaaagagttgcattatcatgagcggcctcttaagaaagtcacctagctataaaaatcatgtgttacatgggcaactatcctatacatgattatcacgtgtggttcttgatcccccctcgcccgatgaactaaatcaaattgttttcatgcaagtgtagtttagaataggggctaagggctatgtgaaaattgtttctgggaatagtgaacttattacttgttctaggctaagctcaacctcagtgaaaacatttaatgttatttttcacttctctcactaagccatatcaccccaattacattatgaagttaaactcctgaggctccgagc

SEQ ID NO: 30956 - DNA, 29668 bp, Oryza sativa
  unsure (1)..(29668): unsure at all n locations
tttaaaaaaaccttcaaatctaactatatagtatataattttcctagaactatactataataataataacttgtatatatgtattaaaataatatatgcaactttatatctaatttatatagagataacaatgtagttagagtgtagttacactatagttacaatgtaactacaattgaactagcatgtaacttagatataactagaacaaatctgccataaacatgtgatgatgggactagcttgtgaaaagagggtttagatccgatagcaaaatatcttagcacaaatcttagagcggaatcaatggctaaaaaatttgacagttttcgctcgtaaaaactgtcgacagtcggatagcagttccgctttggaaaagtgtactcgtagtctcgtacaacttttatttttttacagaactatgaacaattgaacactgcaaaatatatactgacagaaacctaaaagatgaacactattaacaacaacatattaggcctccagagagagacacccaatagctggacgaaccaactaattaattactactacttccagacacacccttcgccgccggcgtgttgtcgccgctgttgcctgccgccgccgccgccgcgtcgtcctcgtcgaccaaggcgagcaggcgcgccatctcggcgaaccaccacctccgctcgaactcgtagcccagcgccgcctccaggccgatgtcgccgtagcggctcacgtcgacggcgccgcccttgccgtagccggcgccgtagccgtagccgtcccaaaccctcgccgccaggtgaagccccacctgctcgtccacccaccgcctcttctccgccttgtctgggcgacggcgagccgccgcctcctggcgccgtcctcgcctcgccgccgccgccgacaacgacgacgacgacgacgacggcggccggaagcaggacgccagcttcggcaagaactcgatcgccatgccgagaaggcgaggagatcgaggcgatcgagctcgctcgctagctgctcgcaattaggttgcgcttctcaactctggctgctgtaatttgctggaggcgtgatggatggcacccttatatggcgggaaagcgtcgcgcggaatagaaatcggacaagggaattttgatgggatggaatcggatccgagatgctgccgtttacgcgtccgaaaatccgaatcggacaaggaaggccaggattagccagagacggcgccccctgcactgcgtaaaaaacatgggtctgattcatatgggcttgatgggtcagatggatgacgttctcttttgaatcgattttgctatatctcactcgaaagattttttcttatctctcactcgattttctcacttaaatttacagtgtattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactccccttttgaattttctaagcccaacttctaatctttcatctacgatttagctatatatctgtcgataattttttccccaaaaatttgacagatataattacagtacaatcgtagtgtaattacactgtaacttgcatgtaattacattgtaactatagtgtaacttgtatgtaactttcaaaaatctctccgtaacatgttatttcggtaaaatggaggtcgtgggaacaaattttttcacatatgtgtgtgctatgatttgttttcttcctcaccaaaacaaatcttgtaatagatctaacgattcaagattatgtgaaacttacatataagttacactgtagttacatgcaaattacggtgtaattacatataagttacagtgtaattacactatgattgtactataattacatctgtcaaatttttagaagaaaatttgtcgacaaatgtataggtggtcccgttcctatacttcatataattggagaggcctctccaattagatttaccgataataaagatgctgattacacaatattttttaaatgaactaggaagaaagcccgcgcagttgcgcgggcagattatttattatttaaaaaacctaaaaaagcattatctcaccatattcactataagaaataaaccataattttgaaatactaaattataataatgtccatcatatccaaacaaaaactttgttttttccaatttgaatgatttctatgtttaaattttctatactaaaaatttatatatagagttcctataattcatatttctatgtataaactacccataccgaatgtttaatcgtacgtgcaaagtttatatatgtgtaaagtctatgagtagaaagtttaatatgactttttaacataaagtttacgtgcgtaaagtctttttcgttgctgtcgaaagtttttgagtataaagtttggcaatttaagtagatagtaataattttaacataaagtttcgttaaatttggtccggctttgtgaatatagagctgctaatatgttaagaaaatcatgtctaaaaatgttaaacataagatgtgaaacagaaacgctaatccactttcgatgaaagaaatattaatcacttccaaaaatccatgcaaaataaaatctgctcaaaaaagggaatgataatcacactatccttcgcataaaaaaatttaatcacaataactaccatgataattacgtgttcgtgagcggacaattacacgaacgttcttggataatcacccctataaacgcacgcacacatgcagatcctatctctataagcatctccaaaatactgggacgagatatgtagagattcacgaaatcaccataggcgtctcgatgtcgacgggcatatatcgctcatctacatgcgagtacccatgtttcaaatgtagaacttgaacgcgagaaaaatggttccaccacgagaaaccttgccagttaagctacgctcacttcgttgattattacttttaaacacagtacatgcggaggcacacttcttgcaatttcatttgtgaagctaaattacattcatcatttcatttgtgcaaacacatttcttgcaattgttttataaaaagtaaacttttgtaagaagcccgattaagctgtgttcgggaggtggagttactctgcacggaaaacggaatggttcattagcacgtgattaattaagtattagcttttaaaaaatatagatcaatatgattttctaaggcaacttccgtatagaaaacctttttaaaaaaacacaccgttaagcaatgggaacccaaagaaaagaactcagcacatatagtaagggacggctaatgggggggtgatcgctcctagcgatcaccggcccacccctctccctatacgctaccttctctccccttttctctcccccccccccccaattcttctcttcctaatacagtacaccatacaaatttaaaaaataaaaaaataaagttggaaaaattttatgtatagaaatacaactactatatattaaaaaaattgaatttaaattcaaatttgaaatgattatgtaaacttttgacttataaactttgggtctataaactaatatttgaattcaaattcaaatttgaaacaagtatgtaaacttttgacttataaactttgggtatataaactttagatgtatagaaatactatatataaaaatatttgaattcaaattcaaatttgaatcggatatataaacttttgacttataaactttaggtttctaaactttagatgtgtaaacttgaggtttacaaactttaggtgcataaaattactaaaatagtaaagtaatacggtgccaaaaaaaggaaaccaggtggagggagagggatccggatccgatcgccctgggcgatcactcgcccaatagtaattccgcatatagtaggggttggtagtgtgtggggaggggtctgcctgaagattcaatttttaaaaattagtctgttttgaaaattttgttgttgaatttgagactgcaacgagccctgcaacttagtactcccatgtcctaaaatataacaacttttagccctcaggatttgtcctaaaatataacaacttctccaccaacattctattcccaaccaatcacagctctccaccattcatttttcctacatacctcctctactcatccaatcacaaccctccaccactcacttctacaaactttcttaataaccgtgtctaactctaaaacttcttatattttgggatggagggagcagtatattttcccctttttttatcgaggggacccagtttttttttcttcggttgcacaaaatgtaggagtatatataccacttaatgaagaccgcctcttatcacacttacaaagttggagattcgtagcatgtgtctgatcttacaaaatatatattgaaagagtacccgtatatgtaaatttaaaatctggtgggccataattccaccagcacacacttacctttttttcttgggagtagttcatactacttcacaaccatgtttgttgttagggcagtagaagtgcggtagcgcacttgaggagcccaaggcctccagctagactagaaaccggttagagaaccacacctcacaatgcatgtgtcttagacaatatctatgttagtgggtcccacctatatatattagtaggccccactcatctctcttttcacttccatctctccctcccatgcacgcaagcatgtgaggggaccactcacagtttcccttttggcatgaggaaaccgtaccctagctagggatgcattccttagcaaagatatgggtcccgccacctttttttcatccacatcagattttgaactagctgacaaacgaggtaaccctctagctaggagcactgacaaacgaggtaaccctccagctaggagcactgtgaagagtcttacttgttaatgtattgatccttaaaaataattggctgccgcttcgccgagcccggtgaaaaaggatgcaaaaaattatacggagttcaatgttcgtagaattacgctgtcttttttaaggataattacactttgttaattaagatagttaaaccaaaaataatcttttgttgtcaaaatggccacataatttaacactaagaaaataaatttggttcagaacttttgggggggaattttgactgaaattgaagttctgttcattatttctttggcacttttttcaattaatataaaaatcaaagttttttagggtaaaagaaattgtaggtggttcgataattttcagtgaagttggtggatctcggccgccacatctttctgaaataacatgaattccagatcaataatatcattaaaaaaatgctttataaacgtgataatgggatcatgtcaaccttagcttcgtacgttagtgcacatagatcctagagagtagagacaaattactcatttaccaatctaatggagacatataattaaggaataaaacaatttaacaatggcgtaccgtacaatttgaccttgtcattgatagacgagtaaagtcacgatccgttcacaacactcgaggataatggttttcctctttctttagcacggtgcgtcggttgtcagtaacaattcttgctgatctttcagaaaaccgaaattcaataaaaaaatatcaagtaaattacacaaatcctctaataatagttatgattaatgcataacctgagtttgttatggtaaattatacagtcggtcctaaacttattcatccgtgtcatttatatcgttgtactctaaaataaaatatagatataggtcccaaaacttattaaataatatcatttaattctgttttcaaattagcaagaaaaatcctacatggtgttgatgtgaataatgcgtgacgttgacgtgacatatcacgtaaacactaaattgagtaataggctcacttaaaaattttcgaattaccgtacttattgagctggccagttcgcccacatcaaaactttcctataaatataaactttcaactttttcgtcacatcattccaattttaactaaacttttaattttggtgtgaactaaacacaggctatgtattttagaaaaataacaaatacggagtacttttataatggtaatttgttttttttaaaaaatattatacgaggtatacgatacattcattaatcttggtttcatgaaacattttagcctacaacttttgtattatcgtactccaaaaacctgagatttcacgaataaattttactccgaaaatactgcggagacctgtttaacacagagacacagagtaattcatcccgatcaaagattattacattatgaaccaaataaaccggactctactccgtaatttataataattaaagggttcatcttttcgcttatacttatacttattagctaaaatntaaattttttgaggttgattttgaggttttttttttcatcgatgcttattttttcagcctttacttttatattactaaaaatatatataaaagttttagtaaaaaaatattttttatttacaaatatactgtttgatttattcgcttgggccgtaaatcttgtgtgtcacgactcacgagtaaaccgtgctagcgtagttaaattcggcgaggaatcctctccccttttaccgttacaccaactttgaatgcctccatctgacgacggttgacacttaaccctcctcctccaacggctatctcctcgattctctcctctcctctccaaaccaaaccaaatccccccaatgccctcgccgccgccgccgccaccgccgccaccaaccccctgacccaccgccgccatgatgccgaggatgtccaagccagcgcccgcctcctccgcgtccaagccgaggaggagggcctccccttccccgtccccctcccccgggacggcgcccaagaccgccaagaatgctgtcgctggtgctggtggtggcggccagcgtcgccgtagcccgctcaccgatctcaactccggtgacgcctccgccgcgcggggcgggtgcttcaggttcctcgtgtcgtccgcgtcgtccgggtccaggtcgaggacccccgtggcgtcccccaaggtgaagaagccccgcccggagatcgggcggcgaggccgggtggtggcggccgcggatcaggagtcgaggacccgggtggtggagaagatgatgacgagggggagggcggagacggagacggcgaggaagcatgcgccgccgccgagggggctgccgcttcttggcgaggccctgacgccgcagaggaaggcggacgcgggggccacgccggcggtgtccggggcgacgccgccgatccacgcgtcgatctcgcccgaggtgctggcgtgcgggtccgccacgccggcgtgcttcgcggcggggcaccacgtcgtgcctggggtcgccgaccgccgcaagtgccggcccaggggcatcctggccatcgccggggaaggggcgagcgaggagctcgaccccgacccgtccagggcgtcgatccactggctgtcctcaccgtcgggggaggtgcccggaacgtgctcgacgaaatgcaccaacgaggcatccgtcaactggctaccgtcgccgcgcgaggagcgcggcgtggatcttctcggcgatgagatctttgtcccgaggtgctctttggaggatgcgttctggcaaatctcccccaaatccacggggctgttgagctcacctgtgctcaatggtctattggaccttggcacgccggcatcggaattgtccgagacgacaccgtcatcaggatttcttcccctgcagaagacgccaagcaccggtgacagccttagtcccttctcactcattgtgaagagggcatcacaatcactgtcctctagaggactgaagtccttgtgttcccagcaaggaccaggcagctgcagctatggctcggcagctgatccgacagcgatctccggtgagtcatggagcagcaagtgctcagggctgacgaggacttgcagtcgccctttgacgaaaatggatccggtggtcgaatgtctcgagatgatggctctgtccccaaggcccggggatgccgattattgcggaaatggtgccttgcctgcaccattgcctgaccttagcttccagtttgcaggtgctccaatgtctctggaatccatagacttgacctcttttaagagatcaccttgtggcatagaattgaagggggagaagagtgcaagttttcagaaaccggtccttgcggacccccggatctcttggcgagaagggctggttagcaggatgtttgacatgggtgatctggactgctgcaagtggtggtctgatgatgaggatgggccagtttttcaaggcaatgaagaggctttgcgcgataccgagcttcagtcagtcatcccttcttgcctgcaggaatgtggcgaccaaacggctgcagcatgtggctttggatcggttgagttcagttgtagtggtggtggtggtgaaatgtgtaatgacagtaagccttcttcaaacccagtttcagttgcagagtcaatgagagcagaaggattcgagctcgtgtcgtccgacgactcggattggactctcttctacaagaatggcttgtttgagtcatgagtttgtctgaattggagtggggtttccctgtccagagatgttgtgtactaattgtagcatgagaagaaccactgcgaacacaggagtttgtgtttgcctcccggccttgtacttttaattttcttttaccaacatatggagttttctgtttttaaaccttgagcacctgttcatgtaaattacgctggtagatagatttgttttttgaataacttcttgttcatttttaatccagtggttgcaattcagagcaacatgagtaatataccatatttttctacctttcatttgattaatgtctgagcaattttcttcgccgaaaggcgtcgatttggaattcagagtatgtggttgtcatctgtcatgatggttaaggatcctgtcaactgaagacatgaatctgctatgctgactctatcaatcaaggcgaactcagtcgatgatattctgtaacaaacaactgtttagctccttcgcttaaaatttctgttcatgatggcaattcaaagcaacattagaaataataataataatataatcattttgtctccattgattgtctaaataatttctttctccaaaggcattaatttggaattcagagaatgtaaagtgtatgtagcgctggttaagtgatgctgtcaactgctgacatttgatgaatcttctatggttgactatgaatgtctgaatgtaaagtgcatctatctaaagttgatgaatcttcttgctgtttggcttgattggcgaatggcgcagcgccaatgccatgtgggtcccacctatcgggatgcagccatcctacagcgagaaattcacatgtgacatccttaaaaaccggtttcgctagaatgttatcgttgagattcgcttgaatgccactctcaacctgctggcattcgctacattgtcattttcattgtttcttccatttaagaaaattgatattatgtcatcttcaaaaatgagtttcactcaaatacaattttgggagtgggcttcgttaaaataccactcccaaccgaaggctacacgctatattgtccgaatatactccacctccatcgtgacgaggacacagcgacggcgaggcgctgacccacgcggtcgttggcaatggtcgtttgatccgtgccctcggcagcgacgaccagcaaactcgtgcgctcatcggcgacggaccgacggtggccggtggacctacccgcttatcgttatcagccattacatccgcgcgctcatcaactgtggcgatggatccacacgctcgtcggtggcggccgacagaactacgctcttgtcggcaaacagtagacctatgtgctcatctatgccgacgacagatccatgcgctcatcagtggcgacgccagatctgcgacctcatcgacatcctcaaccggatccgtgtgttcgtcgtcatcgtcctccaaaccattgagatgaagaaggccagcggaaggaggtcgtacacttcatccacggcgttggaggaggtggatggaggagacaggggcaatttgtccaaagtagcattctggcatgtagcccttggttgagagtgacagtttaacaaagctcactctcataatagcatttgaccgaaacctgcttttgaagttaacatattagtatcatttttctccatacgtttgcaaaacatttttcatccatttttttcctcggacgtttttgcccctggctgtggttgaaccaaaccacatcttctaactctctctctctctctctcgcttctcaggaccgagcgagaggagagaaggggcgccgccgccgccgccgccgcccgccatccgcgccgcttctccttctcctacagcatatatatatctcgtcggcgaactgagatagggtaactgagattagggttttggctcggagggggagtggagcgggaggaggaggaggaggcgaggcgatgatgatggtggcttccaggctccgattccaccagcgtaagagctcttcccatctctctcctgcttttcttctcctcctcctcctctctcgctagcctcctctgttctagtagttgcgagaccaaatctttcttcttgttatctgtggatagcctggctcttacagaaatcggaaacaaagaacagggcaggcagggtgtattggttggggaatcaagtggtgaataggagtactagttaaccggtttatcccttttcatccctgaacctgtggtgtgtttgttttgcgtagttgggaagatgttgagaggggagctaggtagcatgtgctgcctccaatttcttgatttctggaagagagctttcaaatggttaattaaggtgtggcttttgctttctcagttaggctgattggggtcaggccgacctgctgctctccgtcccgggatttcgcggcggtgagaacccaaaagcttcagctcgccaagaagtaaggcctctgaatttatttattttttcactgcactgttgttttactttgttcaaatctgcttttatgtgcttgtgttaggtaatgccgggtagttcatatctagtgccgagtaacttaagctttggttcatatagcaaaatgttatgtggctctgcttatgtaggctttggttccagattccctattttctgtgtgtttcttcattcgcaaactagttgttgatattgtgcatacaacagtcgtgcggtgcctgctctgtcatggtgtggccacattgagaggttatactccagtgtttttatttagaagtgtgaagtgtaagaaattctctttaaatctaacaatttgtttcttaaagttaaatggtcaatatcctagttttgttaaatcagagactcaattaccgtaaagaaagtagcggcaatggctcaatatcattattgtgatggtattttgtatcgtgcaattagtttgttcaaccaacgttgtcacttttggtcttcttactcaggaaaagacgattggatgaagtgtgccttgagagatttcaacagtatagcaggacgtacatccaatcatggattcttcagggttagtcctttacttcattgattttatgcatttagatctttacagctatgaattggtttggcactttatacttcatatggtaataacactgcttcaaaaggcaatctcagctatcatgtcatgccaaataatgcaaaactcaatgcatgccttaatcatgtcatgattattcaactttcctgacatatgagaatggtctgtgacacttgatcatatatattttgtcctaagatcagtggacatcgaaatgaactgttcacttctaaggggaagctatattagaggcacacttatgccaccttaagcttaatgtatcattatttaacaacaattatctgccctcatgtttcatggcacttttacaatataactttacatcatattcaaatatatcaaagtaactgagtttggaacaaagaaaatattagcaccataaatttgccccttcccccctttgaatttcatcagtgaaaagcttatagaagttctccctactgcaacagattgtatgatatgcgtactcaaatgtgtttctcatgctattgccacatatgacatctaccaggaaattgcacacttcacctttcagctatgactttttaaccatgtacataagtatattttgtatgtaaagcaaacctaataaagcattctctgttatgtcaaatttcaggtaaggtccttgtggatggaagggttgtgaataaagctggaacacaagtatctgacaagtcgatcatagaaatcaaggctgaaattccaaaatatgtatgtaggtgatgctcgaactgattggcttactttgctatcaaacaaaagtaactccagtttgtccagtttataattgtgtcatctgtcctgatcaaattcagagctggtcataagcttgaggcggctatcaaagaatttggtattgactgtgatgaaaaggtagcccttgattcagggttatccactggcggttttactgactgtttactccaacatggggcatcacatgtatatggtgttgatgttggctatggacaggttgcgctactcccttaaaagtttatttttaatctaaccgctatcacattatttgtaagctgcaggtagttgttacaagattacagcagcagaactataatatgctccacttcatttcaggtggctgaaaaaattcgagtgcatgaacgtgtttcagtaattgaacgtacaaatttaagatatcttactgaactgccacagctggttgacttggtgaccctggatctgtcattcatctcaattctcttggtatgatttggtgctgcctttttaatgtctgcatgattgtccacttgcacaagtccttttagcagagctcttataatatgtcactgtttcttaactgagaataccatttccctatgttattgaaaaatacactgggttattttacatcgttctgttctttagttggtgtttctgcacaaaacattccttgtactattcatttgtatggttagtatgatatacttaggatcatgatctgtgtgttcttgtaaagttgtctggtatatacagtaaaattgacccaatcaactacatagacttccagtacttaaatgcatctatatattgtatgctgcatatatcatatgcaggaatgtatattcatgtgccctgttatcttaactatggttgcttgactagatggctgttatcttatatgtagttacagtttctatctagtaatcttatagatattgtcttatctggtttagaatgttatttgcagcagttgaaggtttagattaatttgtgacgtctagcctgtataacgatggcattgttttctcattaagcaatgaagatgatttagtctagtttgtagtttctcttccaaggtctccttagaaaaccgacgctgcttgattgtcctcccagcaatgtttagtatttagcgcataatgatctaagtatcattgcttgagaccggcgcgacatccttcatatcgttgtatttaaaactttttttccctcaatcttaatgaaattggccggccaatctttggccgacccagcaaaaaaaaagtatcattgcaatagagttcttgtatagtcaattagctcatcttgctgaagtaatagtgcattgggaaaaaatagtgtgcttttggcgtccatggctgccgatgctcctactgacctatgtagttcaagttcatgatgtttttgatgttctgcaatcttttccaaatataagatgataagatcagcagcttcgataaattattaaagcacatgctatccattgttcactgacgttacctgtgaaatcaaggttatgcctgctgtagtcaaagtaatgaagacagactcgacattgattacacttatcaaacctcaatttgaagctcgtcgatctcaggtatcaaacaaatggtcttagtttttcttttcgaacgttttgattgaatatcaattggaaaagaatgtataatcactttcatagccttcagatctcttcatacatgcacagtgatagaaataagcaagccactaacagcaaatcctttttatcctgttcaggtaggaggtggtgggattgttcgggaccctctggttcataaagaggtaatatgatttgctgccttttttgtgcgtccccatcataaagcttcacattgaatataggaatgagctacttccttaaaataaggttgctgtttattcctgaaattccaccagacaaatagtttcacttgtaagcaagaaaagaccccccaaacaaatcctttgattatatcctgaaaagatcccatttcagcagtgtctgattgttgcctcattttacttcacgattcttcccttgagttctgatcggagtaccaacatattccattgattggtcacaggtgctagataggataatttcaggcgtagagcagtttggattctgcaacaagggctggattgaatctccgataaagggcgcggaagggaacaaagagtttcttgcttgcttccataggatcccagtgcaagaattgcagccggaggaagcaaagtcaacatgattatttgtacctaatgccatatctagttcacatagaatagctggagaatactttctgatctttttaccaaggatgttacttcaaattggcataatgtgatgtgagaatcccttttgcaatgctttcctaattcctatatctgtaacagaaacagaaaaaccaagctttttgtgcacttccaactaactcggatatttatttacgtaggagtacactacaggtatttttgtttaattgtttggcgagactgaaaattttgtctggacatgacagtgagattctcagtggtaaattcaacatatgtttaagctgtgtctagatccaaacttcagtcattttctatcacatcaacctgtcatatagacacaacttttcagtcacatcatctctaatttaaaccaaaatccaaactttggatccaactaaacacagccttagttaacgtcaaaattgaaaatttggttgaaattggaaggatgtgatgtgaaaagttggaagtttatgtgtgtaggaaagttttgatgtgatggaaaagtttgaagtttgaagaaaaagtttggaattaaacttggcctccaatatatagtagtaattttagggcctgattagatcctctggcaagttttttcatcccgtcacatcgaacgtttgaacatctatatgaagtattaaatattagctaaaaaataactaattgcacagattgcgactaatttgcgacgaatcttttaagcctaattgctccatgatttgataatgtggtattacattaaacattttctaacgatggattaattagtcttaataaattcgtcttgcagtttacagtcgaatgttgtaatttgttttattattagacaacatttaatactttaaatgtatgtccgtatatacgatatgacatggcaaaaattttcacccttagaactaaacatagccttactctcacgggaacattttgtctttttttttgttgctccctaaatataatgaatttgaagataacataattagtaatttttctagaatttttgttgaaatttactagttggtgttaatacgggaaagtttatgtgcactttgccatggtgttttctgttacagagcaactttatcatagttaggaacttgggtgtggctctagccgctcccagtcgaatgtttctaaattaaaaatccaaacaaaaatcactgaggtttacttgggacacaatctttacacagctacgtattcacgcgttctcttttcacacagctacgtattctggtgaggagcatttacttaggaacatcacttagctcacctaagcagcgacgatctcaagattgcgaaccagagaatcagatatccaaaactagtttcacgccaactaaaggtcacaattattctcgagcaaaaaaacgatttcaatgctatagacacaactttacgaagtagaggcttcgttttacgacaaaccacgaacttggatattaaagatgccacaaagaaggttcacataaacaacacaggtcacagcagcgaaagctacaagcaaaccctgcataatcgaaaagcaaatgtttttcaaaaccagacacacaaactgatagatagaagcccacacggacagatcataggatagcagcagtaatcaagcattgccaaggcaccaggcaagaaccctgaacctctctagtactcgtcaccctcatcaccctcgtcaccatcgtcgaactcggagccgacctcctcgtagtccttctccagcgcggcgaggtcctcgcgggcctcggagaactccccctcctccatgccctcgccgacgtaccagtggacgaaggcgcgcttggagtacatgaggtcgaacttgatgtcgatgcgggagaacacctcgacgacgctggtggagttggagatcatgcacacggccctctgcaccttggccaggtctccccccgggacgacgctgggcggctggtagttgatgccgcacttgaaccccgtggggcaccagtccacgaactggatggtgcgcttcgtcttgatggtggccaccgcggcgttcacgtccttggggaccacgtcgccgcggtacatcaggcagcacgccatgtacttgccgtggcgcgggtcgcacttggccatcatggaggacggctcgaaggcgctgttggtgatctccgccacggagagctgctcgtggtaggccttctcggccgagatcaccggggcgtaggaggaaagcatgaagtggatcctcgggtagggcaccaggttggtttggaactcgttgacatccacattcagagcaccatcgaacctcagggaggcagtcagtgaggagatgacctgcagcacattagcattagccacatgatgtcaagacaaattgcacattacattgatcttacagcaaataactggagtacatagcgctgcaaggaaagatgcagggcagtacctgggacacaagcctgttgaggttggtgtaggttgggcgctcaatgtcgagggagcggcggcagatgtcatagatggcctcattgtcgagcaggacagcgacatcggtgtgctcaaggagggagtgggtggagaggacactgttgtatggctcaaccacagaggtggagacctgaggggacgggtacacggtgaacccgagcttggacttcttgccatagtccacagagagacgctcaaggagaagggaaccgagaccggagcccgttcctcctccaacagcgttgaacacaaggaagccctggagaccagtgcagttgtcggcaagcttcctgatgcggtcaaggcacagatcaacaatctccttgccaactgaaacgaacggcaccacatgttagacatccaaacaatcacatttccagaaattgtgaacagatagtagtaaagatggaacttactggtgtagtgaccacgggcaaagttgttggctgcatcctccttgccactgatgagctgctcagggtggaagagctggcggtagtcaccagtcctcacctcatcaatcacggtaggctcaagatcgacgaagacagcacgggggacatgcttcccagcaccagtctcactgaagaaggtgttaaaagcatcatcacctcccccaacggtcttgtcaccgggcatctgtccatcaggctgcataggacaaaacaagatttcaacaaattacgccttaagaattttttttatcacaggatttatcaagacaagacgaacagggagtcacaggtgaaccaatccacataatacagcctttcagatagcgttctaatgacctttaagaatataatagcacctatcttcagatcagatcaaaagattactacgcagaaacgagcactacaaagcatgataccaaagaccatcaaatagttgcccaatctgtctaaatatttttttctgtgcttgctctgaaatagttcttagctcgcagcaatgtacatactacagatccacatactccgtccatacatgtgcctaagttacagatctattcataataagcaacaaattaagtataaacgggagtacaaatctaggtgaacagcagtaaaatatcaagatccatcaaccaaaggggcatttcagcacggatcatggcaatccaaccagatccgcatgccattcctatacaacctaggtagaaaatttgaaaaaacaaacaagcattgatcagatctatccgaaacaaacatacactaaccagatctaccaaaaaggaacagattatcagcagggagacagactaattcagtggatccccatccgaaacccccctaatattgcatcatttcccgattcttagcgtctcactgccagatccaaaacatttcgccagatccacgaactaccactgatcaaaacgcagatccggacatcgacaaccacagaaggccagatccaccgacagatctatcaaacagaacgaaccacaccccaggatcacccagatccacccacagatcgaagcgcgctactacgagaaacggaggaatggaagcatcagatccgtttttgtttgttttacctggatgccatgctcgaggcaatagagctcccagcacgcgttcccgacctggataccggcctgcccgatgtggatcgagatgcactccctcatggcggcggcggtggcggcggagacgaacggcggcgaacggcggcggaggagggcgcggagagaggcgagtacgaagacgcctttctctgcggtgtggtagggtttccacctcccactcctcccctttctatagagcgggaggcgcctcggcgtttttgcgtttaaccccctcgattaagtttcccaattttacactccgctccactttggctcctccaacggtcaggaactgtactggtttggaatatcggaatttttctgagggttttagtgcaaaatattcatgccgttttgtttagtgtgggtgggtaagagtccagatctacccgccgctcactgggaggtgggcccactggttgctgcgagcgactgacgtctcgcttgtaggtgggcccacaagggtgggaccggattgtcagtggcgtgtgggttggtgggcgtagttggggtagaattcgaggggttgttccgtcattttccgcccgctccgtcggcggccagtcgtgccgatatttttggattttgaaattcaagagcgggagccaggagggggagggtggtggcaggcctggcccatgatctattgtttgctcggatgggccttgggcctaactgttagttttgattctgtttgtaattaactctttttgaaaggaataaaaagaaccatgctacctgacgggttgatgttttaccattgagatttcaaaggggttaaagtgaaattgaaactcaattcgaacatgattttaattgttttgaactcccttcgaattgagggcagttttagtggttataaatcttcatcgagagaatttttctgatgtttttatggaatttgatgtcctaagagcatctctaacaggcaacatcctctccaaatggctctcaaactatttttttttgacaattctagtaaaaagatactaccccaataacctttccaaccggatggccaaatccctccccttattggcctaacttggcaacccaaaataacttgccaaacggtaggccccatgtactattcctcctccccacatggctactctcctcttctctctctctcttatgttgacggagaggaggcgttgacggtggctgttgggcgaagctagggtagtgcggtggtggaggtgaagcggtggctgtgctaaagctcgcccctggcattggtggtgtgggagagctggccagtggctagtgtgacaatggaggtgaccaggcgacactttctccctccctcttccctccatgttgatgagaagcatgttgttgtctcgaggctaccttgtcgtaccctgtcgtagacattcaaatcaacatgtgctataagccattactggaggtagcattcccaccactgatcgacctcagccttcgccacaccaacttcctcatccattatctcctttgcatctccgctgctgccggaccccactgggccctttgcactgcgtccacccaatgccatcgtctggggcactatgggtggggtaaggaaagatgttgagggagagaagaagaagaatcgcagagattgacaagtgaatccattgtcatattgaagagggtaattgaaaagttatagaagtgaaagataaatttgactctctgattttttttttttgacaagctagccaaatagaaatttggagagttagatttcagcatgttgggagatgctctaagtaaacttctataggtaaaaaaaaagatactgttgtgaaaagtgaaaccgttaaacttatagaatcgaccaaaaccaaacaaacctaccaaaagaagccatgccctaacaaaatggtaaacatacttgatttgcagtcttcaaatcctactatgtttgcatgcttggttgtaacttgcaagatactactaggatgcatgcaggtatcatcagcctctctagtcacaagttgccaacttaggcaagcactcaggaattggttcatgtttaggtactggattggatgtataaaataggagtaataaatttcatgtgagatgtagatttatcatgtgattttttttgtgattaatattttattgttattagatgataaaatatgaatatgcataacttatattttttttataaactaggaaggtagcccgcgcgtctgcgcgggcatgttatttaaaccatcataatttgtgttattaagattgtgaaatgttatgactttgcctctcggtgaaaaaaaaattaaaggttccttcgtaacacatgattgaaaaaaaaagaatagaaaaggtaaaaaaatatgataggaatgcatgtgtaaaatagagtattgaaaagaacggatgttttaatggagtgtagaaaatcacggaattgaaaatttattaacccacctagatcaaaatatcatctatcaatgcgtaaatcataaccaaacaaactttccattagcagcttgattgcctagatgctacgtgaaggaataaaacatgcacggacattttgtttttattttattgccatagggatatacgacgacttttacttaagatgttatttcataatagtttaaatacatgatatttgtcctaaaaatgtttttaagtagttatgatactttctagattgtatagatttataaaccaccaagattaatatttatagctcactctatgggcactttgttaatatcgttcaaaattatacaactatatctttttcttttgaatatgagtgtttgatattttcaaaattaaatgttgagcgttagttatcctaacaatcattgacatatttaattaggcagtaaaagattaaaatcataattatattcttatgatgactgagtccggcatcataacattatgcgtgcattataactcgtcacatgttctaagtatttttttatttataaagatataaaaaatatatacttcaaactgataatttgtatattttgatatgagtgcgcaataaagcacatttgagcaacataaccatttatttatattaaaaggttgaaactgtacttccattatttataagaaaggcagtgattaatgtaaacttattccttaaaaatctacttactactccctatgtcccatttttaagtgcagccatgattttccgtgatcaactctgactgtccgtcttttaaaaaacttaaaaaaaaattaaaaacataagttacatataaagtaactattcatgtcttattatcccataataataaaaatactaattataaaaaatccaaataatatgaacgatcaaaattgggcatgaaattttatggttgcacttaaaatgggacggggggagtacgaaagaaacacaaacacatttaagttagaacggataactaagtatttttcttttttcttataatttttatatgatttttctaaattattaaagttccatgtagtggtttaggagcattctgcatgatgtttaatggacttaaattttttgtgtgtgtttcttgcatggtataggtagaaaatgattttttttccttccgaattgctatgacatatttgtggaaacctaaggataatacaatgatttatcaataaggaattcaaattgcatactgttttttctatcctataatcggaagcttatagcttgatttttaattttaaaccctaaatgtagctttgatttattttttttggatttcagaatgacaaaaaaaaaacagacagagggttgtgaggccaacgtgcttacgtacttatatacggtgcttatgtgcacgtgtatttagtgatttttagcgataaaattaactgttaggttttcatgatagatctaatggtttttaacggtgtatttattttttttattttagaaagaaaaagaaaagaaaaagagggacatgaggccagctggttccgtacatacgtatgtgctttgcttgtatatatgcacgtgtacgtgggattgatggagataaatttaattgatcgtttttaaaaatagatctaatggttggcaacaatgggtccgggaataaattaaaaaaaaaatcgatggttagatgttttgccttcttttgatttttttagaaataattatagcgccacgtggaggcttaggagcatttgcagggttgctatgtggcggcttaggagtatttgtagtaagtttaatagaattttattatataataaatagataatagatagataacataacatcaattatatgcatgtcggtcccatgtgttgtgatgtattttggatcatagacatctttaagtaaaggaatagaatagtatcacaaattggatataaatttaaaacaatttaaaagatggaatgtttaaagagcgttgattggatattttatatttatatattataggtgtaatttaactacgcatatttgcgtgaatttgtaaattgtattaaataacatcgatttttcttaggaacggtactacgttctttttttctttatttttctctatcttataagtatatgcacatggtcttctttttctcacggcaaacaattaatggtttagctttttttttttcttttagtcgtacgtacggcggcaaatgtttcaactttttttttcttttagtcgtacatacgtggggaaggtatttatcttttaggcaacagttatatatttctcctgtggaaggaaggtattattttttaataacagatgcaatctaatagtctaaaatatcgggaccaccaatttaagtgaaaatcaacggtgagattagatagtgccatgtggcgattcaggagcgtttgtaggattgccacgtggcggcttaagagcgtttccaagtcaccatcactacgtatctaagtgtccgtgtcttacttatttccaaatcatcctcgctacagatttaagtgttcatgtctcacttatttgtaaatctatttatgtctgagaatattgcttctaccctcaggtaataagataacaccgttaaaattatacatgaatacccttctaatgggtaaagccgaccgtagccaccaagcctttcttctctaatgccttaaagcatgggtctttcatcgaccatcttgagcacaattttaacgcctacatcaccatcaacacacttatataagatttagcacactcatatatgattgtattggtgggtagaccagatgagctataattcaaataatggtacaccacctcaactcagtcatatgtatgttgtccaatacttacgatatcatagcaagctctattgtacatggtagacatcttgttgagaaggaggatatatggttgaaaatagttatttttaaagttttgagtccaattgtggtatagagtacacataatttatttgtagtgttaataaatactactcaattttaatgatatagatacaatattctcttttaaatataagaggggttgattattagcattaaaactatagctgaagagagttaccatcttgacaatctccaaagcatcatatcattgtttatattttgacaaatatatatagtacagcgtttgatttgtttccaacatctgttgtgtttataatcacatgagatacatttactaaacaataagaatgtatttattttcacagacatatttacaatatctaatttgttgtggtacacttaaagttggttcagtggggtgtatgtgtcatacgtctgtcaattatgagtatattagaatttctatcgattataaaaaattataacatgagcaatttaatgtttatctaagtgaattatccatttgctgccaaaactatttgatagagaaaaaacctacacgcatgaccataattgttatggtagattaaggggttgtcttataacatggtcactggctgcagaaatttaatttaatttgttttcgcgtctattataatgtatgcttattactcctcaaataacactaaaaaatattaaaatattccaaaaactttgaatctagttgtaaaaacgcaattaaattgtgtagtatatttgtcaagtaaaatttggtactactatttaagatatgaaattagtaaaatttgatactatttaagatatgaaattagtaaaattagatactatttaagatatgaaattattataaattattataaaattatttattacatgttggcatcatgtatcacgatgtacttagcactgcaatatatccatcatatgttattaatggtatatttaatttaagaaatatatttggataaatagtatatataaatttaaaatttacgaactttacaatctgctttacgtgtgcgtatgcttgaggtaatatatatttttatattataaaaattcataatttaaagacagtttattttattcggatcctattatgtacttttatttttctttggtgttgttttttttctggtaaacagtatgacgtattttatctcctacgcattgtttagctgtgcttcgtttttgtctcttattatgtacttgagagggagatattaggagggagggaggggttcttgatagaactaatccaatgaccaaaataacggggtttactaatttaagtgcaaatcaacggctagatatttttttttagaatttatacgagtgcggtggcctattagagtgcggtggcctagaagcgcttcttaggaaatttaatgcactttttccacctccctatcctcttcctcactgggccaagcccatgcacgtacatacgcacttaatgaaaaatagctatgcagtattaaaaaagggagtacctatacatctttcgaaagatttttataattgtatcacacagatttttaatctttggattaaaatccgatatatataataaaaggcaaaaagcaattaagaaacaccataatagacaataaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgaactgtaaatttgagtgagaaaatcgagtgagagataagaaaaaatctttcgagtgagatatagcaaaatcgattaaaaaaaacatacataatatccatagactattcacagggaaaaaaataagtttgtttgtagtatctacaattggaaaagacaactatcaatccttacccctctattttcgttggtcgttgacatgagacgtgcgcatgttcttaccaccggtggtggtgaggggaggagattttcttttaacaaatgtgtttactggtttgagttattcgtatttttatccaatattagagatccaaaatagggcatttttttacttgctaaatatgtattttctaattaaactacttattatgctaatgttattaattaattttatgggcgtcatattgtttcaatgtatgctacattttgttagtcatatgattttcccctaaaaatgtgtcgtgagtgacggtccaaaataatgcatttcttttacttgttaaataatttgggtcttaaattttaaatttgttctgggcaaaaaaaatgaatttgttgtaaataatctaataatttacatggataacaaataagctatatgatttagatcttttagttggagtggaggtcgattgtatatgtttctaatttctatctaatatataacttgaaaataggagagggaaagaatttggggggtggtcatcgttcagctaacgtgaggcggatagtacttacgtacttgtttttaggatagatttggtgggtccacttatttaaagaaaaattggtagttagagatttttttactattaaagtgccacgtggcaatctaagagtgattttaggagtccacgtgtcggcttgagagcgtttgtagaaagtttaatggacttttaagtatataatagaagatagatagatagatagatagaagatagatagatagatagatagataatagataatagatttttaaatgagatggatgatcaaatattaaaacataaacccacaaatatttcaaataaacagacggttaatgaacttttttttttgggcggatgcatgctaccagtctaccaccagtcacttcagaaaacagcaacctgtccaacatgaggttattgcaaagctacaactgcatgctcatacaacctgaggttatttttgttcttggtgtacgtgctgacagagtgtatcaagtaaggtcattgctggaatgaccatcaaaatgaatggattaatataagctcaacacctgctgtactttactggcagtagattgcgattaaggaccaaagtggacacaaattgcaagaaaatactccattcttccagaacaagaatctgatggcccgtcggtgcatacaaaactcaaagagttttccgccgacaaatccacatgatcaaccctggaaatctagctctcagaagcttccttggcatgcttacaagttgataagcagccagatgtgcactttaattagatcctagctgaagttatgaacctagtggcatcttcgtggttgtaatttgcatacacaacatcatatcgatcaggtttaacatattttttttcagatatagctaagttgttaactaatcttttttttctctttctttgataaatccctacttctgcagacattgcctaactatctgttcttgaaatgagaattaagaatatgttggactaggattatgataccaatagcataatgactctgtaatttattttggagttagtagggtttctttttcggggtattggagttagtagtttacgatactataaagcgtttcaaaaaaaaaagagctgaaaggctgcaagtcatatggccatgctaattgacttccattaaattagtagcactgcagcagtttcattggcattgacaagcgaatataattaaatcgaacaaacaggactttgaaaaaattaaaatcaagataagtttgatatcacgatttttctccatggtcaagtcaaaggctaaaataagaatcatccatccaatgaaaagtggcggaaaaacgatcaaattggaagtaatatttgcttgcttactttgctggtgctgcttttcttctctcttttttcagaacacagtacaaacatgatttttttcttctttttttagaaagaaaattactacatatgtatatccactctctgcatctaagatgtgcacatccaaaacttgattgactccccatagaccaaatgttcacatttcttattgcagaattaaattttctgctttgtaattcacagcagcccatattttcatagatattgtgtcatgtctgtgtgttgcaacaggattataaggaatatgtacggatggttttataggtttcggttttgtctatttgtttttgttgatttacgcgtggaaacactggtttatgcatgggctggggtggtttttttttgatgatttttgtgtggaaataagcacatatttgtgtgtgggatggatttctaggcagggtggttattttacatggggaactatcatcgaataggaggatgactctgctttcatataatagtagagatatatcatgaaaaaatctgatgtcgatattttgcaaactaactgcttaactaactcgcttgcttccttgtcctaaaaactgtcgacgataaacaagcaagagtgcacctgtgatacactaattgtactatgttttctctgtgctgacgctgaagattctttgaattgggttcatgcatagagtgtggctttactagggaccaggagaatttaaagggagagaaaacattcagtgcacttgtgatcaatcactttactgaaaatgtgtgttttgcatacatacgaaaatcgctaaactgtagccatgtgtaattgccatgaaatcagagaccaactaattgtaattaacttttggttgtctgctagctttccaatgtgcaatcaacgaacaagcatgcatgttttcaagacctatggcaatggtgttgacatatatggaccaccattgtctaattaagcttctagaatgcggtgcttaggcatcgttggagcaatctggatcactcgtttatgtaggttatttatttatttatttattggtgagttggagcgggttgtttagaacaagggtgtgtttggtttggtaccatgctaaaatattggtactactaaaacctaggcaagttttggtaataccaaaattttggtaactttttgtgtgctattggtatattttggtaacaaaccaaacagtaacaaaatactattcaagatgccaaacaatttggtagggaatattttaacttcaaaccaaaatggttctaaagccctaaatgcaaggctcaggttataagcaccagccagagttaaaaaaaatttaaaacttaatatttagttgattttaaaaaattcatcgtaacttattttttttaatattacattttcttaaatcgcttaggagttttaagtacaacttttcttcaaataaatcgtacggtctataatcaacattatagactgtgttcggatgccccttttcccaacccctctccctcgtttttttgcacgcacgcttttcaaactgctaaacggtatgtttttttgcaaaaatttctatacgaaagtgctttaaaaaatcatattaatacattttttttaaaaaaatagcaaatacttaattaattatacaataataggtgtttctttttgcgtg

SEQ ID NO: 30957 - DNA, 19700 bp, Oryza sativa
  unsure (1)..(19700): unsure at all n locations
agcctaagctaactgatgattatgtttgattatacggcttatacaggactgcattttgtttcaggtttgtcctcaataaattgctaatgaaagttcaaagaacggaccttaaacattaaaactaacagtatttacccttaaacttaaactattaaaattgtttaattatttttaactttggaccagatctaaatggtttcaggtgacgtgggcacgacagggaaattaagttatgatcgaatgcggaaataattatttattcattttatttacaaaataagtaagtggcttaagaacacacagaagtatatatataatctatgtgaaattttgcgattctttttttaaagaaatgtactccagatacgtaagatccagccagtttggttaaggtttggcttttccaatcattaagctaaactgaacaaccttcggtattcagaacaaatgtggaattaatttggggcaaaatttttattccaaccaggagttttgtagaacgctcgcctgcaaataagcagaggaaggatggaccgaaaactcactctctcctgattaataagtaaatcatcatgttaaataaattttttgttccatctttgtgcggaagaaatgagcccaaattacttacacacaagcagggagttcttttagaagaaagcacctttatgcgaaaatgactcagaatgcctgccacctgaagtgacaaactgacaatgccattaatattccattgatttgatgacacgatttatagccaaattgtgatggctacggctactcttacatgtaaccactactgggaagggctctttaatccggtttgcaaccccttccctggttgcaaaccaggacgtccaattcgagactaaatatgtcaatctttagtctcggttaaaataaccagaagtaaaatggatctttaattccggttgataacactaaccggaacaaaagatggtaacatcatcggttaggctttttttttcttttttttttgcttgcatttattgccaccctcgaatccccacaaatcatgcataacaaatcatccacgattcataagcccatccataaaatcgcccacaatacacaaatcattcacaaaatcatccacaaatctaaaataatctacaacaaaatttacaaatcattcccaaaaaaaattcacaaaacacgccgccgccaaccgctcggctgtgcgccgcctccgctgcccggcctcccctcccgttggatctggcggaggggaggccgccgcccgcttgtgcctcgtgcgccaccgcggcggcttccgccgggccgctgctcgctatcactatcggaggaggaggggagaggggaaggggaggaggtagaggagagaaaatgaaaggggggaggagaagaggaggggataaggacgaggcagtgcgcgcggttcggggtagggattttagcaattttttttaattttggtctcggttgttataaacaaccggcactaaaaataataggggtctgacatgtttttgaaccgggattaaaaataatatttagccccggttggtgtgttaccaaccaggactaaagattaaaaaaatacccgtgggttttcaaaccgggactaaagatatttttagtcccagtttcgatcatttctctagtagtgaacatactctgtagtactccatctgtctcaaaattaatataaccgtatattttaaatttgaattatatggctgcacttattttgagacggatgaggcagcgatttataactcattctttggacttgtggtggccaagtttaagaactatgtgctattattgtttaaaacatagcaatacaaaacagacgaagggagaaaccaacatatacttcttgtgaaggggtaactagaaaggatgattacgtaagacgaagccggcatcatgagaagaaagccgagcaaatagcggagcaagggcatcgtgcacggcatcgatgcagaagacgcagtagcaacggtgatggtgctatgaaagtagatgcagaaaggagatatggatttttacgtggaaaacctgtaacgggaaaaaaatcacgagcaccaatcaacaatgatcataatttaggaattgattacgaacatagggtaataacaatatgaacgtcacccccttctcgtatatcttacaagagtatacagaggagatataagaaaagactcatgatatggaaagacatatagagttctattaaaaaactatttcaaatatattgtaagtctaaaattcagatcacatattgaacagatggaagagaccatcgtggcattaatatgtggaagccgtggctcaagagattggaacgcaatgcgtacatactacggttgggagagtggcgagcagggtgcaactcagacaccatgaagatggtgtgaggtgcgggcagggttttaggagtggaagcgaacgtctgatattcccttcgtcctataatataagggattttgggtggatgtgaccgtatgtccaaattcattgtactaggaagtgtcatattcatccaaaaggaaaacgtacgaattaccgcccttgaactattgcgtcagtctgatttaccccccctaaactcgaaaaccagatattttacaccctaaactatgtaaaccgaacatattacccccttaactcaattcgaagtcgttttatcctacgtggcgtacatgtggcggtcaactaatttttattaaaaaagtccatgggccccacatgttagcttgtcccctcttctctctcttttcgccaatgacgagtgccgggtggcggacctccatctctctctgtcatcgagaggcaacggcggagagggagccgagaacggcgatgggcagagctcgggcggcgaagcaggagcccgcagctactggtgctcagggcggtgaagctcgggacgcatgtaattgctggcgcacggctcgttgaggcaacagaggggatgcccgcagccgccggagcttgagtggatggagggggctgcgaggtgagctgaagacggcggcgagcgaatctcggggcggcgaagggggcactcacagtcgctggcgcttggggcggtggatggagcggcggagctcgggacgcccgcagccgctgctgcggccgccgcctctctcttggtgcaacgccgcgctccgccggcgcttaaggtggtggagggggcagcagagctcgggacggcaaaggggccactcacagtcgccggcgcttggggcggtggagggggcggcggagctcgggacgcccgcaacggctgctgcggccgccgcctctctctcggtgcagcgccgcgctctgctggcgcttgaggcagtgcaggggcggcagagcttaggacggcgaagggggcactcacagtcaccggcgcttggggcggtggagggagcggcggagcttgggatgcccgcaaccgccgccttcctcttggcgcagcgccacgcttcgccaaccctttgggcggtggagggggcagcagagctcaggacgcctgcgactgccgccttcctccccgccgcagcctcccggctgcccgccatgctcgcctcacccacccaatcgcacacaccgttgccggctgtgcggacctgcacctgccacacagagagagaataggaagaggtgaagaggatgtatgacaggtgggtcccacaatttttaaaaggaaaatgctgactggattgccacgcgtacgtcacgtaggacaaaaccgctctagattggatccaggggtaattcgtctggtattaaaagtttaggtgagcaatacctagtttcatgttcagggggtaattcggtcaaccacgataattcggggggtaatttgtactttttcctatccaaaattccttatattacgggacggagggagtactatataagagtattgcattttggcttatttgaatctaaacttggaaaggagaaaagataaaggaatgagtggcaaaggtgtggcgtgcaaggggtacagcgccatcgattttcctacaccacacgcccccaaaccgcctgcctctacctgtctgtctgccgccagaggtcaggcgcgtgcatgcactgaacctgctgccttcttgcttgggtgcgatgcgccatggcccatggatgattcgctccttcttcctttttcttcttctccctcttgctttctcgttgagtttaatgagtttgcgtagaatcctcgctttgctgaatcgaaatgagttgcttccctttttcattattactactgctaactctactcgagtttaaggctgagttggatacagcataactaccgggtttttccacggcacatgaaagaagaggtattatcgaattattagttaactattataattttcaaattttgatttatttgatttttaaaatatatgtataaactttttttaaaaaaaaacacacctttcaacaattcaaaatgtgtatttacgaaaagtagggtggtaaccaaacgtaaaagttgattcaaactcaaccctagctgacaaggttattgtaataataggttgtatatgatggttagtagaatctagaagggaccaacaagataacacggctctgtcctaaaataagtttatctttaacccatcccacacgtaccaatacgaaacttaaaagattaaaatacctctaatttattaaattccaatacaattattctcactttatctgctcccaaaataatcattctctacttttataaacttcgatgcaataattactctataaacaaacttattctgaaataaataatggaagtaacaaaagatggagggaatacagaataggtctgttccaaatccactatccatgtcttttgggagacgtgaaaacggttcatcctccgattgcctggttctttctttacatcagaaaaaggaatatgaattcttcgtttttaataaacggagatcttttttatgagatttcaactatgcctttctacagaattagacagcctgaataaaacgtgggcaacatcgataaagctagctagcacgaaagataactagtagtattgaataacacgacttgtaaagtataccacacagcaataggccttctccgaggccggtaatttcctaattgaattggaccaattgttgtgtaaaaatacttggtactttgtacatgattgatgctttgttaacaggacttggatcccattttaaatgcaagaattttacagaaatttgcgtaagagtttcaggaaaatttcttacataaatcaggaaaatttccacgtccgatacagacctcaagtgatgcatgtggcacgatgatctgatgaagatcaaactgcaagggcatgacgagccaacatgaattaaggttgtgagtaggattttaccttactaacggagttcaggggttagagcaactccaaaagagtgactatttagctctccatgttaaaatttgaccccaaaaaaaaaaccactaaaggacttgctatccagatggccaagccattcggctagccaaaccaatccccacgtagccacgcttaggggtaaaaatggtaatgaaaattcttgatcgaccgatgcttcatttccgatttttaccagccgagcaacatggaaatgattaccgatgaaaacagaaatgaaaatggtaaaaaaacacatggaaatggaaatgattttaccttttttatattatgataattatcgtatttctaaatacactaatatttatggcctatttctttatttgattcatagtttagagcccatcaacttctcaaccaaatccctaactatagttcaaggttaaaagaagacaacttataacttatacatagtgtaaccttgaatttgttatattatagttatgcaaaattaattgtgcgattttacaatccaatgtttccgatatttattatcggctttcgatcaataccaatatgtttatgtctgtatagcctatttctggttttccgatatttccgaatatagcccgcctcctccacttgtcaaacgtgggtcccgcatcctctgtctatctttctcccatctctcttgcttgtaactattatacatgggcctaaagagagagaaaaaggaggaagacactgacatgtactcctctatcctaaaataaattaacctcagatatggtgcatcctagtacgataaatttagatgcccttatgtctagagtcgttgtactagaatgtgtcatatcccgtacaagattggtttatttttggacggagggagtagagcctatataatttggagagtgggatatgaagggattgttggagtaaaaaaaaaaaggattttttttaggaagcaaatggagagtaagatttgaaaagactcttggaccgagtttttatctctactttcccaactcacctccctcgttttctgtgtacatgtatttcaaactactaaacagtgttttttttaacgaaaactttctatatgaaagttactttaaaaaatcatattaatctttttaaaatttattttagctaataattaattaattaggtactaaatgttgtttcgttttacgtactagggagcgaacacacccttggagatgctcttatcactctccgacgataagctcaaaaggcacggtaatggcgtagctaccgcctaccgcaatggttagtggaaaatcagacaaaatttactataaaattatttttttgtttaaatttctttggaattttgtgaggttaatgggcccttaacggtactgcaccccgacgacaagccgcacagcaacctacagtaaggaatccctggtctttgagccttgcctgccctgtcgtattctgctcccttccaatttgcacaactccatgtggccaattgttcattaattttggccaatgcacaacgcaagctgacattttttaaaaaatatatttttggtggtccaatatattaaactctaattttctgcctatattataagtgcagtcgatctttgtgaaaatgactagtcggctttgctgaatgcatctatgagaaaatagatagaggcacatgttgaactcaaacatgcatggggtgaacaaaataaatatgtacctctgacgacgtatctgctcctatttatttgcaagattatttcaattaaatgcaatagcgaaaagtccaaatgcaaccctaaactgaggccgagagttcctctagcatctcaaatcaatattaagcaagatactgagtccctgtaattcttttgtctgatccaaataacccttaattgtttcgcaaaatgattttgcttatgtggcatactgactcgacggttttgccacgtttgcatgctgactagaccactacaacaaaattaaaagaaacaaagcaggagctgaaatggctgcaacactggtgaccctttgagcagagatgaaagtgtgtctttatcactaatccaagacagctttcccctgattcaatctgaaattctttgacataacaatgctaaattctgctatttttcccttgataatggtgactaaacatcctgaaggaaaaaatgtatatgaaagtagtacaaacctgcaattctagaacaaaatttctttgatagcaatattgactgtgaatttgtgatttgctcataatgtctatgttgttaggagtttgataaggactttgcagagcaagtgggtgattgattttcacatatatggacacaaaaaaggtggctaggggagaagaacccttgaacagcaacacctctcccttttcaaaagtgcttggaagaatatcaccaccacactctaataagggacccaatacttgtgaccaaaatgcaaactaaagggcttgattaatttgattttactttattaggaaatatgaattactttactgcatgtacatatacaagtgcagaggactagactatttgttatttaaaatctaatattgactagctattttagcacaaaaatattatccaggaaaaaatgcagcattatcataaaatagttttagaaaataaacaatggttgtagatttatgtagtcactaccaaaaaccagattacttctgacagccaaaaaccgtcgagaaaatccattatcacgttaggaaaatacgtcctgactttgtaccgtcagggaaatcccgtcaagactggcttgtcagcgaaattttaatttgcctgacggatcctcgtcaggataattaatactagttaaatacagtgacaatgtatacagacttctgtatatctagttgaagaacagtcgagccaatcttaccaaccagtcctctttgtcaaagtttgtctcttggagagagctttgattcttaatcatcaactgccaaaatggatcattacaacaagcatattataatactttctagaagaggagatactaaaagtagtttacatacattgtcactgtatttaactatgaaccaaataccaggtcaatcctaacataccaaatatcagaaaatgtatagatattcctaaaccgtctgtttttttctaatcgatatccaccaaaggctagcctttggaaagagcataattattctaaacaagacttaaggcagtcgacaagtttttatttattttattttattttatttttttgctagtgacgttttagaatatgtgccgtccatacatacccatccaattattcgggtttgtcatgttcaaaatgatattaccagatttctcggtaaaagaaaagagctcacatcatgatacctccaataacttttagtaacacacttttttaaaaagataacagtaaaaggtctgcattcaagaccccataaaccactttaaacgagaagctagtaaaaagacgaattaaaaaaaactagtaaaaagaacctttaccatacacctcaaatgaacaccacagcactttactacacatctaacgtctatttaatctagtattttctttaagatatgcatttcaagctgtacaaatctataggtccaaaattttgattatattcataacatttggataatttattttattcatagagaaaatataaaattttatactattataatttaaccaacacacactctagatcaatgtgcatctggggatctggagttcagccgaacaacgcagaacctcaaaaagaaatccacattagcaaagaggccaaaaaaaaaacaaggagagacaaatgataatggcaattagggtaaatcaaaccccaacaaagaaccctaaataatcaattactccatccatttcatattatgagccatttgacatttttcttagttaatgttctttaggatcgaccaagttcatagaaaaaattagcggcatttataacatttagtttcattaattttaacattgaatataatttgataatatatttattttgtattgaaaattttagtatatttttctacaaacttaatcaaaattaaacaaatttaactaagaaaaaaaatcaaacgacttatgatatactccctccgtcccacaatataagggattttgagtttttgattgcnannnnngnncanttgtcttattttttttttgcaaatataaaaaacaaaaagttgtgtttaaagtactgtagataataaagtaagtcacaaataaaataaataataatttcaaaattttttgaataagacgagtggtcaaacgttgcaaacaaaaactcaaaataccttagggcccctttgaatcgcagggtagaaaaaaatagatgaataggaaaaacacaggattttgacaggaattgaagtgtaaaacagagaattgcaaaacacaggaaaaacacaggaatggtcgtttgattggagcgtaggaaaaacgcaggaatcggatgagagagatagactcaaaggaaattttccaagaggttggatctcttgctaaatttcctctaaaattcacatgcaatgtgccattccataggaatttcataggatttggaaagcttcaatcctttgaatcaaaggaccaaatataaaaaaatcctataggatttaaatcctatgaaattcctatataaaccctttgattcaaaggggcccttatattatgggacggagggagtaaaacagatagcatataaagtactattagttccaattgcaggagtagggactattggggggccctactcgtcgtcctccacttgtaagcatggcatggggttgccccccacaagttggtccttgatgcattgcatccagccccccttcccctctcttgtgttcttcctccacctcccatgatttgaagccaagccaaaccccaccccactcataaaatcggctccaccttccctgtcaccatgctaatctttcctcctcctcatcaccgcaacatcaccgaaagggtcgaggatatcttctgcttcgccatcaggggaggatccacctcttcgtcctcttcttcttcttcttcctcctcctgcgacgacatctttgcgaccctgccgcttggagttcttgggctgtgcagttcttgatttgcttcttggttgggggtgttgtgggttttgagggaggagaggagttcttggcttgttgggtggagcgagaaagggcgttcttgggagagacgcgaagtccggacatgggagcaatgccaagttcaggatcgaaggtatcggtttcttgatgttttttttgttttgcagcctaatttagtctttgttagggttagtcagtttctttgaattgttggggggaaaggcatgaactttttacttgcctttcttgataatttcagatgggtgtatttggtattaggatgatgattgttaactctaaaaagggtttttcttttctttttttcttcagatgttgtcactttgcctgcagttcagatgatgggcaagtctgcaacagagacttcagatctgatcagaaatcacaagaactctcatacacatctcagttcttggattgccaactgatctagacaaaatcacagatcaaaacatctagccgaatttggggtttgttgcaatggaaggtgtaggtgctaggcagaggaggaaccctctgatacccagaccaaacggttcaaagaggcatctgcagcatcagcatcagccaaatgctgccgagaagaagaccgccgcgacatcgaattacttcagtatcgaggcgttcctcgtgctcgtcttcctcaccatgtcattgctcatacttccattggtgcttcccccattgcctccgccgccatcgctgctgctgctgctgccagtctgcctgctcatcctgctggttgtgctggccttcatgccaacggatgtgcggagcatggcttcctcttacttgtaaatacatctcctaggggaatttatttttgtttttgttattttggttttggttttgtattcgacataagatgagcgcgacgaagcaagctgtaaaacatcactttccagacagattttgaatgctgaagtttagaggttacatatgttactggtctgaaactctgaatttgggaattctggtgtgattaccttacctgacaaaaaaaatttgcaggttttttttttctgtcaaaggatcaatcttttaagtgatcaaattctccagctgtactggaaagtctccacctgagaatgggcattgttttgagttcttcgcaagcgacggtattcttcggttgaccctagaaatgcatacaaaataatccggatagggcggcgatgtaagtttcctaagttatatgtgaagtagaatggcagactaagtcatcagtaaacaatgtttatgcccatgctgcattagaatggcagtctataggtcatcagttaacaatgtttgtgtccatgtttttactaatgtttgaacagaataggttcgcttacctagtcaaataccttttattcattactaatttagctttcagatgatcagatattgaagtgtaaatcactaaatatttttttccaataacaaataagcccatgtaggagcattgttacccaagcttgcatggttgtcttccatttccttcctgtcattatcatataagtagtctgaaatacaatccatgtgaaaattgaagcctaagaaagcacacattttagaagaaacttctgtcctaaaaaaacatgtagctgcagattcggtcgatgaacgctatcagaggcaattgatcactactaagcaactgaagtatcttttttgagataagacaattttaagtagggtattatgcagagtgaagtccatgatagtttagactttcaccgataaaatcacaaagagaattggataatttcagttgcaaatcccgttctaccgtgccaatatcaacactcaaaattatgccctgatactgacagttcatgaatataactttcacccccaatacattgcaataatgcggttttacttcgaggttctaccctctatcattggaataactgaatatcagttgacaagaatacttatactccctccgtttcaaaatgtttcacaccgttgactttttagtatgtgtttgaccattcgtcttattcaaaaaatttaagtaattatttatttttttcatatcatttgattcattgttaaatatactttcatgtacacatatagttttacatatttcacaaattattttaataagacgaacggtcaaacatgtgcttaaaagtcaacggtgtcaaacattttgaaacggaaggagtaacttataaactttaactgaagaatggacgaataactcattttcagcatgtcttcacatggagactggacactgaacttcagatctcaaatcgacaaagcaatatttctccagtcaagccacacctaattggcttcagtgttctgaaaatcatcagggaaccagagaattagggagtaagggcagactgtgtgttggtcatgtctagagcagctgacaattttatgctgtgcctaatgggccaaaattccggttacagactatcacctgttgggcctcaataccctatgggccgaaatcataacatcaatcccatagaaaaaagtttactttgggtccctcaccaaggatcgagtttaaaccacgtccctcaactgcaaaacctggtaagcgatttaaacttaaccatagatcagagacctaaaatgagctttcgccaatccactattattaaggtcaattaggagaacttatataactttatgttttcctttacactcattattcttattaaattataatatctctctgtgaaatagaaccagagaacatattcttatcccccttgacactaaaaaattgccagatcatgggacatgtggcacatgcttgattcgttagcagtagaactacagaataacaccatgattagtggtgtgcgcacccccttgtgcactgaaaaaggaatatcatgtcacatcatatgcaccttcaaaaatattttttctccttttgtttgtgaactaaaaggcttgaaccaatataaagaaaaaaaatctctgaagtttgacaagaaccaccattttcttccctgcttttctaagtatttgttaacttcatttctcatttttaagggatattcctctagaacaccattcatattcattcaatacactaaaaaaatgatgagatgcactgcttgctttcccctatggcaaaagttggactttgctactcaaatgtaaattcatcaagtctattattttttgttcaattggcccttggaattatgatacctgacataggagtagttactagtactaaacaagaacatttatgcctgaccaatctagggtccaggtctgatgcctgacataggagtattaacttgctggttttcatggttgcaacatccaaattgatgatgccctgaaaccatcagaacgacacagtgcctgccctgtggtaaatcaccagacacaaacaggctgcaatcatgttcatgcagaacaatttaggaatcaccagagaattttctagttggaaaataaacaattttcagggtttttttcaatcagagatcaccaggggtgacatttggcagattgaacattttgagctggcatgtcacagctcatggtatggccgcgtagccatggatgatgcttgataatccgatgtttggaagcattcaaacaaaaggaaaaatcaattgacaagaaacagcagcaagatcaatatactagtataaaactatacttcctgtctcgcgtctcaatcaaggcatcatcaacgcatataaagcatatacttactgtccattcatttttatgtttgtgaagccaagaaagatgagactagtccatgttcaaaaactcattagtccaaaacaaaaacatgacgcccatggctagcactcagaaaaaactggagaacactttgctcaatgcttatatcattttcatcaagattatgatcccaataagatctactcaacacttggctcgacaagaaggtacacaccattttctccccaaaattatatactctccgaacagcgccagcaggagagttcttcagtcactatgctctcagagacctcaaggtgccatcgtttcagatgattgtccccaagcaggaacatgacagcactggaaaacactgaagatggtgcattgcccttgttactttgcttcttgcagcgaccaatgcagatcatgtggaagctgacctttcaagtctggatcatgaaacacgggaggtggtgctccaagatggccaggagctctgtgccttggctagccctgtcgagttgccggccctcgagtctaccagccgcctcaacaagctgccctctcagcttctgcggcaatagccgcccacctgactccacgcattccctgtacagtggtaggtaggccatggcaatcaccagctcaagtgggaggtccctcaggcagatcggcgactcacccttttccattatcctcatgaagttaacgaagtgctcttgcgcagacgcgaatccctcagaaaaagctgcctctgaccaatgctcgagcatgaaagatctaagctttgcatccactgcctcatcggcagattttgcaatgttgtctgctacagcatatgtggcagctgggtcattgaggaagtttgagcggagaaggaagtccacaccatgcagggaaccggtgctcctctcaccagcagccttgagaatttcgacgctgaggggtgcaagaacatgctttgggactagagggagaagataggctgcaactgcaacctggctactagaggttgcagcagtaagggctaagcaaagctccatatcccgacaaccaaggttgacgaaccattcaacaacttgaaggcatccccgttcagctgcccgcattaaagggccaagaaaggcaaccgcattaccctcctcaactaagcaccccatggtatccagtttcccatagtgagcagcaaagccaagggctagatccacatcgatgtccaagctattccttcgagcaatctaaaaaaaagatacaaacaacagatatgttagaacgctgctaatgtttcatgatatatttgcaccaacagacaaaatatcagaaagtatgaaataaaaaggaaaaaaattcctcaaacagcctgagtagcttctatttcacaagacctataatgcctgtacatttttcagacaggaaaacatttgtaaatatatcaaataatcaattgttatctaactcaattaaattcgagaactgccatatttgagtgatggtctaaccatgaaaaggtgcatggcaaaacattgttctttttttttttgcatgactaaatacatgcatagtgcacctacaatggaattggtccaattgctgcccaaagtagagatgaattacaaaggaaacccatctgtgcaccagctgtctaaagtcaaaacaactccaatatattaacctattttaggacctgatcaatcagcgcagttcaggaaagtcttccatcacgaatagattgatcacaccattttttccctttgattggggattctctatgtatctccagtgagattaatgaccaccccaaaatttatgagcttctctaaggggagaattatacaattcaccagatttttcatgtatactatagttatgtcgtaatgaatctggatgaagcaagtcagcagaaaacagtcccccagctactctatgtaacagattatatggatctccagaaatttggaaagtatagtaataggttaaggtaggttcgaaggcatgaaggttgaagacggttacaccaagtataattcaaacatgagcagtaaagctccatagagaaaaaaaaaagatcaatttccagtcaaaaggaacaaagttctgaattaatagcaaaggtggtagctctacatagtttccatattcatatattcatgacctggttatcatggggaccaatgtgtggtgcaggctattaagaaccacttagttgtgctgcatttatattgtttgctcagtaggagtcattaacctaaatagtacaactaatatttattattaactgaaataagattcacatgtgaattattgtttttattattacctgaagtaagatgcgcacgagttcagtgcttccatagcgagcagcctcaagaaagcactggttcacattatcggcaccaccctctactaacaactctaagagtccttgtattgcagctgccgagatacctgatgcccaaccttggtcaaaggtgtttgagaagagtgtaagaggaaaacatgccgcgtcaaaggcctccgtgaaatccttcccagtaagatcattatcggcaagatccagaaatgtcttgaaagcagacagctgaagttggacctcaatgatcgtgccatggtttcctctgcccttgttctcccgcacacgcgaatgcagcccgatacactttagagcccactctgtgaacttgtgcacctttgcgcttgcttctgccttcaatacctcgtcgccatgggattcttgaaggcgctcgttcaacctgataaatacataaacaaatcattacaatcaccacaattgtatcaggctagtttcaaatacaaagcataaaggcgaatcgaattcccgaattcgattcgaagtttcgcggtcgcaaaacatgcaattcatgttttggacaggcttacttttgccccatgaagctcacagcgtcggcgaggctggtcgttctccccctgcacgccgacacgcacgacgcgaggaacgacgtccggagcgcggcgcgggtgaagtcgttggcgccctccgacacgatcctccggatcagggccacgacggcggcgagctcctccttgtcgctgaggaaccagatggcgtcgacggcgacgcagagcacgtcgttgagcccctgcgcgtcggccctccgcaccagcgcctccgcgccatcccagtcgtgggagctcaccgcgtgctggaacgagcggctcagctcgacgcggtcctgcctcgacagcttcctctcctgctgctgctgctgctgcttggcaccgagctgctccaggtccagctactcgccgaagtcggagctcaccgatctcggcttcttggcggcggcgcaagccttggcggtcttgggcggcggcggcggcaaggggcagtccttggacccggcgccattattggcatccgccggccgccgccgcggcgccgccgggctcgtccatgtccatctccgatgaatccagctgctcctccatcagcttcacggcggcggacctaacgtggggcatcctgaaccccccaaaaaaaattaaaagaagaaaaaaaaaagggagaaatcatttttggttcgccaacaaactccgattagaacagcaccacccccacacgcatcaaatcaaacccggatgggctaatctccgttaatcggtgcgggagaaggaatcaacccgagacccccaatggatctccctccaattcaagaaatcaaagaaaccaagaaagaaagaaatcaagaaccggaagaaagaagcgagagtcaccttcaaattcgattcgaccccgagacggatggacgggcggcgggaacgaggccggccggcgagcacaccgcgacgcgcccccaacccacccacgcgctggctggatggcgctggctccgacactgctcgccggccgtgagagagcgcgcgcgcgcgtgtcgcgcgacgaggagggccaggccgcgggagagggggcgctcgagctcgggccttgcacgccggcgaggcgcgcgcgcgcggaggaggtggctggctggctcgctggctcgccgcgcctcggccggggagcgcagcgcgaggagagagaggggaggggagaggagaggagagagagagagggggtggagagaagagggtgtgtaggtaaaaagaggagaggtggagaggaggagagagaaggatggagggaaggaggagggggacatgtgccagcaatttcaagtcatttctattctatttttttcccttcatttttaaaattttggttttcgaattaaaatgtaagtaaatttttgggaagatgttttatatgttttggtgaaaactatggtttttgatttagcattgaagtagatgttttagaaagatttatataatatattacatgatgattctcttggctataactttatcggtaactgagcttgtgaaatacgtgcttccatccgtggattctaaatcaatataagtatatgacgggagagacggataatatttgagttttttttatagaattgcacgttgttgtagtagtttatttagtgaaatatctacctaagatgaagtaattgtaacggtgtaaattttagccaaattaatggtgaagagagagtttattaagaaaagaaaagagaaaaagcctagactttttataggctaaatcagtactcacctctaaattcttccattcaccctcttatctctagcctctttcgatctaacctaagagaaaaccaatcacataaacaaattcaactaaggggaattacacaatgaatcaaaaaagaattaaatgaatccaattaaaaacataaaacctgaaagtgcatctaggacccctcatttattttggtgttaatatcaacacaattagaggttcactaatgctctttgttgagatggatgcaaggataaaaaggagtggaacttgagtttaaaagcattgcggcatcttttgtggtaattgtcttctaatccatgtatatattgtgttcttgagtattaggatgccgtactattaagagggataccacatgcatataattggtagaacactagtgctcaaaatcctgtatttgaagtgttccttttttctcctgtcggactatccgatcttgatcagactatccgatatttcacagaactttgctctgtgtctttggtctgagtattggctaaaaaatatcggactatccgatataaggttggattgtccgatacatcggattgtctgaactttctcagaacttcactctctgtcttgaattgctttttatttctcttgagtgattttcagatcagactatccgatgtgatcagagtatccgatgatacagagactccgaaatctattatatattaaaagtccattaaactccctataaacactctcaagccgccacgtgagcctcctaaaatcgctcctaagctgccacgtggcacttttatggcaatagttcaagaggtaatttgtttttttccatttaaaattgacttgttactttggaactcatatgtaatggttttttttgggggggggggggggg

SEQ ID NO: 30958 - DNA, 8224 bp, Oryza sativa
aagcatgcaaaaaaaaaggtatttaaaattttaaactatgtcaattgattcttaagcttggtgatataatgctcaagcttcaactatactgtaactaatttcaaaaggaattatgattatatgtgtttcataaataaaaaaacatcatattttgtatgccaaaaatgtaaaataaagatattttggttgccatgaaccattaacattaaaaattatagttattttacttcaagcttgctcaaaatcacagcagcacacaacattttctctggaaagtagggacatcaaatcaacaaatctattgtgcactactttgatattgtggttaaatatacgaatctcataaagtatcatcgaccaatccatcgtatggcataaaatgttgtggtgatcatgtgatctgatgttcccatcaatttgtgtttggttttctttggcaattaagtgtgcaatggaaggactttggaggtggcaaataaataaatacggtgcaaaaataaataagtaaataaataaagatggcgttttcatgctttatttcactctcgtcagctcatgaaagtgagagtcgcctcccatcacaggccaccaccaaacacacgtccctctcccatgtggggccctcctttatttaggttccctgcgggcccaccccaataattacaatgcccttcacagctctcatcttctgtgctcaagcatagggtggcatctcatgtggctttaaggaaaaatattactagcactcagtagtttctttcagcatctccagtttccaatctatagatttttattcaaattatgtataagaatctatagctatgggctctgttcggctgcaatttttattactgtactgcagccaataggaacattgttttgtatttgtagctgtgatagcccagcagctgcatatagcagccaaacagacccatgcaattcagaaaaatgaactagaaataacctagtttttttaattattatcagatgacttcctttttattcaatagatgcttcttagagtcccgagttttgaaataagggcgccatagtatgcattgtgatttatagtgatgaaattgtaactggaaaataatccatgagtaaataatttaatgtgaaattcatgcacatgagttataaatacaatttgtcaaggtctcattgatcctttttataattgtggtctcatgcatcgttccgtgcaaataatttgcattatgtttacacaagatctaattctaaataatgttatttagaaacttgtctcacaaaataccctgaaagcaataattgggttagaccttccgacatgtacaacaacaataattatacagtctggtgagtgacacgttggatgtttgctaatatgttggggagagaatacatatacgtctcctcatgtacaaaacaacacaggtatacactgtgcatgtacttgttacactcccccaagtcatggaagcatgttactctagtcatgttctaagtctaactttaaaacctttgtgcatcgatatcaatatcttttgaatatttagatcggatgcataaaaaccatatctgcaggctagtccaaaaaaaatggttcataatattatagtacctacaatacaaattagtaatcgaagttgcgtctagaagacggtactaacattaatatgtatagattttttcagaaaaaatgaaacatttttatgacggaagataatattagtcaccttgtgtttagccttcagtaatgggtagacataggaacccatgaaatgttactaccatattaacaatttacacatgccattttccattatacacaacaacttactattgtactaatattttctcttgtacataaataattttgtataatatatgcagcaagttgggccacacaagggaccacagagagagaaggagaatgcaggcaggagatggggggcagcagcacacgggcgccacagagaattccagcttttggtctgcaccacggatctgcaggttgcaaattactaagcaattgctacagccaaatcaaaagaaaagttatttatattattcatttatttattttgagaaactaagagctcgtaatgtacgtttcactcacccatataaacgtatacgcacgtaccctatttctataatcacctctagaatatactgatatatcttaagattaacggaccattccttatcgatgagtatatcacctgctaaaaagtttaactgtaaatttaaatacaattagctgtaaatataaatttacatgtatttattattgtactactactccactagtatatttattattggtttttttatttagattcctgagcccagaaaccctcgcgctcactgctctccctcccctgattctctgtgtgcgtgggtgggccagcaccacttgatgccaacacattattattaagcgtctctgacaaagcggttaatcatgtgggaccaccttttgtgtagggacatgacatgaatttttttcagctctttttagttttctgccggtattaaaaactcgttagtattgcatgacacacgtgtcctttacaaggtatacaagcttactctagatggatgggaaatgaaaaacaataaacattacaaacatcataaaaatatttgaggggacaccaaaactattgctttattatttttatctaattcgagagagaaaccgtaatgaaatgatgaatttgtccctcgagctagcacatgtatgttactcggctttggtttgatcgaaccgaacaatgccatcttttccgcccgacccccttcaaaaatctagaatggcgaccacgactccacgagtacattttacaactttccaatttgtttactttttcaaatgtttagaaaaaatcaattgtttattcttttcttatttttccaaattttcaaactacacattatgcaatttgcaatctactatcgccccaagtatattgctgccatatatcaaatttcttctttgcatcaggttagaaacttgtggctcaaaagtcattcttgtatttttgaaaaaaaaactctctctccaattgaacctaaataaaataatagctacggtgcctgtactatccaataaattacatatttgaatgtgtcctttcttcatcgtacacttttattgtccaacatcaaattacttaaagtgttatgtagtaaaatttgccaatgaaaagtgtttataaaatttgcccgttgttttagaagaacacttctatatatatatgacatatcatatataattggaattttggtggtaaggtttcacaaaactacccacatctgaatccctcttaatcacaaaagctttctgattcccaatcattcaaataccatttaagaaaatcctatattatagtttattctttttccatagacggttcacgaaacttctctaattggtgaccttctaatagtagcgtgatgtaaacaaatgagtcttgtttcaaccataagtagcatatattttatcagataattcaaaaccatctaggtaaaccccgttaaggcattactatataggaaccatcggtgatgaccttctcagtaataggctaaatctgttaggatacacgtaggctacgatagtataaattaaaattttctatcgcgtaaaccaggaaccatacaagtattagatcatagatcgttaccactcgacgcgctgcgcagcgaaagaaggcgctaagaagtcgaaggaattctcgcgaagtagcgggtcgatgtagaggaagtagtcgatcgcaccagctcgatcttcttctcctcgtgcgttctcctcgccgtattcacatgctgatcagtaccgcaaaccagcggcgcctctaccggtatccacacgtatagggacggaacgccacgcgtaaatgtgctagcactcgcgcgcggctagggttttgcttagggaggatagtgacggctagggtttctcacatgatgcaatacctccgccggtcacacctctcacgaatatataggatccatcacttgggcctccaaggcccgtaggactcctattcggatccttatccgaatcaagctcatattggatctccatccaatccccttattctagcccattaagcgtgcgactctgtaggttcatgtacactcggctgtaacccaaaaactccttttcggttcacgcgtcaacagcggcccctagcagagtgtattgacccacggggcatacataaagatcatatcggctgaacctttagtgtatacttgtatgaacccctttgcctcacgatatcgattaagctcaaggctagatatgtgccatcctctaacagctcaaccgttcactcgaacctgttaatagattatataacttgtgattgactcctcaatcacctttggcatggctatgcacttccataatctacaacatcgaggggcccagagatatatctccataggaggggcaaatcccatcttgattattcatatcccactacatgtttcatagcatacccgaaaactacttttataactactcaactacggagtagcgtttagcagtccctaagtaagctactacacatgttaggaaccatgataatctcaggtctaaggattcaacaccaatactaaatgagatcactgatgacacaacacatatggctcttgcagtgtctcattatgttgggtctatccaataacatgttcactaacatgtgtccacattattaatttggtatctctataccatgatccatgagacatgatcatcaattaatacatgtgctgatcatctaaatatatttgttctacatatgatatttgatcagggatcctttagaaatagcaacacacaacataaagagtctcatgaaagaatcacatattcattaattatctatttcaaggaacaaagtcggataaatatgtaaacatagtatgtgatacaatcatctctatgattgcctctagggtatatcactaacaaaatcttaatttgaaaattaatctatatgtttgtaattgttttttttccaacataactttggattttaaaccgttaaattgtagatgagtaaagtattgtcctaaaattattttctgttacttcaaacacttataaaccgcagaaaaaaaaatgtcagccaatcagattctaaaaatagcattgtggtactgttatattgttaccagtagcatctttgtttggtggagtttctatcagctaagtttttgtcgaatgctctaactttcataaacaattcagattctcaactaaattatgagaatttaaataaaaaactaaaatataagaattcgtgtagttatagaataaaaaattaattagaagatataggtcagatatagttcatgaagaccagcttttccagtttctctatttttcggaatctcgagcccccaaacaaagcttagatatacctcaatgtttctcattagtttgggcctaaaatgcccaaaaacttctgtaccgttctttcctcatctggaaatgctatgcagtttaaaaaacaaggtcgacaactggtaaaagaaaactaaagataatagaatgagataaatgagaaaagaacaaaaagaagggaagagagcgagatgggggctagctagctgtgcaggttgcgtacaggttgtgtgatgtgagatatagattcaattcttctagagaaagtgtctggtcctatgatcttcatgtacacatattcatgtatgatgttggagcttaatgtatagccacatcttttcaaaactgatgttctaagtgcactcctttaattacgctttgcaacataatacttcgttgcggagaaatagcatttgtggatttgtcataaaaggcattggtgtaagctgagtaacagatgaacaaaaataaacataactatatatgttgcacatcttattcatactaaatgacaacaaataaaaagagaaattgcttaataaaatgatgcacggatctcctgcgtgttcccaaataaaagtaaaaaaagaaaaaaatgatgtaacattaataatccatggtacaagcttcgcaggctctcttgtttcaatcatgcagctcgaaccacacattagtgggagttaggaactctccgccaaacatgcaaaacagaacgatccattagggtatgattaattaagtattagcatttttttttgaaaaatagatcgatatgattttttttaaatcaactttcatatagaattttatgtgaaaaaacacacaatctagtagtttaagaagtgtgcgtgcaaaaattgagggagataagttgggaaagctaacaaaacaattcagcctaactcgctagtgcgccgacgagatatttcaatgtttttttttgttggcacccatgactccgcgcaaagactcctctaccgttctttcctcaactgaaaaacattacgcaattcacatatagaataaggttgacaactacaaggaaagaaaagagaaaggttgagaggagagaaaagaacaaaaaggaaaacaaaagaaaagaaaagaaaagaaagagagaggggaggttgctgcaggtggtgcgtgtgatgtgagattagattctgctcctgcaaaattttattttctctgctcttctcctcttctcttctctgtgggttgctgcaacgcagtttcagcacgcgtcggcgtcactgatgtcaccccctcccgtttcttcttcttttttctcctccttttcgttgttgctgtttgttccttccgatcccattctatgccttttgtgctgcgtctgcgttggtttgtcatgaaaccgtgcacttggctgcctctccaacggcaaaacgattgccggccttttgttcttgtgtggcgcacgcgtgtgccaaatgtttattctcttgttcttgatctttgtttctcttaatctgctcagctgatcaatttctcgaatgtaaaataccggcccaggtaacaggattgcttaaaaaatatattagtatatgattcaaagttttggagaacaccatggtttaatagactgtaacataggctaaattcgatgctgttgattggctgattagcacatggttaattaagtattaactattataaacttgaaatatatatatttttatttttgcaaaacagttttttgaaaaaaaatcgtttagtagcttgaaaagcatgatcacgataaacagtggcggacgcaggattaaaataaagatgaggcgaagatgctcgtctcaataagaacaactaaacgcaaaaaataccatatttatgttgtaatcatattaacatatagtataatcaataaattaaggcaaacaaaaaacaaaaatgatattaaaataaagtaataatttttgcgccgtacataattcgtcatacataaaaagataccagtaaacatatcaatttacaaatatgagtccattcataaagcatggttgatagatatcttttaaaaaataaatatataagaagatatcgcataccagaataaaatgattattattttgcttagaagggagagaaagaaaaacagtaggcacttactatagtaagggacgggggtgaacgatgttgaggaattgaccgaggaaaccatcacatacgcaggattaaaattggacacttgggctgcttatttatgggccaattgtgaattggatgtggtggtagacggtccaagaaggatatggagggtcggggcggcacgggccgtagctgggccggccgcctaaccccgcctaatgggtggtaccgcccctgacgataaacgagagaataactctttccaatcgcacagacaaacacagcgttacttacaggatgtaagataagtaagacaacgagcggtgtgtgtgtatatatatatagtgtgtgtctatatatatatatatatatatatatatatatatatatatatatatatatatatatatatatatggggtatgagaaatatatatcacggtactagatatatgtgtaaaaggtggtttaatttctgatatgcatagctttgttttaagctgaaggtaggcttggttagatccagtgatcattcaagtaacaacattccacactcatgattacttatgaaatttggttactcaagtcattggactccaaacttctcatttacgccctattaaattcattcatgccttgtgagacctatgatgagcgattgttgtcactagaaaaaaaaatgattttctacaattttattttagacttgatg

SEQ ID NO: 30959 - DNA, 1168 bp, Oryza sativa
  unsure (1)..(1168): unsure at all n locations
aaaaaaaaaaaaaaaaaaaaaaaaaaaaaaaaaaaaaaaagaaaaaaaaaaaaaaaaaaagaaaaaaaaaaaaaaaaagaaaaaaaaaaaaaaaaaaaaaaaaaaaaaaaaaaaaaaaaataannaannaaaaaaannnnnnnannannannnannnnnnantnnnnnnnnccgccccagggaggagggcgccagcatggctggcgccgccgcctctattcctgtttctctgtgtggagttgcaacggtgtcatttttattttatttttttgatgtttttacacactcaggatcacgatacaaccaaccataaaaaaaatttaaactcgaactaccacttagctaagtctgaaaatatctagtataccacttagtctactttgcaccttcactaaaattagaccataactcctttagtaaaactctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcgtaactttctcatacggactcggaattaggcaaataatatatgcatggacatctacagaaaaagttacatccgattctccccagctttgctgggttcggcgatattaaaacctccaaattccgcttgcaagattgtgttttcgaggagagaagtttttcggtggagctttggaaaattccatatgccacatatttcgtccgtttgagtttattttttacatggttggttcctatgagttcctaagtgtgaaaaagtatcaaaaaaataaaataaaaataaaaaagttgcacatctctctcctctgcactagttcggagagaggagaggagaggaaaaattctacatgtcacatgttacgtctatttgagttcaatttttctatggttggttcttgtgtgtccctaagcgtgaaaaaaatatcaaacaaattaaacaaaaattaaaaattttgggggggggggggg

SEQ ID NO: 30960 - DNA, 3321 bp, Oryza sativa
  unsure (1)..(3321): unsure at all n locations
ccctagccacctcagcatcgcgccgcaaagtcggcagggggacggcgccaaagaggctggcgctgtcgtgttgaacgacggcgctagccactctggcgcccctaaaaaggataatttttgggataagtttttctaggggtctagttacganataagttttttcaaaagaaccaaattgtgaaaaatccagggtagctagggtggtacttgtcgttgaccttgacataatttggaattattgggcctttaatagatgtcacaagtacatgtgtgcaaccttgttgtgcatcataacagcagcagagatcgtgacagctcaagttaaccgcatgccccctttcagctttacaattaaatctgagggtccctttgaatcacaggaataagaaaacggaggaataggaaaaatataggattctgacaggaatgtaaatgtaaaatagaggattacaaaacacaggaaaaacataggaatgaccgtttgattggaccacaggaaaaacacaagaatttgaggagagataaagacttaaaggatttcttccacgaggttctacctcttgttaaaattcctccaaaacttatatatgaagaggcattctataggaatttcataggattccatagggttcattcctttgattcaaagggatttgtaggaaaaattcctatagaaatgaaatcttctaaaattcctatgaatttcctttgaatcaaaaggggcctgaaggtttttaccattcctgtagttatgcatgctgcacacctaatccctgttattccagatcagatcagggtgaagttttggtgatcgatccaggaatttttttggatcaatatgattaacaaacagaagatatatgagctatttgattcgaatgattacatttgatcctacatgcccatttttcttttggcttgcgcaatagaatgtaatagtcccatgatgtatcgaccgtctcctttggagtttggaacaaggaattttgcagaaattaaacaagtttttgtaaaattgctgcgttccaaaagaactattgttttgaacagctcaaaccacagcctattcacaggaaaatacagcaagggcttgttcggttttgaacggctcaaaccacacagcctaaggcttgttcggttaatccatataaggaagacattagaggggaattaacttcacatgtggaattaatccctttcaaccttttgaaccttttgggaggaattaagaagggattagaggagattgaaggagatctattccacaccttccccaaattctcctcaatccttaggtgaggaattaacggaacaaggtctaaagcagatgcacatgttactgcagttgaaaaaaaatctaaccctcctacagttccagttgcagtcagcttactgtcacactatgcaaaatggtaaaaggctgttactgtctgaagctgttttcttcctacgatgtcctggtccaaggaatggcatgtgaaaatgaagtgttgagaaaaagatgaaagcatcggccctgaaaagcatacagatgctacagctaaaataaaaatcatatgtgaattgaatcatattagtgtgttgtcaaccacaaatctatgatgaactatgcatgcaatcttcatgaatggtatgtttattgcctttttccctgatgggtaatctaagggtgaaagcatggtgtaacataaagcagtcaaggtacaattttttataacatcagagctgcaatgctctaccaaaataaatcgaccagtctaaaggttgtgatttgtgacaagtcggtccatctgcattattgttgttgtagagtagaaaaatatacaaaaagaaaaaaaaacgtgctaaaatatatttataggattaaaaggacatctagtcatgatcctgaatgagttgtttgctagccctagaaattcctcccagaaacatataattaattataacaaatcgctcactaattcgtttcagtgatagacaggcttgagtatttcgccaaatgatatgattgccctatcaatcacaaccccacaagtagtcgtaaagttcaacagaaagttgtttttgatttcttgatttcgacgccttagggtgacaacatagaaaacacaatatatatatttttgtttccataataaaaaaaagtcttacagttacatgtacagcatagtttatatagacagggtcacataacataacataataggcaataatctaccaatacaatttacatcatgaacgtagcaaagacggaattaattagtatttaagcacaaatgattccgagcaagatgcaacgagttaagctaggctattggtacaccatacacaggtagaaaaaagtgtacaacgatcaacaacataaaaaaaaaagaaagaaattatatcgcccaatgatgaagtacgagagggacatttcaaccaaaagtatgatgttgcatgtaacaaccaatagaaatggacctaggtttttcggtattgcacaaggcaggcaggcagcagggggcgtgtgcccacaccaaaggtaccaacctgaacttgcagacaagcgaaagattccaatacgcataaaaaagttgctttcaaacaaatctgtaaaatcattcaccccttgaaacttttgcaatgcagaaagcaaagaattattgatggggagttcacattattcaatctccatctttacatttttcctttgacaccatcgtacaaaagtcgggcatacttggttgttctgagacgacatgatagctgctaactatttttagcatgttgttgagatgtatcactatgcctttgaatctaaaacagaaggaagttggctgacatctagaacatatatactgtacataccatatggaattggcaacatagaactgtatcaagaaatgattaatctatctgtattgctgtctattattagggttccattttattacgatgtggtactgattaggagggaaaagactttatttagatttagggacacaagaatgagagcacaagctacactgagcttgccaaataacaaaaggttatttgagacactgacaatgaaacaagctgcaaaccacagaacagaacacaaggcaaacatggaaatctcagtttataagcatatgccactggcaaaattgacttgttgctccaactccatatcgtactataattcgctcgcaccttgttttcctcttctggaaaggagagcatctgtagcccctggttagaaaaactcaacaaagcgttcatagggcatactccctccgtttcacaatgtaagtcattctagcatttcccacattcatattgatgttaatgaatcta

SEQ ID NO: 30961 - DNA, 4552 bp, Oryza sativa
tcaatatgaatgtgggaaatgctagaatgacttatattgtgaaacggaggaagtataaactaaattatataggatacatgagttgtgctggaaaattctactctttgctcaacctttcaagcaagattaattgtgagtcatctgctagaatctgcttcctctggtatcactgtcaaagacacagttacattgttcgcccttttaacaagaactttaaatggcactccaaccttgtcccccatgatatcaatgatctggaataaatattttatttataaatatggtttaacatgctcttggctcttggattgaagacaggacaatataattactaggttcctaaaggaatactgtaagtgatacactagttagcttagttacctctttgatgctctcaaccagtttaccatcaaattcaacgaccacatccccaggacgaaatcctgcatgttcagctggtgatcctggtgtaacctggttgacactcatatggtgtcagcagtgccaactactattatgatcataataaaaatagacgcatgctaaacatgtgacaccagatttgcagttgagttaaacagtcatagactccagccaatatccaaaggccattgcactgtgatgattaaaactgaacagtaaaattcaattcaaacaaggtgattagatccactctacccagctgcaagaagattcatcagacatgatgaattaagcatcacttaccattggaacaagcacaccattttttacatctggaaaagaacttgatctttctttaagttgtgcaatgatcattgggttaaggtcaagcatctttaaaccaagccatggtcttacaactctcctgcattgcatgttggagaagtataagtagcagctaagcatattacaagctaaaccagaacaactaagctaagtgttcattacaaaagcaaagccatgtctgatttcaagtaattgttcactattgaatgaggtttcattacttctcttcgcacaagagaaaccaacaggaactagaagatttaatcatgataaaataaatgtgacgataatacatatattacagaactttactgttgtaagcatgttgaaactattttgaaagaacacacccattttaccccatttgactcttatgagcccccaaactacaaaagcataggcctcaccagtgttttcctctctctctctctgtttctcttatatgcaactgccagcagctgagcgccgctcccttcccaataccctcactgtcaaagttactacacgagcaaccttgtcactgtcttattttcaaatatgcatcttctcgtaattttatctccccaactatcctcaataatcctgctgggtctaagcagtgctctcattcctcacatcttaagccatggaggcaaggtggagcagtggccaagatcaaacgaattgataagatgcaaagttggctggttggaaaagtcttgctgtcttgaagaatggtacaaaagttcacatactcatcaagagtgaattcatatcattttaaacacagcgaaggaaaacaggtgaaatggaaaaccacatgtatgctaccagagaattgaaatgggtgagaatcgccttcctattcacagtcacctactcctagtcctcatctagccactgatacggattgtttggggaattcgaactaaatataccagcccatcccggaaaattggtcatgatttaacccgtgctaaacaagacttgagtgggatcaatgactgctatggtgaggaactcaataacatggtagctaattcaacagctttatggctgtgtaaggcaccgaaataaggtcagtgaccacaactgcttgaagcggcggtgatcagcatgaaactattagtgagggcttccatgtgtgcattagtatgccaactgtgaccatgtgcacactaatatgcacatgaaaaggacaagtagggtttgtttttgccaagatatagttactacattaggacgtgacgactcgaaatttcgaatgccatgtcaatcaaaaccacactagtcttgagagtaaagggtttactgattttgataatcaagagggtgaaacttagacggtcatgtagttgaagggttgaagttggattcttctggtaattgagggtgtatactagatatatacctatttcaaaattgacagaaatattacaagctgatttgaaagtatgatactatgatgctagatgtcctcataattcattcttgtacaagagtgcaatgcatgtggaatttatgtcacaaaaaaaagaaaactattcataaaagtcaatgcataaagacagactaaccaccaaacggtttcttgtattttatttctcccacagaacaagttggaaacaatgagggcattccatttaattctcacatttatagaagtacctaagtgggtaaactacaggctttaatcactaaaaaaacctcaacctgaactgaacaaatatatttcaaaagaaaagacgaaatacacaggaatggtatctaggaataaatagtacaatgcaactggcatcatacaacttagaaggaaggcatacccatttttcttgaagttctccactattttcacaatagagtcaatcggtactgcaaagctcaaaccatcagctgcccaaactttcatcacattaactccgacaatttcaccgtcaagattcacaagtggaccaccagagtttccctgtgtccaataaatgcgtgaactatttgacatagagaaattgagaaactagaacaggaactagggaaaaaaatatatcctagaagtcggtacatgtgagcccaatcatccataggacagagtacagaaccaacaaaaaataactccaacagacacaaaggagtttatgttcctccaaacaagtataacaagaaagcaagaaaattaaaaggaaaatgggatggttgacagcacaatgtactatatttttagttgggtaagccctgataagaaggggaaaagtaattcacaattttccgattacccccttctgcaattactagaattgcgatcctgaatcaaattgtatatgcttcagtagaattgaactctaggatcaaagcgtagaatcttagacctattccaaagtggcatgagagtccgtttgatcaccgtggcacctaatttgattcatttatcgtttatcttagcaccataatactgtattcctcttaataacataataccgtggaatacatgcattattgactgattttttttcagcaatgtgcagtacattccatgggttaatggtaagcatgtttattagatcatttacacataatttggttggtaaatatactccctccgtcccaaaataagttcatctttgcctccacttgtttgtcccagaataggttcatttttaagcaatcattacattgtagtttgtgaaagtagggggacaaatgcgttggaagtaagtgggggacaattccatcgggatttagttggagggtattctagtcctcttgcttttgtattggtatgtatgtgatgggtgaaaaatgaactaattttgggacggaggtagtattatttagcaactaggtcacattctgatatcatttgaacaattctacgcctagaatagcaattttaatgatcttgacattttatgtgacaaactaaactaaatatatgtaatccatttttactttttcatccttcaggattccaaatttaaagagaaaatctaattcatcaaataataacttcaaagtaatcaacgtagaagttctaattctttccaaacctgagaaagaccacacaagccaactcccagaatggtacaatcttatacgatcctacacgactagtgatcctatgactgggattacaagcattcgtggatgagctgtagctcagtggtagatcacccagtagaggtctcggtgggcttcgtacccacttccctgcacaaggtttcgggggccccttctttaaagccaactcaagggggacatacttgccccttcattgagtttttttaggattgcgagacttccagatatgattcttgatatgattttagttgtttggttgggtggaatcgtagaaatcaccctataactagaatcgtgattttaacaaccaattgttaccacccagtgagatgatataccaatggtaaccactcactgaacaaacagagtacataaaggagataacacctatgagtaccactcactgaacaacagaacagagtagctgagaactgtgtggtgttacgttaattgttttatcagtgggtttgaaccacaaaactactttgacatatgcttattagatatattaaaatttttctgcatttattgtgatggtttggtgacagggagtagtacaatggcataaacattagtataaaacaatctagtgtactcataaaagcaatgacttaggggtataatgtaaagggtcttgccttattgatagcacaatctgtttgcaaatactcccttcttattcctccaagacctaggtcactgcttttccggtcaacacaactacaagagaatg

SEQ ID NO: 30962 - DNA, 1110 bp, Oryza sativa
atttggccacctttccggccagagccaactcggcctgctgtttgttgccccagaggaggacaacatggagacgatcgtcgcgcatgatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaatagaaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttct

SEQ ID NO: 30963 - DNA, 29169 bp, Oryza sativa
  unsure (1)..(29169): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcaactgttggcaggtaaagatttatctaggtcaatgtaatatgctcctcttcctttcgatcataaaataattgatctatatatttctatttagattgatgttttgttatgttccagtgtcaagacaattcgaacatgctatcctcaaaccccaaatggcactggtccagttactaatagatctgccaagctagatatgctttttgctaacaaggtaattacttttaatatttccattactcaaacaccactttgttactgatcactgagttctagtaattcctgtagtaatcttccctgaacaatgtattcttgcacagtagcaataattattgagcataatacaactaccaaaagatttatggaaattaagagtctaatgaggatttagaaaaaaacctagtgggttaactccattacaacacactggtccttacatgtgagacatctcagttccttgattgggggttcagagtctgattatatggtgcaggaaattctggaaacccaattgccatcttgacctatggttattctgtttgcactagattgcatgaataaaatcatgacacggtcgatattttgctttatctgatgtgttttgaggaaaaaaaaaactttatattctatatatatgtgcatgcatattcattatttcatttcagtatttttaggggggaaatatttcattattttttcgatgtaggtccagatgaaatgatggataaacataggaagtaataataagatattaattaacttggctcaaatgaataatattccttgttaacaaggttatttctttgttccatttttgttgtggccgacatatgtgctacactttttgtcattgatttcttgttggattaatatattttccccttgttggcagctgcatgcttttgttgagtacgatactgtagaggatgctgagaaagcggtatggaccattacatgatgcattgtaatattttcatgaacatggtaatcactgttgcacatgcatcatctctgatattttcttcatcctatgcagatcgtggaacttaatgatgagaggaactggagaaatgggctgagagttcgattattgaatacttgcatggtaaccattggattagtcaattgcacatgagagttcagtactttggtgcttaagtgcatatgcaaatgtcatgttaatgcgcacttgttatgtatgtgttgctttacctgtctgagagaactttagttggttttgccgtgtatgaatctgctttaatggcaagagaccatgattttaaatctaatccttattagaatggatcaaaccatgtggacggattcaatcgtatggcacttaacatccattggaacatctaataagagtatgaggtccattaatctatccagctttaaatacgcaagatttaggggattgcactagtgcactcataatagcgttacatttcagatttgctctcaagtatggcacaagtaaccttgaaaagaaatacacttcagttgttatgcccccaatttgcaggtgaccccactttgatcccaactctccacgaatattaataacagatcaaatatggggagttggtgaccctgtacctcatatattgtccaatatattatagacaggtctagagaatgcatttgcaagaatatagggaaagtttggtaccgtggtatataggttgacgtgtttcaactttcaacgtcataatcttaacttgttgctaatatgtgtgaacataaccagttactcaagaaattataaacatggcagcagatcaacagagaagtcatatttatctaaatagccatttgactaaaagatcacaagcagttcagtgccaaaataagcatgtttttatgttctcagcgtggacaattcatgttaattttctgtgagcgcaatttatgccatgttcagacttaattcgaacttcaagtaacaagtatcccccttctatttgggttattttctatcagtaatatgtatacaacaattggcataatcatcatcatcagtttagtgtatgccatcaatccttcctttcttttgtttgtgttcactgcaacaattatatagtgtaatcaatttgcgcagtgctatcttaatttatttgcgcagtgctatccttaaattggttgcatagctcaaaatgattatgtagtttaatgcatgccataaatgcttctttaatttgtttgcacaatgcaaaagaaaggaattctctttacctttatataatgttccttttttgtggtatagacaaagggaggcaaagggaaaaagggtggccatgatatcaatgatggacatggtgtagaggatgatgtctccacttctaaccaatcaaatgagaaacatggagaagaagcactgcaaacaccagatgcacagggagagcaattggtaagctctccattttactttgtataatcccttatttggaaacacaaaaaagaaacaaaacagtgctttactgctgtagagtttccaagtgtgcgtaaacttatttccaaatatgagcacaatttgtggcactggtgttaataagggtttcttagggcatgtaccatggtctttattagcggtctctctttattgttatgcaagcatatttggtgacgtggaagagagaggaagaagaaagagaaagatggttgctacgcatgacaacggcatagagtcgactcttagcatttattaggaaatttttcgttgtattgagtctaataaaggaaagatgactagtaagaaagtattttggtacattaatggttaaagaccgtattgtcttaactattgtaacgtgatagcctctaattaacgtagagaccatactgttctctactagttaggaatgttcgctgacatggaagagagaagcgaggagaggcaaacatcgttgctactgttaacaactgcttagcaacgactcttaacctatataaaatggaaactttgttgtatgagggtgtgaagaaggaaagaatagtaatatattttttttctggatcaatatggtttagagcatttgttgtctcacaccattgtaaaggtatagtctctaaataagcatgcgttatctaagtgtctatatgggctctacctttgaacatatagtgttttctttaagcagctcatgccaaaaacataactagttacatcacaatgaatggttctctctctctcatttgaaggttcatgattggttgtaaaaattttacctaatagttgggttgtgcatctaagcttgttaaagaaactatactcccaaagatctgaaaccaatttgtttctgtacagcctgatgagagcgctggggatatgggacgagggcgtggcaaaggccgtggccgtggaggtaaaggccgagggcgtggctaccactaccacaacaacaatcaacagagctaccacaaccatcagcagcataatcatcagaatagcaacaaccggaacgccgcccatccagttggaacgccgccatccaaccatcctgccaagaacgagcagcaacagcaggcacagccacagccacagccacagcacagccacagccaccagcaggagcaaacaagcagcctccagggccacgcatgcctgacggaacacgcgggttcgccatgggcagagggaagccgcaaacatctacgacgacacccagcgcatcatccggtagcgaaccttgaaactcgaaacacgcaatgttgctgttggtcatgttgatagaaagagatgcggttgagagacttgtcttttttacaagtctgtccttggaagcgtgcctccttttgttgtttgttctatatatacacgtttttctgccgtgtgctgttgttgtgtagtactacttctgaaacaggtagagcacacaccgtttgtgtgactcggtgtgagtgagtgacctgagtgtgctccctgtcactttgcagctctgtttttttttttttaccatttttgccgccctgactgtaagattgtagtagtaaaagttgattccagaaagataggggaggagaacatagtaaaatgtgatgatgtttcttgtactgtgttgtgttgtcctctgtttttgttgctcaactggatgttttggtgtatcatgcttgtaccttactttgaaagcgatataattgaagttcccgtaaataacgacgtagtatcaccttaatatggtttgattaaattgtgaaatagaatgtgcaagaacaaattataggaatgttgagaagcaaatgctagaaattttggaagtatgttattcagagcatgtttggttggttactgaacaggcatatgatcatgacctggcaatataacaatttagtattgaattagatagtacaacatttctccaaattcatattactaggctgtgtctataatcttgtacagggttactatattttgggacggtggtacatgatatgtaggaaagactaccaatgaagcaaagcatccttgtaacaaattgtgtcacgcctaaagccttgtggtgtgtccttagaattacgtagacaaccaaacaaaacacacccccttaagatcgccctttctagattccatgatcagaaaaacaaaattaattattgatgttactatatcacactagaaatttcaatgcacgaagaattttacatataccagaacacacaagatcaatcatgtgaaattacaaagccaagagtacgtgcacaaagtgcacacgttacaaagactaaaaaactacggcttggccgccgccgccgccgccgcggcgagcgggtggaccttgacgacgccgccgctcttgccggcgtccggcgccgccgccgcgtcgtcctcgtcgaccaaggtgagcaggcgcgtcatctcggcgaaccaccacctccgctcgaactcgtagcccagcgccgcctccaggccgatgtcgccgtagcggctcacgtcgacggcgccgcccttgccgtagccggcgccgtagctgtagccgtcccaaaccctcgccgccaggtgaagccccacctgctcgtccacccaccgcctcttctccgccttgtctgggcggcggcgagccgccgccggcgccggcgccgacgacgacgacggtggccggaagcagcaggccagcttggacaagatcgccatgcgatcgaggcgaggcgcaagagcgagctagactgatcgatcgattggcaatggcgccgtgtcgatccctctatatgtagcgcgcgcgcgcgggctcgcaatccgagtcggagaggtagtacgtgacgatttgaaatcggagtcggagattttctttcccgcgtcgtcgactccgaattgagcaacgaaggctaagtacaagttgaatccacaatataagtgaatgtcatacagaaatacacaactttgcttttttttttctcgattttcccattgttcgctttgatcaacactaagaagtactcggatttggtttgatatcttctttgagagccacagggagtaacctaggctgagttcgtttcaacggttatgctcaaatgttcagcgctgccggtgcgtgaaactgagataatccacgattaattgagtattaattattataaaatttgaaaatggacttatttgattttcttctaaaagaactattgtatagaaaaattttacacgaaacacatcgttttgtaatttgagatgggtgatcacggagaatgaaatagtagtagctgtataatccttcatgttcatttagtcatgtcagctgtataattcacgcaacctgaacttgtataatcctgcaaaacgtaagcaagcaatgaacacgaaggattatatagatttggaccgcatgtgtgcgtaatatcctactcctgtatatggaatatggatgatcgaaataagctacaatgcatggggtcctaacgaggaatgctagtttctctgttcataatatcatactcctgtatgtgtcctgtatgtggaatgtttagattgtggatcattaacctcatcttgatgagtatgcaaccaacgcatgtaagttgatttatttcacctctgttcgtatggatcagtttcttttatccaacataatttagttgtcattgcattctttggcacaagcattgaaacatcatgacttggtttgcctgatttttacgatttgcaacactgcaaccatggaaaacaattcaatataaaccagctttcatgctggtaactattaatacctctgttagtttgttctacaatttggtcttggattctaaattctgagacttactaaaaaatactcagttatctctttagaatagacatattatctctttagggcactactgtgttctgccttttcaaattgagcgtctaaatagaagaaattgtgcctatgtaccttttctatatattcgatgaaataagttttgatagcaaaaaaaaaaatatgcttgcggttctacataaatagcgatatggctgaaatgagacatttctaattccagattatgcaccattttgatagtgctttcagtttatctatttgaaaagctcttagatatgtgatttagtcacccgataagcttgcgactttgcagtcactgctgattggttcttttcatgtgtgctttctctcatcagtcattgttcttgccgtagtttccagataattagaacttttcagaaaaagaaagcagtgatatccaacgtgttttataacacactacgatgtacttcctccgtttcacaatgtaagtcattctagcatttcccacattcatattaatgttaatatgtatagattcattaacatcaatatgaatgtgggaaatgctagaatgacttatattgtgaaacggagggagtacatgcatctttcattttgtgttttgtgattcttacgacgagtgtccagaggtagatcattcaatcgacttgaaatgcacttacctggcaaaatatgttcactgctgggtatttttactctcattctctttcatcatttcgtatggggaggtatggtgaaggcgagaagcctataatgaagtatgcctgcttcaccttgtctttgctggtatataatggcccatttttctgattcctggttaatatcaaagttcttctcatcaagcaaaatgattccctaacctccacaagcaaaattgtttgtaatgcctttaagaagagaagaaactaccaaaatgattccctaaccttttccagtgtctataagcaaaattgtttgcagtgcctttaagacgcgcgcgaagaaactgttttgagcatgttgctacatcaatagtacaatcgtcacctatagatgcctcacataaagtcattgtggctcacaaatttgcatccaaaacatgaattgagattcttttaaattggaagctcgtcactgagggttaggatcaggattgtctactactccaagtgatctgtacaatagatgatcagctcttttttttttttaacttcgcaacaggtgatagattcgataaccattggaaatatttagaaacgtgtagttgaactggaagaatatttgtggcattatagccacctaacctttttcttaatgaattattccaataattttttattgagtaatctgcccttataggaagaaatttgtactctggccatttaagctcctataaagcatgaacattattgcataagcagggagacattcttccagagtataagcttctatccttatttgtggatccaaataattatgctacctagttgaaattgtatgttcatcgagtgaaaactttcaagctgaaattgtttcgttcgtttttctcctttaagatgtgtattacatgtgcaatttttattaaggtgttacagtacttgtgcttaactgttctgtttattcaacagcagcgttacaacatactccatacaaatgtaataactcgcagcattttttatatcaataatggaaaattttagtattgatgtaaccacactcatgaggcacgccaatgccgcgccccgtaatctagtgcctgtttaccagccaccacaagtagtgatgatacaatgttgaaaaaagaagtctgcaagtattataagttcaatacacatggtacgtagcacatataattgagttgtaaagtcatcaacaacaagccccttattacaaatattaagtcttcggaccattggaccttatgtccacagcacaatcacaaaaataacaggatacatgccacacgtactagtagtatggtctgacaatcagaccatattgaggagatcagagttaaaagttttacccaaccaaaatctgagctccaagactggccattcaccaagcaacttagttattgccggcaataaaactgatagcaaacaaattccaatagctagccatagtaatcgtggggctaatacggtgtataaaccagttgcaaatgccacattagttgccatgtatgcaaaccacatgagcttcttagtgaaggacctataatgaagcaagaaatgaagatcctcccaccttgctatgatgcaaatgaaggcgatagcaagtgaggaaaacattgccaatgtgtttgcgatcaagaatgacaaatgcaaattttcttgccaatgggaaatcccaagtttccagcatcgctgctataccctccaggtaaggtgaaagcagcaacaaatgtaattgtagcaatgattattgcaactaaagaagtgttgctcgtatatgtctgagtcagtgacttagcatctttcattgataatttatttaatttgtccttggccatcttatgaagaatataaacggacattgcactttggggatcaactttgaataaaagcatcaacacttcattctgcatatattaaaagagaggaacaaatgactaaatgtgattggtgtaacataataggaaagccttgatatctgtgcctttcgagtataagtatcagcaaaacatgaaacacctttgtaatttttctatgggaaaagtgggcttgtaaagtcatttagaactcaacacgtggtgcaaagaaaaacctatttgtatgcacctacaaatagagtgccatgcatagctaatttgtgaccataggtattatgggacacccttggctctcagtgaagcctcgagagcaggaaatcatggatctttgggtgatgggattgggcttattgagatgctgataattgcatggcttggcaaatgcccatccaatggcttggttcgaggacttttcaggtgtcatgggtaaccctgtattggctttggaagaccttgtcacgaacatctctttattgtcatatatcttgcaaacacaggctagatgattgaaataagtttgtgtcatgggctcatggggtaaatcccacatcttctataggggttatctaatttgtccaaaaaaaaaagcattgtccatggtcatgcatcaaagtaaggtggttcctccggtgacgcatagtcttgtttgcaaaggtttcgaaaagttatgtgttaggtattaggtaatatctatctatctattatatactaaaagtccattaagcatcctataaacgttccgaagccgccacgtggcgcttctacaagcgttcctagaccgccatgtggcattctacaatcccaccatctattttcatttaaattggtggacccattattttacaccgtcggattagatctatttaaaaagtttatgctttctatatccgagcaatttaccggaaatactatatacatcaaaataattacgtactatggaaatacttacatatgtgtacgtatgaaagtacttacatacgtatatgaatatttaggtactgtaaattaaaaaaacaaacaaagaacgtacgtgtgtacgataaaaaaaaacctaaaaaaactgcaattttgtcatgatgtaattaggacccaaaaacttatattttcttcgtatcatgcatgagatgaatatgtttaaaatgcctcttgcgtctctatatgcgactgtgatcctatattttaattaaattataatgctgaattttagttattggtactaattggctataccttaaagttaatttctaccacaagtccctaggtggtctgattttaaaacacttttttttgttccaaaattcctgttagaaatacaagatacatctttatttggttcgaaaattcatatgcatgaagtttatattactaaactttgatttcagaaaaaaagaaagtgagttcaaatagatcatcttgttttatgtgtttctgtttgtgatgtgtagataataacactcctattattgagttgttagtggcactatagttacattcggtggttactgaaaatctgttctaaatatcattgtccagcatctctattatgttttctcgatgattctgacattttgagctaataaaataagaaatatcgctaagtacagttctttgaatagttcagattaaactggttcttttgtttaggaacttttgagatcaatccaaatatcagactgggagcacttgctaattctaatcacattgtctgttcagttctcacctgacactacgcttttcttcttggttaaactaatctgtcctctacttttgttcccttattagttattacacatgcaagcaactgcagcagcaagagtaagagccgattatccgggcaaaagctatagaagacaagggagcttgcaggaagacaagaaaaaatgctacatgagaggacaaggtttgagagagcaacattattggtcccatcgtttcgattatttgtggaataagccaaatggtatatttgcaaacgaaaaataatttgcgaataaaatttttatatatgtgttactagcgatctaaaaataaaggataaaaactaaacttcgataataaaaccctaaaatcagctccaactttaaggttgaaaatttaaattttggttgataagctaagtataagtgaaaattcaattttttttccagaattctcatagcttgaagaattgcaatgagggaatgaatgagcaagtggaaaatgaggtctgttgttttatgatgttgttagccttttcaaaatgtgatcaaacgtatcacttagttacaatatctgtcacatgtgattcagttcctttggcttaatttcagctgttgtatatatgttcattttctccaacaatctcccaaatattatctttgcagtgaattgatgtataaaagtgatcgctgaactgctggtgtatacataaatcttgatggaggaaacaagtcaacaaccatgaatctaggttcttgtcattaactacacatctatctatctatctatctatctattaattaattttaattatatactaaaagtctattaaacttcctacaaacgctctcaaaccgccacgtggaatttctataattgctcctaagctgccacgtggcgcaacaaaagaaggcgaggacccacatctgcagcgcatgtatctgtggataaaacagatcgatctctaccattagatctaaacaaattcccaaaacaaaagaaattctgaaatcccctccgagaccccacacatacacatgcgacattgcgacatacggacgccgcttttattctccagcttttttttcctacggtaattaaaagatacccctatttggtaacaaagttttgatctaacaaaaaaaaaaccgaaatcctttccatgggctcccgcatgcatgtacgcatgcatgccttttcttccctgcttttttttttctattgcagttaaaaaatatttactgcacttttatttatggtaaaagaatttctgcatgttccatattgatgtctcacacacaaattgttcttcgtgggttttataaacaaataagcaaagtttaaatgattataaattatatacccaatatatgatcggtttaaaccattgtatattttaagcaaattaataatttatgattcattcatattgactattttcaatgctaaaaatttattacatgttggaaccacctatcatcttgaggcctcaaccgagttaaaggaaatcttaaaaatctcattgaaatcaaatgccaaaccttaattatttttgtcacttacggttagacatctaataggttttttacgaacataattattttatctctaaatgtgtgggggaaactataacctatacgcatggatcatcatgcttttataaataagcaatcataaaatgatcatagcatctaatacaatacgtgaagtctctaataattagaggggaaaaatcttagaatgatctcattttttttacatcataacgtgttccttatcaggagcctatttttcatagacaacaaatttaaaatacaattatggacatttggcatcatgatgggtcgtaggaagcacgtgtgtttcaagaagggattatggtagtgaaacagctatgtggtgccattagtgatcacttaaatttttgtatataccatacgatacttcagaatatgaatatgtgataggagattccggtttggttttaatttattactacctcagttctcaaacagatgcagctaaacctcggaatattaaatcattagcaaataaaaaatagggtttgatatggaaaaaatgatattaacagaatgttactacctccgttctcatatatgtgttatcctagaaagcgtgcagtaaaatatcaaaatcttcattaataaaaatatattatgcttatatggaaaaataatattgataatttttttatgaaaaatgcttttatacagttatatttttattgtttttgaaatatatagctaaaaaataaatgatgtaattaataatggaacatgtatattggagactattgttgtccaaaacagagaacagagaaagtaaaagacagttcatataatatttttggctcaattttggtggtagggttaggacgtctttagcctctactgagttgtacactcaacacaattttgttttcttcccaaattttagagatcaaaagcatttcaaggatgattgatataacataaatctccaatattccatacgagatggaaaggaaaactggaatttcaataaaaattgggctaaacttaaacaaattttgttgaatccaaaggccgatataaattgcagaaatagaaaaaaacacttctgcaggaacaatgtaattggaatatgtgatttttgtaaagaaaatcttacaaaatattgtatttcaaatatttttggttaaatttcaacaactcttctaaaagaactatgtggatttcttaaagtatagatgtccaaaacgaagatttgctaagtattccaataaaaacacatattgtaaaaatattagttcataggagttaactctattgttgtggcacaatattttcctataattcaagatttcacggttttaagtaattttagtttagaatttatatgttgcgagggtaattagaagaaaatcataaccaacattcaaaatagtcacaaatgatttattgggaaaaaggttgataacggaatacaaatgttttagaaaaaatgactcatatttttcaagcaacattaaataaaatgctcgcgcatatgcgcgggcttgcttcctagttacctttaaagaaaaatcttcggtgtgggttccaaactgacagtagtttcaacaaatatatataaagagtgaatttcagaaaaccccatgttttgaggccaatgtaacacataactacatgttctatttattttctcatataacccagtgcattcaatccaattaacacagtaccataggtttaagtgtgggaaagtgttacaatggcaagtgacatggcagacctactccacatcagctggccccacctgccagatcaatgcgtgggctatttagggcgggatcatgcggaagaacagaactgcacgttccctgttgccacgcacacacggccggcgacggcattccccaaccatctctcgcatgatggcctccggtgatgatcgtgctattgacctagctggaggaagagtagaggaagagaactcgttggctaccaagattagggagatggatagaatcaacaatattcctagcagttaacatccatccattttcttaagatgatcatctgaatcgactccaaagtatgctggttggtgattcgcaaggacacactgcttcatagttgatgaggaattaaatctagctttttgatcatgtttgtcttgtcaagaaattagggctaataaaatgtgaagaacatgtgaagaactcaggttttatataccattctctggcatacaggtgcattctcacaaagcgaccatcctatttttcccaagcagtcacttaagcaagaacgatcaacagtacaagtatcataacattggacaccaacaaaatttgttgttttatctgtagtgatagcgccatcctttcaaattgatcgctccttttcgtctccactctccagagcctgcaacatggtgatgtccttgttcctctctccgtcagctatcatcctctccttgtgcagttcataccattgattcacttaagcttcatttcgatttcttgcacagtcaacagcgtgtcgttcaatctcaattgtgttgagatctcttgcagccactgcccacaaaatcacattcatcgtcatcctgcaacaagaaaaaaaatgccaactgaaacataaataagaaaaactagtgagaaagaaattgagtcagcaatccaactcatatggggcacccaatggattgtctcccagcatctgaaccttcccaggccatccttctcactggctcaacataattgaaatatcatgcaattttattttgcattgacaaaaatcgcaaattcccaagttactgaaaccctacaaacataaattgattaaaattgcagaaaagcagagttggagatgcttgcctttgcctgtgcacgacgacctgcccctctgaacttgtaagaggacgatttggtggaacactgccgcagtgagcatgaggaagacgaggggtgcatcgtcgcgtgcgtgggaacagaggatgggtgcttccgttctcccgcgtgatcccgccctaaatagcccacgcattgatctggcgggtggggctagctgatatggagcaggtctgccatgtcacttgccattgttgcactttcccacacttaaacctgtggtattgtgttaattggattgattgcactgggttatgtgagaaaataaatagaacctgtggttatgtgttacattggcctcaaaacatgggtttttttgaaatttactcatatataaatgatgtgggaagttataaatcctactccaaattgctattatttaaccatgacaacttgattttaagcaaatttaagaacagagaatactgcaaaacaatctactcaaatttgtgatgtacgaccattttaaaattttatttgcaggttgaaatgacctattgctactgtaacgccccaggtagccacgtacctagagtgccacactaaaaaaacattcaaaaccactaactcccgaaattattagaaatttcggcagagtctctcctaaaaatacggacatccacgacacgtagttataagatagatcaataaagaattaaccaaccattgctaaccatcctagctccataaattccacgtgaaaataaagactagaactttaaatgaccgttacaagttctacgcaaaacttatgctaaacagaaacatagtctaaaactaaatttcaatagtgtgcaataataatgtgtagttcaagagtgctactcctgtcccatgccgatcaatatcattaggtacctaaaaaccaaattaaacacaagagtgagtaaagaatactcagcgagtacaatattgaactagtaaaacatacacaggtttaatgcaataagaaaaccaatatgaaacatttgacttcctttaatttaaaacgaaagaggcaaaaagtagtagttctctccgggcaggtgtgaatatcctcttagcattaccggtaagccgagcaagcgtgatcatcgcttctcaaggatcatgaataaagatccaaattgcactcccatgactacgcatggtacttgaataatgtaaacaaaaatttccggaagaatgaaacatgaataacgtcgtgaacttgaacatgaagtgaaatatgaatatgtagcataataccaaaaccacataattgataatacgaagcttcgaataataattgggtaaatgaaaccaacaaagcaacacggtttatccatcacacaagtccatcttgtacttgccttaacttcttcgataatccaactcaactcctccaacgttggaaccctccacacctgtggagaaaaactacgcataaaccactatatctaatgatagttacaagggacatttactaaaatcgaaacctagaatatataaaaaattttaccgatttatattaaataacctatagctgttcccttactgttttatgcgtaactcacaaaccgtctaacgaaatctatcaaataatataacttcggacatctatacaaaattgtctacaactttcatgttgggcgaaaattccgattatgcctctgcaaatcccagattaaggaaaacgaattgctgtcctgatttccggatccggtcagcagtactgtttctgttgtttctcctaaaccatttatcggaatcaagggaaaccagcggcgttagaaagatatcgacaatggctacaaactttatttagaacaactaacctgaatcccgacggtttaatatcagatttgaaaatacggtttcagcctataatcaataacctcgaaaattgcacaaacgactatcgaataaatttctatttgaatcaaatacttctagagagtagccaaaagtaccgctgcagtgtggatactagaatctgagaacaaacctgctagttgcaaaatcaccgaaatccccaaattccttcttcctcctgctctcctgcgcccttctcctccctaacagcagcagtcagcagcagtcgtcatcagcagaagcagtcagcaccagcagcgatatgaagagaccagatcgcagcacatcaaggcatcaagccatgcattagcagcagcggcaattaaaagatcggatcggcagcagcaacaacaggaatttggcagcagtagctcagcaagaggcagccgagcagggaatcgattggcggcggcggacgacgacggctgtggcgacgccgtcaccagcagcggcggtgcagaggcagggttggggaggacgacgggctagggctagctgctggtgtccttttcttcttgttttttttttcgttggttaaatagagagccgagagcctaatcaatatcgaacgacccatattaatttgatcacctggatttcgttcggactccgattacaataaatttatagtctattttgcactactcggcgagctctacgcattcacggttcctgattgcctattcgaataacagtttaaaagttaaaattttgcgcgtttgttctaatattctccgaaatatactaattcgaaattcggggtattacagctaccccatgaagtcacgagcctccataatttattagcttgaatatcagatactggaattgaaaaattaccagaaaatttcgtttaatggtcaatatagggagttcttaaatgggtatcatagtagtgcaaagcacgactacatggctagtatttctcgaatgggtctaacgaattaactgacgaaatagggtggtatctaagccttggtggttccaaaaggttgattaatgataatttaactaatgactaggaaattttaacgaaacagattttcttctaaaatttccttttgaaactttgctaaaactcttacgaggcttgctatagctgaagtaattgcattttccatcatgtctttcactaaacctcctttcaactatataaaaccaaatatatgttcctatcagccaaacacgttaacaataacaagaagagaaaattccatgtgtacccctgaaagttcgctcaatcccttctatacccctgagattttctcattcccttccatacccctaaatttcagtttggatcttttctataccccttccatcagttgaccgttaaattcatatcataaagtccattttaacatttggtataaaaaaatataaatttatgaattatattgatggagtttataaatttattgtataagtttattttgtgagatattacttaacaaaaataatttttatctcgcataacaagatttatcttataaaaaattttgtactactataacaaaatatgctatatatacagtttttaatggtaattttttttgttttatctaaaataaattttgtcatagataaaaattatttttgttttcccttcacgaggtaaaactaaaatattacttttgttaaaaatatctcacaaaataaactcataaatgtaatagtcgcatacaataaatttacacaccccatcaatatacttcataaatttatattttttttataccaaagggttgtcatagataaaaattatttttgttttctcttcgcgaggcaaaactaaaatattacatttgttagataatatctcacaaaataaactcatacatataatagtcgcatacaataaatttatacacttcatcaatatacttcataaatttatattttcttgatagtaaagggcaaaatggactttatgatagaaatttaacggtcaactaatgaaggggtatagaagggatccaatttgaaatttagaggtatgaaagggaataagcaaatctcaggggcatagaagggattgggtgaagtttcaagagtacacaggaaattttctctaacaggaaggttaacaatagttcattaaaatggacttgatgtacgtacaagcaaggtttaagttggatgaacgcaggttatgtttcactcataatcccaaaattaggaacataatatcaacatctaagcatcacaacacgttacatgtgcatattgctttgagaactaaagagaacagaaaatatccagcaccaaacatgtcaaactagctaggaatgccaatatctacccatgcctacctccctcggtgtgcccacgggcatgcctgtttaccagccaccacaagtagtgagacaatgttgaaaaaagaagtctgcaagcattataagttcaatacacatgtacgtagcatatataattgagttgtaaagtcatcaacaacaagcccctaattacaaatattaagtcttcggaccattggaccttacatccacaacacatcacaaatataacaggatgccacactagtggtatggtctgacaatcagaccatatcaaggagatcagagttataagttttacccaaccgaaatctgagcttcaagactggccattcaccaataaccttagttattgccggcaataaaactgatagcaaacaaattccaatagccagccatagcaatcgtggggctaatacggtgtataaaccagttgcaaatgccacagtagttgccatgtatgcaaaccacatgagcttcttagtgaaggacctataatgaagcaagaactgaagatcctcccaccttgctatgatgcaaatgaaggcgacaacaagtgaggaacacattgccaatgtgtctgcaatcaagaatgactgaaatacgaattttcttgccatgatgggaaatcccaagtttccagcatcgctgctataccctccaggtaaggtgaatgcagcagcaaatgtaattgtagcaatcagtattgcaactaaagaagtgttgcttgtatatgtctgagttagtgacttagcatctttcattgatgatttatttaatttgtccttggcatccttatgaagattataaatggatgttgcgttttggggatcagcttccaacataagcattgacacttcattctgcattgattaaaagagaggtacaaatgactaaatgtgattggtataacataataaaaagccttgatatcctacctttcgggtataagtattagcaaaacatgaaacacctttgtaatttttctttgggaaaagtgagcttgtaaagtcgtttagaactcaacacgtggtgcaaagaaaaacctatttatatgcacctacaaatagcgcactatgcatagctaatttgcgaccataggtattatgggacacctttgcgaccataggtattatgggacacctttggctcttagtaaagcctcgagagccgaaaatcatgaatctttgggtgatgggattgggcttattgggatgctgttagcatggcttggccaatgcccgtccaatggcttggtcggaggacttttcaggtgtcatgggtaacccctgtattggctttagaagaccttgtcacgaacgtctctttattgtcgtatatcttgcaaacacgggttacatgattgaaataagttagtgtcatggggtacatcccatatcctctataggggttatctaatttaaccaaacaaccatcgcccatggtcatgcatgaaagtaaggtggttcctcctgtgatgcatagtcttgtttgcaaaggttttgaaaagttatgtgttaggtaatatttatagaaatagcttatggcttagatcgataacttgatagtcaaatacatgtacgtgcaacttgacatatctgtgggcaccatagatgggcttcctgatggaaatgttgtgttgccatgcctgacggtggtggacttttggagcatgttaaactgatgcagctctgggagactgggagccagtaattctagtaggatctttttttttttttgcggggaattctagtaggatctagaagcgtaacaacgaacaaatgactctaaatacgacttaggttaatacgtgagttgttgcaatacaacttagaatatgtcgatatgaaaagttgacagagcacgtacacatatagcagtttcaaaatcatttcaaataatagatttgcagaacaatataatctctcttaaaattaagcttgtataatatgcactgttccatagcttgtttagtacaaaagtagtcaatctacatctcatcaaaatccaggatggtcaacagaatccaggaacgtgaaaaaagaacaaaggaaaactagagttttatcttagccccgtgctgttggatgtggttttgggtgtgagatgtgcagattctattagccaatgttcggtagaggttatgagctgagctaatcagctagtgaaacaaggcaggttattaatgcatgattaattaattaagtattacaaatctgaaaaaaagatttagtgttttttgaaaaaaaaaacttctataaagaaagccttttaaaaatcagtagcagttcagcaaaatgtgtttattgaaaatggtaaagtagttcagcttacaagccaaaacaaatagtgacttgtatgcatacatacacgcacatgtacaaatggtgacttatatgcatacatacacgcacatgtgcagttatgcttactgagaattccttgtatacgccaagtcgaccattagatctttttacttgtacataagtgccagctaaaaagaataattgataacaaatttagaaacagaaaattgaattttgattatattcggaacaaatttaaagggtaatttctttttttttcctctccgatggatatctctttaaatttgcttcaagttgataaaaaatatattttggtttataagggaggaaaatagaaaaaaatggtgatttgtataatctctctctatgaaacttgagcaaatttggttgcaattatttgaaaattttatattttggtcttcaaaattagtcaaacaattttgtcccttaaaattttttataagtgaaaatttcaatttcatatataattaggagtttgtaggaagctagcacttgcggcgataaaaacatgatggtctaagttataggttatatatggtaaattaatggaataggtgtagaagagataaaaattcggtggtacatacagtggatatggcaaactcgagggcataaaacgaattttatgtaagaactcgacaggagaagagaagcatacgaaaatgtctctactaactatgcactcatcaacaaggaaaaacaaaatttagtacgcaaaaaggggtggtggattatattaactaggaagaaagcccgcgcagatgcgcgggaatcttgttaattgtttttgtaaaaagaatatgaaaaaagtcaccgttaccatttctacttaaatgattggaacatttctcaaatttaaataaaaacactttcaccaagtaacatatagatcactactactaattatgttttaaaagctaatatagatgaaactgcatatgcaccaataaaataagcataatacatcattaatacactataatatctactacctgggtttcatgtctcacttatttctaaattcacatataaatatggtaaaaataccgttacttctatccattaatgggatagcgcaattaaaattaaacataaatgctactctaatggataaaaccaatcgtagctgctaagactttctttctccgttgccttgaaatatgggtcatgcattgatatagccgtgttcctcaagatcagcttggagcacaattttaatctctaattcatgatcgcatgctcatgaagtattgcatggaaaagtacgaagttgagtacaattagtcagtggcggacccaggattttgctaagcccggggccaaatcttattgccaccgcacacaatgatacaataatagatgctacattgctagtttgctactaatactaatgcacgatcaaaatgtatggtacaaatttagttgcggtgcgaaaaagaagtacaaatacattttcaaataccttgctacgtgttatcttcctcggagtctatatcatcctcattgaattcttcaattgtagctccagatcttgatcctattggaaaaagaatcacatattacatccatggattgagaaaatgagaatcaaagttaacagtacacaaatttcagaacaagaataagacataccactagggagaggtagcttcatctttctggttctcaattcttgaaaatgagttaatatcttatcattatcaatgcttgcaaatatgtctctctcaatatagcagaccacgcgatgattgagccattcatcagccattttattccgcaactcagttttgatgatattcatagctgaaaaagccctttcaactgttgctgttgccaccggcaaaatcaaagccaattcaatgagccgataaaccaaaggaaaaactgtatgtctatcactctgaaccatcttcattgcaagattaccaaggtcactgcaacttaggaaatgtgggtctgctctcacatcagctataaatgtctcaagttggtcctttaggactatgcaatcatatggagagaagtcggcagcatacattctagcaagctcaattaacttatcttcatcaaaattggcaaaagaattcctaggatcaagacaagcaatgcatctcaataactgggtagatctctcagcaaaccgattgtttaactccacaataagctggtcatgtaccacattaaagatttcattattgaaatgatgttggtaagttatcaattgacctccacgaccccttgaacgacccctagtagtagttgtatctgacatatctggcacaatgatgttatacttgagacaaaatgtctttgtctcttcaaagagttcttgccaaccatgctgccttatgtggttaattttttgcaatgtggtcccaatcaatcctatagcacgaataatattttggtctttcttttgcaagcattgtgacagatcattagttttacccaatagtctaatcattaggtgcatgataagcacaaattcaaagctctccatctgttttagcaaacctgtagcagttatttttgtagtggggttatcctcacatatattttctaatacctctaggactgctttccacatgtgctgcaaacgacacaaggttttgtgatgtgaaccccaccgagtatccccaggtcttgcaaggttagttgcttggtttttccctcttcctgaaaatatctccccagtctctaaactactcacaagattatcatggtgttcttgggccagctgatcatgtctcttacaagaaccattgacagtgttaacaatcatgggggtatagttaaagaaatctgagacaggagaacaacattttgcaacagacacaaccactagctgcaactgatgggcaaaacaatgaatataaaaggcataggggttttcatccaatacccgtctttgcagcccatgaaattcacctctcatgtttgatgcgccatcatatccttgccctctcactttatgcatagataaaccatgactaacaatcatggcatccaaagctattttcagtgcaactgatgttgtatcaggaacatgttcaaccccaagaaatctctcaatcacctgccctttgctgttgatgtacctatgtgacataacatagaataataccattgttaatatggtcagtttcaaaatataagaacaaggaaaatgcaaaagacagcaactaacctcaaaataacagccatttgctctttaatagatgcatctcgagactcatcaacaagaatggcgaaatttctctcaccaatatcctttagaatggctttagttgtcttatttgcacaagccttgcacaaatgcttttgtatttttggtgaagtcaatagatgattcccaggagaatttccaagtaatttttgggcatctttatccttctccttgtaccattctatcatctctagaaagttccccttattgctagatccatgagattcatcatgaccacgaaaagcaagtgcttgcaataaaagaaatctcacaacacccaatatcatagttatacgaccataatattgttgctctaacttcttagatccactatccatcttatatgatacactttgcctttgatttttgaaatcctcacaatgttttctagctctattatgaaaactatctactttaccaacatgttcattaaaagatccagttgcatgtttccaattagtaaagcccttacttgtgaaagcatcaacaccaaaattatcaggtcttggttgcttgaaaagataacaataaaaacagaatgctgcatctttggcaatactatactccaaccaattatgcattttgaaccacgagtcatgaaagcttctttgtcgatttcccattaacttctgtggatatttatgaccaattggttggcatggacctcttgacaagtattcccttctaacagcatctctaatgtctatatgaaattgctcaattggttttctaagcccaggatcagcaactatgtcagccggattaagctcaactgtctctgaattgtgaggttcttgttctggttgtggaatattactccccactgtctcaacaatactaggggctgcctcacaagtactaggggcatgttgaacttgaatgttactagctctagctccagtttctcctatggctgcctcaacaacagctgctgcttgctgagtattactacctccggttcccgctgtttgtggaggatttgggtctaaattggattggggtgttgctggggcataaaaagatttcaatgtagtcctaggcctcttcatcttctgatctctattgcaagttaaataaattgattggaatcaatagatctatagacactgcagtattttaggcacttagccacttaggcatttgagaaaagaagtaaagaacaaattgacagaagaaaatagagatggaaaacttacccccgtacttgctgctccgctcatgagcacaaagccgcgccttggcccttggcccttgggggttgtcggctcgttgccgaccgccggtcccagtgatggcgcactggtgctgtccgcctgtccgccagggagccggatgaggagaggagttgaggctgaggagtgaggaggcagcaaggcagaggcaggtagggagcgaccgagcgagccgaggagacggcgtgccaggcgggcggcggcgccggcgtgctgtcgtgctgggtaggaccgtaggagcgagcctcgagcaagaaggcgtcgcgccacgccgccgctctcccatctctgtctctcgcttctaaggaactgaggaggggagttagggttaggttgatttagtgggccttgggccaaaatttcagaggtatatctaggtggggggtccattactacacggcccacgacctggtccgcggcccaggttgccccaggcctgggtccacccctgagagacgctaaaactttactgatctgaattcagaacgtgacacacctaaaggagcaggactctcacatatcagttggattttatgtagcagacgatagcctagaaaactttgagctgaaatgagcatttcaggtagtgaattgcaacctgcactattgaagtattgagactaaggaatgttgacctgtttcacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatgatgtataaaatgagcattataaaagcaaacagagtctgcattagttaaacagatcgagattatggttggaacaacagatacctattagtgttatcttacatttgaacccaatatcttggaagcaaggcagtaacatgagctatatatgcacagcagagagacaattaagaaggatttgagcaaatttccatagagcagaaaatgattcactcgttgcaacaatttgtctcaaggacatgaatataagaatgttagatctctatcataccttgggtacaatctggtcagaaatctgcatactataaagacatttgcccacttaaattaaataaataccttcagatattaggagaaaaacaattgtgtatgcagaagtataaaattgtgctaaaagcagcaaataccacccataagaacgtaccagcaaatcgcatcatatcatcaaccaaaaaatattgttcttcttaccactttcttaccggataactgaaacatttggtccacatctaagatcagatatgccataggccaggcctggtgactacatggtgcagtactttacaaaataatatcattgatcttgcattggccaccgatgagcaagaagaaaaaggcaagattgggatccatggtgcatggtgatgccgcagacgaacattggagagagagaggtaaggactcaaggtccttgaagtactccattatcatgtcttggcaataaatctgatgatagaggtcagagaagagtggcatcgagtgaggggggttaaaagaagataaagtgcaggagcgtcgagttgaatgctccttccatttgtagaagtggaggaggcagggcatgcgccatcagtttcacgcgagggagatggaatggggaaggtgaaacgaattagcgaaagattgggtggaagcgaggaagggaaacagccctgacggtcagggggagggtgggtgggtggggagggggggtgggtcatggggagggatgggggaagcgctacgcggcgacgatgctgggcccgcggctggctcgcgctaggaatgagaggagacgcgatcgtggccggctagcgggcccacgctggcgcgcgtgatgggggagaccaggagaggaagcgagggtgtcggcggagggccgcgtctggcacacgcgcgatggggagaggaagcagcgcgcgatggaggaggcgaagcgggacgcggcgtgaatgcggtggaggggcggcggcgcgagatgcgggagaggagcgatgcgcgcgtggggccggcgaagccgagatgcgggagaggagaggaggggagcgatgcggggaggggaggggagcgatgcgggatgcgcgtggggccggcgccgcagcgagatgcgggaggggagaggagaggagcgatgcggaggaagggctcgatgcgaatctaacggtggggacaaaaaggggtgacgtggaagcaccaggaagcagagaattgtagtagtggggatgatttgtataggtatataggatttgtttgagattaagattctcaaagcattttttggatattttcagaactatttgattggtatttaagaagtaggcagcatacatgatacatagatatgaaaaaaaatatcaacaatatttccagccaatgattttgctacaatccatcaatagatttatggtcacatatttttgtctttgccatgattttgaacaatgaagtaacatgctaataaactactcatgtcatattttcttatacttaaggaatttcactatgtcaggcataattgatagatatatgccataaacttgattgacgtgactataagtgtactccaatggattagttagtatatataaatttgggaaaaataaatgcattcttcaaattagtaaaattgcctcatgtcactatgaacaataggagtggaaaacaaactaaacgctaaattatatatatttgtcaaaatataaacaataatatggtgttctcgatattatcaaggtgctatgtatctttagctataatttttttaagtatcatgaaatgattaacctcactcattttcaaaagagagtattttatctaaatgataaaatttgagtagtaatgatgaacaccaaaaacaaactgtgtgtacactgtaccacaaatgtacttaaaaacataaaaaaaaactatcttgatatactccatcttctcttgtcctattctaaagggcatcaagggaacatatgactaagttaaggtggccacggtatatgccaccatcactaattgcaggggcggacccaggcctggggcaacctgggccgcgaaccaggtcgtgggccgtgtagtaatggaccccccacctagatatacctctgaaattttggcccaaggcccactaaatcaacctaacccta

SEQ ID NO: 30964 - DNA, 837 bp, Oryza sativa
ttccgtttctgtcgtttgagtccgagtccgtctagaaaaattcccgtgctagatacccaaatcaatcaaccaaccaaaaacagcacgaaataccaaatttaatctagaatttgatccaaagaaacctaatcacccaatccgatccatctgagccaacataatacattaaacaatagaaaatgaatcataaatatacttaatcacgaaatcacaaatccaaaatcatcaaaaaaaaattaaataaaagaaactaaatcatcgacgccactgctcatgggagccaaggacgccgctgccttgaggccgtggtagcttggcggccgcgccaccgtgcatcgcgaggagggtgctatcaccggccgaggagaagacgccgtccgcagggaaaaggacaccacaggccgggagggggggcagtgtgagggcaccacagctgagatgccggctgccaagagaagcggcgtcgccggtggggggaggaggggaagcggcgccgccagttgggggagagggagtggcagcggcggagagggagggcgagctggctgaggggttggggaagcggtatcgctggcggtgaggagggggagcggtgccgcgccgctggttcggagtgagggaggggcagcggcaatgagggactgagggcgccgctggctggaggagaaggaagcgcaacggaggagaaaaggagataaggtgggcaggcggaggaaagaagtccgagagggaaaaaaaagaaggaaagagataaagtcaggcgaagaatcgagacgcgcgtgaccgcgtcttctctcggctccgcgtcagggagaaaaatgtacacgtataactgta

SEQ ID NO: 30965 - DNA, 9014 bp, Oryza sativa
  unsure (1)..(9014): unsure at all n locations
tggcccccgtccgcgtgcatgcgagcgactgccaccgcccccgcatgctgccgtgcgcgtgagatagagaggggaagagtgagacaggtagtgagagagataaaagagaggaatagtggaagacgatatgataggtgggtcctacatttttttataaatagaatactaactagagtgccacgcgtacgccacatagaccaaaactaccgcggattgggtcgaggggggtaattcgtccggtttgcatagttagggttgaagaatatccggttttgtggtttagggggtaattcagacgaccgtgatatttcagtggtggtaccttctatctagacattgacaaaaaattgtgttcacgcacaacatgaagaatattctcttaaagcgcttggatgatgaaagtatcataattttagttttccgtagctacgcacgggtattttttctagtatatatctttacctattataaaagtttaagatatttttgccaagaatttttcgtacgttgtccgattccctccccgtgatcttttttttgcgatttttccgtgttattttccagtccgactccctcccgttcccactcgtgtcgcaccacagcgccagtaccacataaggcggatgttgcacaaattcaaatatcgatacaaaatccaatcggacatagaatatagagaaaaagaaaatgaaacaagaagaataaaaaaactgcacaaataaaaaaatcgcacaaaaaaaaagcccacgaccggctcaaatcgatccaattttcttcattgagtacttcaatgcccatccccaaattgaagatgaatatacgaacaacaaacaataatccccatatccttatttcaacatatgaacaacacatacaaatcctcaagataaaaaaaagcatgaataaacatgaacaaatcacacgagtaattcattatcatcgccttcgtcactgcttctgcttctggtgtgggaggaagaacaggagggggtggcgtcaccatcgcacctcctagatcagcccatctctgacctccaacaccaatggatcggccaagccaccagaggaaagtagaagagaaagagaggagaagaagggcatttgtcgcacctgcagcccgctgtcaccgtcagctcgttaccatggaggtcgtcgccggttgatgccgtagccggcggcgggaggagtccggaagaccgagtcgccgtcgccgccgcctcgagtcgtcgtgcccttgccgggaagggtgagtgcaggaagaggaggagatggagcagaagaagacggatctgggacgccggaccaccgccgcctcccctcccgccagaagggagggcgccaccgcctgccaccacccatcagcatcgagccctcccgcggccccatggcgagggagagaaggcgagggacggagaggcgtcgctgcgcgaaaggagagccgcggacgccgaggagtagcttgccggtgctgctccccagctcgttgcgcaccgctgctcctgctctctactctctaggcatcattgccgcgggacggcgggtcgtgggtagagggagagaggaggcgtggagaactagagaggagaggagaggatgtgtggctggtgacaggagagagatggggaaagagagagagagtaaacgagagagggtggatagagataaggttctttgattagaaacattcacgatattttctcagtaaagtactgtaccagcttctgttttcttatactaaaatgaaatctacgacctagatatgctattcattgaattgaattccgctgaaaaattacagtgggttgagatacacatatatacttagtgttgttttctttaattattattttttactagtgaaaatactcgtgcgttataacgggtgaaaaaaatatttaatcataacatacgtttttcacgaataaccatgtcaataacaatatttgtatggatcgtttgtagctaagacaataagaaaattggaacatcttcaatgtaatctcgcatgtttttatttaatttttttacggacgatggaaatacattttttctcacgcattttttattttttacaaaagacagaaaacattattttaacgctttttctgacttttttctcacgcatttttaatcgtttttattttctcatgtttttttagttgtagaatgaaaacttctctttttaagtagttatattagattagaattagagaagagatatatactgtctactaaaacgaacagaaatcggacttcttttccatgctttttttccgctctttttattttttttcatgcgtgtttttttatttatacgagccattttttcaccactttcttaggaaatcggatgaacttttttttacatgttttttagattttttttatttttcgtcttttataggaatcagacatttttctatttttatgggaatcggatctagctttttttcactttttttcacctttataggaatcggattttttcacgttcggacctatggttttttttgcactttgtggaaaccgatttttttagttggttttcgctattttttccttttttagggggaatcggatctacggtttttttttcactttttagggtagtcggactttttttttttgctttttcactatttttttaatttgacggacgaaagaaacgttttgaaaatttttaaagtagtagagatgctgaccacaaaaatcaccaaacttttctattatattaaaattgaagatattttaccggtactttggtacgtcatccgtgtatgtgttggtttttacccgtattgaaaaatacagttcgttcgcttttagaaatccagatctatatttgagctatgttttaatttcgttcgcttttgaaaatacataaggagtcgtataaaaaatctcttgaaaaaaactcgcatgctaacttaacatgatttaatctcttgaaaagaaaaacttgcatactaacctgacatgattttctagaaaaatatatatccaagcgaattctcacagttaatgtataataagattaaaatagcattcaccagttgcaacgcacgggcatttatatatatatatatatatatatatatatatatatatatatatatatatatatatgatgtgcgccgcgttgtgtttcgctttttggcagttcgatcgatcttatctcgtttttcttctccgaatcatcttccacaatgcatgttggaccagacgcgccaagtcgatgaacgaacaactagcctgctagatcggtatatacacgtacatatatcactgtaggtgttggaatttgaatcatcatggcggcggccgacctcctaccggacgacgtgctggaggagatcctccgccgcctcgccccgtcgccgcgcagcctcgccgcgtgccgcgtcgtctgcaaggcctggcgcgccgccgtcgacacccggtgcccgcccccgcgcccggacctcctcccgctctccctcgccggcatcttcttctccggcttctacttcgcacatgagtacctaccggggttcttcgcacggcgggggcaccatcactgcgaccggatcttccccaagctcgactacctcgacgacgcacccatctncaagctggaagccatcgaccacttgaacggcctcctnctaatgcaagagtacatcgtcaaccccgccacgcggcggtgggcacggcttgccccgacgccggagtggagccccgcgggatcggactttgagccggtggtcaccgactcatgtcgcgaggagtacctcgtgtttgaccaacccgtctcgccgcactacgaggtgttctccatccccgagcttgtcttctgcagaggtgatgacaaagacaatgccgaatcggtggtaagacagcatgagtggccgccatcgccatttgtcgtgcaagtctattcgtcggcgacggggaggtgggagaaaaggtcgctcgtccggcgaggggaggccgccgggaccattgctgatgtgcactactcatcttggatggcaagtcaccacctctacggcgtttattggcggggtgcacttcacgttcagatgaaaaataacgatgttataaggtattagcttcctctccgttttatattatagatcatcgctttgacttttcttttcaagttaaacttattcaggtttgatcgaatttcttaacaagagagcaagcactcactcaagctcattaattatttgctcatcgtttttaaactcaaggaataaaaataaattaaataaaaacatacaatcagtttgagaaaacaaagagcaaattgatttatcttttgctttaagtaattattaattcttttcctatcatttgatttattgttaaatatattttatgtaggcatataattttacatatttcacaaaagtttttgaataagatgaacggtcaaacatgtactaaaaagtcaacggtgtcaaacatttcgaaacgggggaagtatttgctaatttgttggttttgcagaataaccttgttagatgacaagtatcaagtgatcaagtcaccaagcgatatcaatctaaacaatcatccttatatttaccttggaagatcaaagaagggggtatgctgtgcatcaattgatgacaaacaacatcagcgtcttcaggtttggctgctgcacgaagtactgcttggtggtggtcagatggagtggatgctgatacacgacgtcagtctcgagcagatcatggcagatttccgctggaatcctgaagctgttaagccatggatcaaacataatacgtaccgtggcgagaacaagaataatgaagaaatatcagaagatgaatctcctggttgggactctgaggatgatagcatcgttgtttatacggaagatatggtacgatgggacatgaatggatacacttatatccttggactccatccttttaaagagattatctttttatttaactcacatcaggatagagtatgggcttaccacttacacagctcaaaggttgaattcttgggtatgttatgggtaggcttttcagaggagatagggcgacgccttgttggattggagatttatcttaaaacattttgttactaatttataataatccattattagtatactcaagacggatcttcgtggtcatatggccatcttgtctccgtagtttctttcatccacaggtgtatgactggctatgggcttcgtgtacatggcgtcgttacatgggtagagacgatgatggtgttctttagaaaattggtccttaggatttttctttgcttcactggtgggccatctgataaatggtgaatggcttataaagattgtggttgcgttgacagatggtggcgtaggaacaaatctagttcgggattggagcacagcctctctaatgtttacttaggggttctatggatctattatttcggatgtacgaatattatgatcttcaaaagccactatacaattgtggtttgtctgaatttttcttggttctttgtttgtcctctcttccactcgtgacaggattggtgagaatctggaacaacatagggtggctacggttgtgatggattgttatgacctgagattggttgagatgaacagagagaaacagaggagaatagcgaaaacatagtaaatgagttgtttgatggtattttgtagaataaaactttatcagtggcaatattttagaacccacgctttgtcgatagcatggaatggattatctttaaactaaatgctttgttctaacctacgtataatgatttgcacatatacataaatctctaaaacatgaattcaagggtcaagcgatattttttcggtcagcaattggcctcgcgcatatattttgaatctccagcaacaatcaaatggccaacagtacaccatatcactaacatccaaattttcaaacacacgttactgaaattgatccaaacagttttggctatagacatcggctgtattcagccttgaaacctattccactacgacatatcactgcattgcagctcattccgcatcagattctaccatgtcgtcgttgctgtcctgttcagtaatgccctccctctccaattcatccataaggctcctacctacacaggccatgccgcgaccgccaccccttccacttccacgtggtctccctctcctccctctacccctgctcattgccttccttaccttttcgaagtttgcgggattttttgggcaggtagttgtgtaatggccatccctcagtccacaccagctgcacaccctagtacagagcttcttcccccttgcaccaagtgatacattctcttctggacctactgtccgctctttagtctttggtttgggtggtggttcttggcttatgacttcagctgatgtgcccgcaccattgttgcgtgcaacgatatcatccctacatgccacgctgtctggaagcatctcttttcctttcgcagcactttaagggcggccatggctatttcaaatgcaacccttgacttactacctaaccgtacaatagccattgcctcagctagcagtgtcttttgtcggtaactttcttccacactgtcaggtccagctgtaacacggtcacgcctgtcaaatgacatgtcacttctggctttcatcgtgtagcgtcagagcacatactgaggtggtatcttctcgacctgagcatggatgaatgtccgaagaaggtgcgtgcataataaacctaacacaaataagcaatttaccagcagaaacaaacaattcagcaagctaaatttgttattatgtatctcggactggaatcagaagagttttgttcttaccagtatgttcccactgcttgcactcacattcataacgacctttctgaacgtccgctaacactttaaattgtagttggcaccaatcatgcttctcagaatgctccatgtccacaacaatccacctgtttgtgttgccaatgtccatgtcgatcctgaaagctgtgcaatcatccaatgcctcctcgaacaacttgaacacagctcttgtgtacacccttgacatctgcaccacgaatgaccaccttgtctttgttatcggcatgccctgcatatgcgatggtattaaaaacaaagtggcccactagtcagcagggaatgcaaaaataggcaacgatatacataccaaacaagccctggtctcagcagcctccttcgcttcccgtgaaattatgatatcaagcatcctacgcgcaaaactgtgcagattggtttggtgatcgacgaaatttctcttagctagtttgttcacactctcactctgctgagtagatgtcatcctgccacagtagtccttcttgaagagcgctgggatccatctgtgccttatttcgtacaagttttgcagggtcacactatcctgcaaatcaaactcatcaatgaaccacgaccacgcattttcaaactcctgtggggtgtatgtctggttcacgcacaacaacaattccgattcaatgcgatcgtcccttgcatatagaatgttgagtgcctcagagtgattcttcagtatgagccacctgcacagcctatgtattgtcttcggaaagacatttgttatggccaccgcgatcacattgtcctggtctgcagatacacaagattagtgaatacttatcttatcagttcacaatgtgtttactgctgaaccatgagctattgttgacataaacattgaaggaattacttgcctgttagcacgcatctaggcgaggggcaatcctccatacagtttttgaacgttttgaatagccattcgaatgattctatcttcttgtctcgcagtagtgcacaaccaaacagagtgtcttgtatatggtggcttgctccaacgaacatcgccaaggacatcccatatatgttcgtcttgtatgtcgtgtccagagtgactgcatcaccaaagtccgcatactcggcctgactgctagcatggctccaaaaaatgttcttcaccacaccatcctcatcgagctgcatgtcccagtaaaatttagagttctgcatcttgcattcactgaagaaagcgaacagtttgttgatatcatccgccatctccgcgcgtttgttagcagccctcctgtgtaaataaatatcacagattcaatatgaaactgtagggggttactgatgcaccaacacaacatgcgaagtgacaaaaaaaaatattcagcacttcaacagcaccatataatacctgatttccacgtccggtgatgtgaatgggacattttcctgaccttcatgcatgttttgggtaacacgacactcttgcaccgtgtcagctctgttcctatgcacttcaacagcaccatataatacctgatttccacgtccggtgatgtgaatgggacattttcctgaccttcatgcatgttttgggtaacacgacactcttgcaccgtgtcagctctgttcctatgcgacctcatttgtttgacagctgatggcgatggcgatggcgtcaacgggtggttgtgccctataacgacgacgtcaaaaactacagatgacaatttgccgtcagttgtgacattcttgattttaacatatgctttccagccagtcctcttcgatgtccgtttcttctccctgttcgcctcatcgcccctgtatttgtgcctcccttcccttgcgcagcatatctcccgtatcgtccgcttcaatctgcttttcctgacatcaaaacctgcatggcatgcgtatttctcatagaaatcgtacgcgtgatcaaacgattcgaacaccatcccctccttcggcaccaagtcagaactaaccccaggtccctgccagtagtcaaatttttacaatcatgcatacggtgaaacttcacgctaacagactaaacaaaacaatgcttaattgctttcagtaaggccttgttcatttaatccctcacccaaggggattaaaaaagattcgaaggggattaatttcctaactaatcccctccaatcccttcctcatggggatggata

SEQ ID NO: 30966 - DNA, 350 bp, Oryza sativa
atgacagagggtattcacaatattggtctgcagcccaactagatcttatggatctataaccttctgtccaattgcattgaagaaggcacacagacgttggatcgtgtgacgcactttcggtggtagaatgcctctgatagcaactggcaagatttgtgtgattagcacgtggcagtcgtgagacttcattccaacaagttttagatcgtccaatttaacatacttacttatcctcgctgaatagcccgatggaactttaatatccttcaagcatgataacattgcgatcttctcatccttcgacagtgtgtggcaagctggagggatgtacactttacctgtctctgcat

SEQ ID NO: 30967 - DNA, 1112 bp, Oryza sativa
tatatatatatatatatatatatatatatatatatatatatatatatatatatatatatatatatatatatattttcgggaggcatctcgatttagacttaacgagcaacgcgggcaattacgtgagaagtactggtagcgttacagacatgcatgcaagtagtttttgctattaggttgtgcatatttttttttcttcttatgaaattttctcttaaattacttatccaatctataatccgattacatcgttgtgttcgttacaattaaatatttacaataaaatctcacatgattatattttgatgaaaaatcacaaattacttttatgatatgtctaaattacttttagattttactaagttactccttagacatacaaaagtaatttagacttttgtatgtctaagaagtaacttagtgaaatctaaaagtaatttgtgatttttcatcaaaatataattatgtgagatcttgttgtaaagatttaattgttatgaacataacggtgtaatcggatcgtagattggatgaatagtttaagagaaaattgcatttaaagtatgggactgcctatacatcatataacagattttctagcctcctatcatacagatttttgaagccatagaataaacatctaacagctaaatttaatctcatctatttaaatttaggagtacctatgatatgatgtcataatatttaacaaaaaaaaaagtcagcatgtatttacattgtaagttccaaaaattacatatgtaattttagtgtatttatgatgtaagtaataaaattacatatgtaattttagtatatttacgatgtaagtcacaaaattacatatgtaattttagtgtaattacgatgtaattagtaagtgtgggatcataaacaaagtagcaataaaaaacactgctcaaatgcgaggaaaaaaaacaggcgtgtgtttcgaaattgaaccgtaaatatgtgagacccacagaacacaacaacaaagtctagcaaaagcccaattcatctcaaagtccacaaccgtgcctgactttgctcaatccattgaatccaaatgcagcacgaattttaaacaaagatgaatggtaaaaaagtga

SEQ ID NO: 30968 - DNA, 522 bp, Oryza sativa
taggggataacttatatctatgaaatataacggatcatgacttaggtattacgtttccttatgtattatggaacggcctaaagtcctggtttgataatattgtaaagtagatttagaaaaccgataccatattggttaaggtttctatcttgtaatcctgacccccatcttatataaggtgggcaggaagccctctagagggcatgatacacaactagatcatcagatctataatacacccggcggattcaaatctccaaacaggagtagggtattacctcttatcgagagggcctgaacctgtctaaatccttgtctccgcatccatccactttcaggtcttgtgcgctaccccttttattattgccgaattcttgtttcgacaatataccatctccatctaattggaaatgccatgtatagtacatatataggatagctatacaatccacttacaaaagaggaaccgtacattctacctgatgacacaaaaagatggcaaatctacttatgcaaggagca

SEQ ID NO: 30969 - DNA, 757 bp, Oryza sativa
gaatttcttaacaagagagcaagcactcactcaagctcattaattatttgctcatcgtttttaaactcaaggaataaaaataaattaaataaaaacatacaatcagtttgagacatgcatagaattatatgcatagcgacgccaaaaaactcggatcgccacccatgccgtcggcacacgacctcttcatcaagaatctcatgcggcggggcgccggccacgacgacgccgtgccgtggttgcattaccctgccgtggacgacgccaacgctgacacggcgccgctgcctcccgagtactgcgccgctgcctcccaacaactgcgccgccttgctcagctccggcttctccgaccacctcccgccgcccgccgggagaccagagacccctgctccttctcccacggcactgtcgtcccgtccgcgtccgccgcctagcaggctcgcacaagcgccgacgccggcgtcacgaacttcacctttttctcgaggcctctgcagcggccctccgggcggcgagagcacgtcggcgaccatgtcggcggcgggcacctcgaccgtccccgtcgagtcgacggtggtgcagccggcgacgaaccggctaatggcgaggaggagtgagagagatgacgaagggagagaagaggggaaagagaggagagaaggctaacgtggataaccctgacatgtgggcccacgttggtcccatgctgacttagccgttacatagattaaaaccagggttaaaactaccaaag

SEQ ID NO: 30970 - DNA, 1095 bp, Oryza sativa
gagatagattaatctctatcggccgtaaacgttggcccgtcaacgatgactcattttccatctttcatttgttgtgagtgcaaaatatatagctgctgtgtaataattcattttattagtcataatacattttcggatagtaaatgatttcaaatggaaatatggtcaacaacaaagttgtagagcctttcaagatctactggttttattttggtcatttttctatataatttttttcccaacagcttgaaattgattttgacaatatgacaaatctaaacagcatttgtaaatactaaatgatttcaaatggaaatatggtcaaaaacaaagttgatcctctcatcaggatctacaacttttattttggtcatttgtaataaaacaaaattagccatattaatgactacacatatcaagtctttgcaataaaacaaaatacttcattcattacaatagataagtacaaatgcatcagtcacaaggttatgccttccgtatcatctgaacgagcatatgccacaggctcttggggatcatcgtcaaggtcaatgtgaggtcttacatgaagattatggttgtattcttcttcatcaacgacgttgtcaactcctacaattcggcgctttccatccctcactatgtgcatcttcttgtttgaagggtcttttatgtagaatatctgctcgacctgtttcgcaagtacaaatggttcatcggcgtatcccaccttagatagatctactaaagtgaaacctttcttgtcggctttgacaccagtgcgtagattaacccaacggcagcggaacaaaggaaccttgaacttgacgtagtttagctcccatatctcctcaatgcggccgtagtatgtgtttgacccaacttgatcctggaatgcatctatacggacactcctgttttgcactgtgcttttgtcatcttgtttgacggtctaaaatgtgtatccatttatattggatccttgccatgtgtctacggtccaagacggtcccatccccaacaactgtactgtctcatttgggacatccgtggacattgtcacacgattcttgaaccattcgttgaaccgagaat

SEQ ID NO: 30971 - DNA, 1264 bp, Oryza sativa
catccaagtccgcatattgcttgtggtacaatatgcagtcggtgggacaagcgtttattttacggacctctaaccccagtggacacagaacctgctttgcttcgtatgtcgtctcgggcaatgtgttctcaccagaaagcatagccttcaaaattcctaaaagatctgtgaaactcttgtctgtccatccactacttgccttcagcttcattaggtccaaggtaactgacaccttagtgtgttttgctttgcatccagcgtacaaaggcgtcttgtaatcacttaccaacctgctgaacttcattccatctctctcattctaggctaggtcctgaatgtcacgtaacatgtcttgcagcagatcgtgatccacatcaaccatttcaccgcccaatggagaatgtataaacatgtcatgctcatcttcatcttcctaattatgcgcaccacttctgtctgctgctgctccacttcctgattcttgctctccatgcttcacccaacatgtaaagccctccatgaatcctcgttatatcagatgactgtgtacgtcctctccgctatcaaacatattcccattcttgcaatctgcacatggacaacacatgtaatcactgtttcttcttatccgatcctcctccgcagcgttcataaaatttattacgccctttctgtactccgtagaacggcgtttcaaatttttcgcatacatccaacttcgatcaattgctacaaaataaaaaaacaaattagaggcacatattataagatcattattgcaaaagttagacgtgatgaaattgctcaattaatgattaatattactcacttgattgatccattttgatcacctacaggaatttaatttctgttttccttgaaaaaaggacaaaaaatctgcccctacagcctttcaccaaaatagtgaaacaatgggatacagttacactaggtggtggggggtatttatactgtgcaacaaatatctgtaacggccctaaaacaatcaaccgtgacgggcatacaagtaatctctatcgggctttaataaaaaggccgtcaaaaaagagtgtcatctgtgaccggcactaaacttatctcaatcgggcctctaattgggagcccgtcacagatgaccctcatctgtgacgggctttttttaggggcccgattgagatatggtaacccttatcttaatcaggcctcaactatagcccgtcacagataagtggcatccgtgacgggcttttagttttatgccgat

SEQ ID NO: 30972 - DNA, 584 bp, Oryza sativa
ttgcgccataggtctgcctcagggaaggggggatccaccccgttgactactccagccattgcctcccgtcggatctagccattgccaccgccgaccactcccgctaccgccacctctccaactcgatctggccaggggggaccagatccgccatcgggcgaggcggatctacctccgacgtggctggatccgccgcgcttaccacctgaccactgcctcccgcgacctgccgctactgggattactcgtggggagagcgtcccgccaccaccgtccttgcggtcagcaacgtgacgaaggacgaacggtcaaacatatgctaaaaagtcaacggcgtcaaatatttcgggacggagcgagtatcatgttctacaaaatggcttagaggctattgttcgctaagagtactgctgcatgtattggttacttagataccggtcataaaattactgaacacataattattatatctctaaatacatgaattaaaaaattatcgtgaagaaaaactatttgcgtaactgctcctcgactcctcgtttgatagatccgcatatttcgcaaaaaatgaagaaaacatcccg

SEQ ID NO: 30973 - DNA, 1808 bp, Oryza sativa
agcaggaaggcacactcttccccttagagaattactctcgataaacccgaagcaaaggggagaggaaggggaggaaaggtgcaggcctcgcttctagctccaaggaagctagatctgggcaagggctaggaaaagactaagggcaaagaggtcaagaagaaatacatcgctccacaggagttccaactaggcatgccattggttggagatgacgtgcttgccgcaatgggcaccgcttgcaaggaccttcacttatactacatggagaaatctaacgccaggaagccaagtaaagttaccgatatccttggagagcacgatggaaagccattccttggtccaacaaattatatcgtggtcgacttcaaggatcttttcgacctctacaggctccgagcggtggacacaagcctccttaagtgctactccttgtaagtattgtcgcccaactcaatctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgcgcctataatcaatagtaagtgtgttaactaaatatacacaacagcatgacacattccttgagtacttaattaagtttcactatattaatgccgtagtgcccatggatccttctggtcataacacctaagtggagtacatgtcactacctgaactccagaattgataagaacgcatatgattggaccccaattaaactagcgatagatgaagcgtgggcccaatacgtgcaaagaggaggcctcaggaagacaggacatgacaccctcatccacaaaaaagacttcccggtgaagcaacaaataggtgaccagtgcggattctatgtgtgccacaacatgcgcctcctgtatagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggacgttgcgaggagatagctagcttcatcctctgcgaaataattaaccccaaaggaatgtttaggcttaaactaaaatgatgaacaatgttgaacttttatgtttaggcaatgatgaacacttgttatgcaactgtgatgatgtaactgtgatgtttatatttatgtatatatttcatatgtttatgttacgaacttgctaaataaatatttgatccaattaactcggttttgcaggtgaaacatgataaatatttgaatggatgtgaaatatgtgaatggatgtgaaatatgagatggctgtgaatgtgtggttgtgtgaaatatgttgatgtctatgtatgtgaatgcatatgtatatgaatgggtgatgctggggagctggggatattagatatctgtgtttgtttctgtcatttttgcagcgggcatggctagcaaaagcctaaggctagccaaaaaacaaaatttattttttttttgtattatagtcatctgtgacgggtcataactaaatgcctgattgagatgagatcatttgtgacgggctctagtttagccccgattgaggtcagtagtcatctttgacgggctatagtttaggcccgattgaaatgagtatcatctgtgacggggtc

SEQ ID NO: 30974 - DNA, 284 bp, Oryza sativa
atatccgatcgagattacgttcgtgtagtgtgacacgaagtccgtgtgtttggttaatgtgaaataggctgttttgaaaaaaaaaggaaaaagtacgaattactcccgaattattgcggtcgtccgaattacccccatgaaccacaaaaccagacattatttaaccccaactatgtaaaccggacgaattacctccctcgacctaatccgcggtagttttggtctacgaggcgtacgcgtggcagtccagtcagcattctatttattaaaaatgtaagacccac

SEQ ID NO: 30975 - DNA, 687 bp, Oryza sativa
ttttcttttcttcccaaactcattgcttatgtccttgaccatattgtggacctcatctctggacaaatctttggtagcaggctgaagttctctcttaccgttaaaaattttcttctttcttctaaatgcgtaacgtagcgggagccacctctggtgacccatgtataccatcttttgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcccgaccatatgcatcccatgtttccacactttctttccaacgaatctccagatcgtcaataacaggctctagaaatacatcgatatcattgccgggttgccttggaccttggattaacaagcacaacaaaatatatttccgtttaaagcataaccatagtgggaggttatagttcgcaataagaactggccaagtgctgtgagtactactcatgtcatcgaaaggattcatgccatccgtacacagacatatcctcatgtttctagggtcggcagcaaagtctttgtgttttcgatcgatattcctccattcaatcgaatccgctgggtgtctaagcataccgtcattccttctctccgtggcgtg

SEQ ID NO: 30976 - DNA, 704 bp, Oryza sativa
acatggtatatctatgcgtacgcgaatatttcctttgtgattaaaggaaacctttcgtgaaatcgattgatgaggagagtccttctcggacaagaattgggttacctacgtgtcgtgccaggtctagtatattcgagtcctactcggagagcatcagacctgcgatataaaagggaccccctggggaggccatggatcatcgaatctcagagccaacacaacccacacagcctacgaagccggagcctgcgaggagccaaatcgacgagagctagtcgaatcaactcgactacaatctcgccaaaccccccgagttccatcttttcctttgtaacctgtgttttccaccatataatcccatatcgtcgacaacaacgccaacaccagcttcagccaagtttttcctacttcaacaatgctggtatggactcaagtcggcgaaatcgtctacccggtttacaccacgatgccgatctcaaccggtcctccaatgactggaaacgagaacgccgtggctacgaaccaagacgcctccatgtcgaaaaatccacccgttgaaacggagaacggattgccgactacgtccaaactcgtgaaggattctgatgtggccaagctttgtccttctgacatgaatcgcgggccgataaggataacttccgaagctaccaggtcttggtgtcctatccacaaaaccaagaaac

SEQ ID NO: 30977 - DNA, 48384 bp, Oryza sativa
  unsure (1)..(48384): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtttgctcagggtccttgataaggattgaacccctgaaaacggaagtatgcttgaaggtcatcatgctattgctgcatcatgttgttgaagttggcgaactgagcatcagcagattgttgccattcttgcgtttgagctatgtgttccgtgaggttgtactggatctctctcgtctgcatatcaagggtgtccattctcctagtgatttcacccaagtcccaacgagaggaacttgagcgacattcacttggagatggaggcacaccacttgatctgggaggttgattgtccccccattggatgtcatgaggcgcatgccacaggtccacactggcacttacccaggttgagactctgatactgtgacgtggagcttgggtccatctgggtgcgtccccagttggctcccaacctacctcatacatctgcacggctgttgaggattatgaactttctcgttcgttccttgtcatgttgcacgtctccctgtatgctccacctgcatgagattcttttatgttctgcaggggaatggttagttcatggcagttgtacaaatgataccccgtatttggcaacgggatttcatttgtacaatcggggaataagtaaatcaaagatttatttactccatgtttcagaatgtgcccttgcactaaataagcctcatcaatacacggacaagcggctgagataaaagcaatttggtcgctaacgacccctagcccttttgctatccgagtaatcagagaagtgcactcaacaggagcagagaactttatactttctaaccattgccttatcatacatttcacaggagcaattttgatctttctaaccatggcaaatatgataatcaattcatctcccctaatgggcctcagatcacctctaggaaacaaggtcatagcaatccatttgtgcatgagcctaagtgtaggattatggatatcattcgttctagctttcttgcaaattggagcaccagaaatgtcttcccaaaacttatttttctcgaacccataaattcctttctggagatcgattttacaggaatcgtgaaaaccaagaagtgtacttaagcttttccatgtaagtgtgtactttttatggaaaaagcgaaaggaaattccatcttctatttctttcaaagtgcacagaaattgcaaagtaagcagacgagaaccaggctcatctaccacagcaaatctctgccaaccaacaactttccaaacagtacgaaattcaacatccatacctatctttttagcagctccggtgagtattcttgcgtgtgagcatactcccggtcgctcagcatgtagtaggcttgtctctcccgatcactgacaaagtcgaggtcggtgtcgtttaggagtcgttgcggagcttcagtgtcttccatcgagacatctgctgatgaacgagtactagactcgtcataacgacttgatgaagaaccggaccccttgaacagacgagacagtcgcctcctcattctgcacaacggagcaagaatggactaactcggcgggggttaggaatgacaagaatttcacccgccggttagtttcaccaaagcaacttgtatatatgcaactaagtgtttgaatttgagggaaactatcaaagcttgaatgaacttgagagcaaactttggagagggaatgaaaatgtgtcgaaatggggtggaattccctctctcggccggttggcttaagtagtgcacccaaaaaccgacctatggggcccactagcagttgcctcaaagaaggaggcagtcgaccgttggcctggctagttcggccgaacaagtgggttcggccgaacccacagtgggcccaagcggccccactttcggtcgttgggttccaacggtcagtgtggtcgtggcacagcgaattttcattgaaaattttattttggtttgctctgaaaaattcatttaaagaatttcctccaaattcaaaaatcctaaatgcaactttgaaattcaaacatgtgattatgcaaaaattcaaattgttgaaagcaaatatgcggatacataccaaattacctgttggcgaagatcacgtcatttaaagtccggcgtacaagactgtacctccatctagttcagttagtggattttccacccgtatcaggaggtgatggagcgggtgtctttggcttctccctccacaccttctttggttttggtgcagacggtggcttcttctaagccggcttctcttgcttcttagtcggtatgggtggttttaccggcgtcttccaataacggttcctgggcattgttgtgtccttctccaggaaattctgcatgaatttcaccaggctgtccgttttgggtggctccacttcgacctcttgaatattctgtcggttcggcccgtactttattctgaccatggagcattgttccgtcctcggttgaaactcaaaatatatggtgcaaacatcgtaacaaggtttacagtacatatttttcctcatgtgtcttggttcatctaacccatcgtgtgggtctaaaactaaaaaccgacacatataacaacttataagtgccgatctattaaaaaccgacactattagaaaaaccagaacttatatactagataaagtgtcgagccgaaccacatgcaaccgagctctcacccttatcctcttgtccccctcgcctgtctcctatcatcgctgtcacccctctctcgccatctctgtctccttggcacggcaagcggcagagctgcctcccttcacctaagccagcgaggggtagcctagaacccccaccagcctccaccagattcggttgttgcggatacttttctcgctagttgcgttgcctccacctcctcttaaccaagctagagagtgttggcctagatatccctgttagccttcgccagatccaatcaccatcgatggtggggaacgggacgctccaagcatcggctttagtttgaactgatgcatcgaactgagctaggtttatttctttcattcgtggaacctcaaaggtgtgccaattcctaaaccaacaccgaccttcttcccatcagtcctgctaatagggtcctggttgtgaaattcggcacctaagtaggattcccaaccagcagccatcgggtgagttacactgcaactacaatgtaattacattgtaactaacaatataagtacattataactatattgtaacctctatagaacttatttatgaagttacataaaattctttaatacttgtatatatacaggttatataaaagttataatgcaattacagtatagttacagtataattatattaccattataatataatagcatttgaaacatttccactaaaagacttgtggttgtttttttagatagtctcttcaaattattcgtggtaatctattgacaccaaatttaacttcaatatatggaaaaatttgctacaggacattgttcttcctatctttattcccattcttcttcctttcatcacagcaaagcggtgaacggctggtggcattagccggtccgcctcgaccaagacgtttagaaccaccagccagacaaaggcgggttgttgttggtattatgaaaaaagtgagttttgctgccgtggagctcacgccgctcgaagatgtctctgctttctctacaaagacgtcggtggctcgcctcgccttgcgtgacaccacgcaaaccaccccgaccatgtacaccagcagcgcgtcggcgacggagagcgtcacggctagcaacagcccgagccagctttgtcatctacccaccgttgcacaaaaaacgccccaccgtggccgaaccgtccaggctcgggccagccgccggcctcgatatggagcaaggacatgacgttctcctttggcaacatcctggcggcgatagagcacttcaacgacgcgtactgcatcggcaaggggagcttcgggactgtgtaccgcgccgacctcgacggcgggcgcgtcgtcgccgtgaagcggctcgacgcgtcggagaccggcgacgcgtgctgcggcagttgatgccggtgagcgtcatgacgtagaacgtcggcaccgaggggatgcggcgcatcagtgtgaacgagaagccggccgccgtgttgctgctgttgggcgcaccgagggccatgaaaagcgtcgcgttgctgtcgaacaagaagaacagagaaagagaggaagaagaatagagaaagagagattgacaagtgggcccatgggcaaacttgtctttaaccaaagtttctctctccgttttcatcaaaaataataaaatattgggaggagtgtccagcagctaattaccacttttttacagtgtccacgagcaaatacacgatcttcgagtgtctcacagtaaagaccacaatctttgagtgtcctgtagcaaattttgcctcaatatattcatggtagtatgtcacacctggagttttcccctttcccatagttccaattcaccaataaatcgtctaaagaaattactttggttaacaaggagaaaatcaaaattaacaatgtatttaacaacctgaattgtcagggagaattttttttgaattctctttgctttaaaatcactaacaggacttaaagaggaagttaaagagcatcggagttaatgtggttaattaaaaatttgtcaagttttgaagtaataatagtttttccccgcctttggtcgtgaatcgtgcccgattcactcccctctctgtccacggtttcgttttgcatggttcgccatgtccgttatcgttcgcgggaccgttttcgttcttttcctaaaacgacaccgcatttgttttcctttttgggaaagtcctaatcctattctccttctccaatttttttcctcccctccccctctcccactcggccgccgcccctccacctcggccgcgcgtgcctcccctctgccataccgagtcggtctcctctccctctcccctgccgactcccctcctctcccctccggccccacctattttatctccacccctatataagccaccataccccttcgtttttccctgttcttcattttgttggagtcctagctctagccgccagccacctcctgtagccgccgcctccccattgtcgccgtcgtcgcccttgcatcactggtaatccgtttcaccatctccgtgtcatggctatcgccattacctatccatttcttatttgttttcgtcgtaggttttgatccaacgtcgttgtcgccttcgcgtgttgccgttggaccatcgtcgtcgtttccttctcgccgatcgcctcagtttggtgaggaacctatccgtaattctctgttttaggtgttgtttctttttagcgtcattgtggaaaccgtagttgtttagcccgagccgccgctgccgtccgtgccctggcgctgtcgtcgccttgccgccgctgccgcgccacctcctgttgccacgccgccgccttagccgccgccgtcgctgccgctagccgatcccaagccgagccgagccgccgccgccgttgttctaggcgccgccgccactctcccgcgtcgccgtcgtagtttgccgttgtgtcgtagctcggtagccgaatagcaaagccttaggtgcagccctaaactcataccggcctatcgtttgccgtaccgagtctctaccgtaaactgtgtctagttttttgttgtcattccaagccgccgattccgttcgccggttcggttgaccgttgggatggccccatggcacgataagttgactcgttgagtcactaattcttgaggctttcttaccggaggtataattccattgatctatttatctatgggcaataatgtgtaataattgactaaggttttttcggttattagtaataacgcagctcatcttttaaaattcagaacttaataatccgagctccgttttaatccattcaaattgcagtgaatccgttaaaaagtatagaatccattaaaatttgtttattttgctatttcagtagacttattgcttgtatcacctgtgtgctttgtttgtcgtttagattccgtcagttccggtgatccagtttatttcgaagtggttgccgaggttcagtcagctcaagagcaaggcaagtcatacatacatcattgattatattgagcctattttacaaaatcccctgctttctattaaaattgcattgttttagaatgtcatgtggtatggatgccttttattctcagcctgatgaatatcttgtgcctttgataacttgggttatatttgatttattataatttagtccttaattactttatgtacaccaccatggttatggtttaattaaattaaaatttgctttaatggtgggtcgtgggtacatgcatgattttctggaagtcgtgcccatgacaattaaggaccggtttctcgggaatccctagaagatatactcgtactcaccacaggccagatgagctccaggctaaatctagagtataacttaaactagataacataccatggcaagggtagaggcgatggtgcagttcagacctggattttggtctctactatagccagatttacctaggcacgagaggggactgcccgacttcgaataaggagggggtgaaacctgaggtgcatatgttcggttagggagggttatatgacgggttttgtcacgatttccccctttgcagtatctcggtggtacttcggggcatggtaacatgtatggaatcgtgtctagtgggtaaagttgtgcacctctgatcagagtaaaactattcgaatagccgtgcccgcggttattgggcggtcaaccagctcaccgtgattagtcccactataacaatttgacttatagaactggtgtagtttaggtggttttggttggccctgttgcgacgtgatttagcgttggacagtgatgatgttaatactccttaattacttatattgtttttacttctttcaaatcatgctttataaatgctgattttactgcaaactatcctatgagccattcatttgaatatccttgcatcataccttccccttggtatggcttgttgagtacagtggttggtacttagtcttgctttttttcccccaccccaggagcagaagttggttcagatggtgagttctctgaggattgagcttgttctggacatcgaggattgtatggagaaagcttcgctttggtcgtgaagattaagtttatttctttagttctttagattaaataaaaaaatgagggttataaatttattttgttattttttaagtcgtggaactgtatcaaattgtcgtttgtgtaccctgactggtcttggatagggatttaatacacatcctgcttgagattcgggttgtcgaatttctgggcgtgacatagcataaactgatatatgcaattatgcattgaacatgcatgatacatataattatttactacgtacatacatatgtggcattagaatacacatattgaaattacgcagttgggtatgaaggctccatggcaagcccacacatgcccctcttgtcggaaatgtctttctccattctcaggaagccattctcaccccatgttgtgccccaggagttcttcagcaaccaatattgtgtgccatcaccgtccttgccatagccaatggctacaatcccatggtctaagtcagtgccgcatgagccggtcatcacgccaccagagtagaactggaatgtcatgtcgcctccatccacggcaacagaaacaggttggtttgccacggccttcatgagtgcggcctcattgttagctggcacatcctcgtagcccttgattgttgcggcgctgttggatccaccattgcacttgccgtctgccgctgtgtatgggtacttagactcagtggtgaggccaccattcttgatgatgaatttgaaggcatcatccatgagccctccctcgcagccctgatcctcgccatgaacatcgcagtcaacaagctcttgctcagagagggagataagcttgcccgtgctcaacttgacaataccctccatggctgccacggccgaaaatgcccagcaacaacctacaataattattcatgtttacactttcgattcaatacattttacagatgatttgtaaaatgttgcagtggcaaagtggcttgaattttcttaccacactggccttggtccttgatgggtgtgacagcgcccttggttctccagtccacggttgctggaagcgtgtcaatgctaacattctcatacctgaatgtggtaggaaccctaaccgtgctaggaatgaatcccttgttggtcttcgtcgcccggaactcatagttggtgaggtcagcgaactggttaacgccgagccaaaacttgtggttgcctgcattgaacgactcgatgaatgcgacgttggctttgaatatctcaaatcgacgtgccttctcagtagcatccttgtacacccgcccatactgttccatccacctctcgtgcctcgccaccatggctgcgtggtcgctctgctcgcgagctgctagaacagcgctgcagaggcagaggcagctgaggatggcaaagagcagagccttggggatggccatggttgatcagactttgtcagtggttgctcactactgcttctgatctgtactcgtttggttgatggctttgggttgtgaagtggatatagcatggcatgggttaatatactagcttaggagagcttagattaagtaattaatttgtacatcccgtgcttgtgtgatgttgtagacagggatgtctgcgtagcagagaagttactctgtatgtaagctcgtcagtgaacgtacgctagcttcgtagtaagataatgtacgctttgctcaccatgttcacacttactaattactgatgatctcgtcgagcaaatgctaatacaatgaaattctgaacatagatacagtaatgttagagctgtttcccttattttatatctgtactagatcctcatgcatgtgacttatttattttataacagttacagtattggtatgaaaccggattgcatatctgaaatgttgtgaaaagatttcatcttcatcatgattcgtaaaacaagagttcctcatgtctcatggtagtgtcttttgcaatttacatgttaatctttattcccattacttggagttaacattatttttagtacggatatttaattacctagtttatgttatttcctatttgggttctacagcttgaatttacaaaattttagagacaagtttcacttgatttggactttatttgaattacctatgagttttcaaattttaattcatatttctcttcacagaaataatctctcaagtcattttaaactaattttccgaaattacccttctgggagacgttagaatcactgacagcaggggtctacgggttaatattcctatttgaaattattttctctaaggaaaagggcatgtggtattgacatgtggggccggggttatagttgaccatgccatggtggccatagagaccacacgtcagtgacaccatatcttaaacaagattttaatcagtttcttccacgggtatgggcccacatgtcatcgactgattagagagggattcgaggagggcttattgttgtggattagggaaggtgggaccggggtagcgctactggagaaaccatctttggtcggttggccaaatttcacaatagtccgggttgtattaaacaccgggactaaagagcatttttagtcccggttcaaaagagggcaggtagtggacccctatattttctttagtttcggttgtccaaccgggactaaatatctatttgggttgtttcttttttttttgaaaatttgttattcggatctgagatgtatttgatttgtgtgtgatgtgaatacgtgatatatttgtgatgaattttgtagaacatgtgatgtaatttttttaagattttgtgatgtatttggagatgatcgatttgaggatttggaggtgataattgatttgagattttacgattcggggatgattgatttgggattcggggatggggtgaaatcaatatattaaaaacaatgaagaaaagaaaaaaaataaaggagcaaccagatctagcccggctccatctttaatcccggttggtggtaccaaccgggactaaaagggctccatctttagtcccggttggtgttaaaaatgaatttttactcctggttatttcaccctggactaaagatagcaatctttagtcccggattcatagtctcggttggaaaaccggaactacagggggttaccaaccgggagtaaaaaccacttctccatcagtgtaggcccacatgtcggtccaaggaaacgcaaaattttatcccctttctcttctttcattccagcgggcgatcgcgatggcaaagcgacctatagtagtgatgattctccagcggattggaggaggtgaggtggccggcgctgggagtgctcaccatgcagcggccgcatagcggaggaaccgggctcggggaagaagtggtagcatctggctccagcgtcaggcggcgccttctcctccaagaagagaaaaaccaagtagctagatttgtttgcaaaaattgtatttaatttgcgtttatgcatgaattatggaagtattatgtaagctactctatgtgtaatgtgtttgaatagttatgatatgaactttattgatgtgcggaatatatcatgtgcacacaagatttacacattgtgcataccaactaacaaatgtcacaataaaacttagaaaataatattgtactatgtacttacaataatattacacttatgtgtaatgttttcacccccaaattcattatattttacccataacgaaaaagaaaaaattctgacagttttgaagtacaaatatgtcataatttgatattttttgtctctccctatacaattaatttaaagatgatactttacacggaattgtgtaaattgcacccacgatacaacaacttggcaggtgggtgcgatatagtgcaagaacttgagaattgaacgtccgagtgcaacaacttgataagtatgtgtgttctagtataagaacttgacaatttagtattttggtgcatcaacttggctaagcatatgctatgtgagtttttttcacgatgtaaatatgccattacacagtattcctacagatattaccttataatattgaatttaatctttaagaattatactgcacacacaatttacatccaattacctttaagatttttttattttcttcaccttctcaaatatcaaccgaaatataataatttctacatccagtttaattgactttaagttattagtaattaggataaaaaaatataaatatgcttatacaaatccgcgctagtatattgtcaaaataagtacttaaaaaattgaatttatataaaaaaatgctccaaataattaagttgtcatgtactttcttaatttattgtatcaaaatcgtacctaccttacaggttgttgcatttatactaaattgcaccttcctgccaagttgttgtactagaacgctcatttctcaatttattgtaccaaattgcacccacctgctaagttgttgcaccgtgggtgcaatttactcttgtaataatattaatagaaaaattttaaatattttttggttggtatgtgcagtgtgtacacaaaaagacttgtgtgtgttagtatgtggatgtggatgttgtatgtggaatttttgtgatggtatgatttgtatgggaaattggtaggtcctgtaatttttttttcttgccagcatcttggtgcaggtttttattttttcaaaggaaggtgcgggttttaattacaaaccggcacgtatattctttgccacgtgtgtaggtcagtcaacaacctgcacctatatgctatttatgtacaggtgccggttgttttaaagaaccggcatctatatggatagcaacgtggcacgttagtttagaaccgacacctataatgccatatatgtgttagttcttacctaaaatccaacacctatatgtcttataggtgcctgttctacatccatattctaaactatagctggttcccaaccaaagtcatcagtgtgctaggtactggttgagaaatctggctcctatgactagttcccaagcaacacctaacatgttttctctagtattgtggtttgatttgattgactaatgttataattgcttgctatttaatcagtcactgaacctaatcagcaacagaaaaatcttcattcggctaattgctcaattaataaccgagttaaaccaactagccagtcgctcgtgcggtgcgactggatcaagtatacgactttgggttatttgccgtagctcaactccattaacttggaagaaaacggggagaaaataaaaccacttttaaggataatggttggggcatgtactgcaattttagggtcaacataccccactaccaatgttttctatcattacatagtgagagttaagattgtattcaaggtggcacaacggtctagtaatgtatttttgaagaatatggctaatgcaatgttagagaaatttgataaatattgggacagcacaaacaatatcatggttattgctacagtccttgatcaaaatgagatacattaaattgttcttcggaaaaaattatgactgcataagagctagcatacagcttgatgccatcactggtgagttggataagctatgaaagacattcgagaagatctatcgccagaaagtaggtgacaataacccacacgatgctcattcagcctcatcttggaaggatgcatgcaactctttggcttctattgttccaagtggattccagtcctctttgcaatctaatgctactgaatcttcaaagtatgaataactcatctatgttgatgaagcaactgtgcccatagataataatgcattcaacttacttggttattggaaggtaaatgctcataggtctcctgttttgtcgagtatggcaacgaatttcttttttttggctattcaagctagcagtgttttatcacagttcacttttagcactggacgtagagttatcgatgactatatgagttcaggcattggtttgtgctcaagttggataagagaccctcaaaatgagaatagttatccaaatacttgtggtttgtgtcgacgggtgatacccgtagaccggatatagagggtattggggtacgctggtacaaggatctacgtagtacgacatcgagcaatcaaaagacaagaattttactggttcaggccccttgataggtaatagccttaatccagttgacatgggattatatggtggaaaacacaggttacaaaggaaaagatggaactcggggggtttggcgagattgtagtcgagttgattcgactagctctcgtcgacttggctcctcgcaggctccggcttcgtaggctgtgtgggttgtgttggctctgagattcgatgatccatggcctccccggggggttccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccacgtacgcatagatatgccatgtcgttacgtgacgtacaccgaagggtagagggtatgcctgacccgtaaccctgacagtagcccccgacttctgctcaacaatgaactcgtacgaccattcgcgacttcaggtgtcgagaacgttgtcattccaggtgcgagaaccacggagatgatgtgtagtcgagcataccatttgaacccaacggtcacgagtgaattttgaactgaagtcaaaaaactgccacacgtaacggacctagaaatttccagcggggatttctctccgttccttggaattcgcaccatcgggagtgcggttatttaaagggattttgggtgcgcgttttgaagtccgcccactttgtcaagcacacactgctcattaacgctcctcgccttcttcgctgtcgcaaaaaaccctagcttcgtcagttttcgttcatctccggcgatcttccagcgacgatggatcttggcaagtcggcttccaccagcgcaaccctgaagaagctccaagaggatggcgcccttcctggccgtgaaaaggcagagagggaagcaggaggtactaatccacagcccctcttaggtcgcatggttgcgatcgaagactatgttgtctgcgggtttcttcctcccccctctgaattccttctgctagtctttaatttctatgggctttcacttctgcacttgaaccccaactccattgctttccttagtgtctttgtgcatctttatgaggcctacattggggtagagccctttcttgacctgttccgcttctactacgagttgcgctggatggaatccaatagggtgtctggatgcgtcgggttccgacttcgtgacggaatgaagtcgcggtatgtccccttccagtgtccctcttctcgcagtaaatggcggaacaggtggttttatcttgaggtcaaggattcggatccagtccttgttgttcccgaggagcaaccggacaaaattccggtttggaccgccaagccccctttgaccccctctctcgaatcgtttatcgacatcatcgatgatctccgagaacggggcttatcgggatatgaagtcgttgcagacttcgtcgggaggcgaatccagccgctccaggctcgggcccacccggcttataactattccggggcagatgacgcgacccgggtttctcctcggggtatccttctcgcattcattttgatatgcttgtactcacattccttttcgacttatcaaaaattgattctttcttgacaggtctgagcggcgaagtcgtgggacggcgcgtgagtcaagtaatgatcagcggcccgacaacagcgagcgacatccccgcgcccctttgtgaaagggaagcagcggagcgcgacgaggcaatcaatgtgagttcatttgataagcgtccgcctcccttgcacaaaatcggcttatgacatgatttagcgtaggcccttcctttgactgatgtcatcggtccgctcgcggatcatcaggtggcggcgtctctgaaggagaaggtcatccaggaggcgtccgatgctgccaccactagtggtggcaaagctccgactaagacgaggaaattctcatctgtactcggaaatcgccgcaaggcagaaactcccttggtaatttcctccttgtcattaggttgtgtagcgaggaaagtttgttctcactctttatcggttgtcttgtaggcttccgacgtgtctcctccgcccgcgcgacgtcagcgtattgtgacgatccgcgagaagtaagtgaagaatttttagactctcatatcttctgtttgagcggagttttgattcatggcggttaacagggaggcgcggtcgaaagctgctcggggcaagtctggggaaacgtccggcgcgtcccctgtcacggcgtcaacagatgttgtgcccgtggtcgggagtcgggaggcgacaccgaacggccccgtgggagatcccgtcgagggctgcggtctgtcagaggccgtcctcacctgggaggagcgccacgtcgagatgaggcgccttctcaaagccggtgcttgcggcgtggggcgcgaggtctcggaggcgagggcggagacggcggcggccaatgcgcgtgcggagctcttggtgcgggaactggctgaagcccgcgaggacctcacgaagatgagggagctggtggccggcaacgagcgccagcgcaaagggctcgaggaccgcatgtcggaactcggggataacctctccgagatccgtggttcgctgcgggtcacctacaccggtctccaccaacttgctgaggagtgcggcgtcaagtcctcgatcccggcgaaccccgacgagttctcgttgacctcttctcttgcggagctggcgacggcgatgggggaaatcccctccaggcacgtggccaggatcgcggaggagacgtccaacggtatctataccggggcgtgtcacgtcctcgcatgcgtgaagttgtcgtgtcctgaactcgatctgcgcgagatcttggatcagggagcggcaagcgacgcgcgcaaggaggtgatggaggaagtcggtgacctgggggagtatgtcctccccctttttgaagagtaggatctcttgtatattttttttctgacttgtaaatcttaaactctggttgccttcgtgcgcatgattaccatctttgttcaccgttgatctcggaaatctctcttatcgactgtagagatgctgatgacgaggatgtccggcaacgtgggcagcctgagtcactggcgataattccggtactcgagtttgaactgcacgcctcacatgacgtcgaggaccaaactcctgatgcggaggttgaagtgacgacaactgcctcaagtgagtagcctatcaaccttatcgttgttttgggggtttccgggttgtcttagtggtcgttacgtttagcagatctcgaggatgcccttgcgacccaaaatcgtcgtatccaatactggaagacgaaatttgaagtggcggaactcgagagagcaatgctagccgtaaagaatgagaaagctgtggaaacgctccgaggccgcgaggtgtggttctcgtcttacttgcagagttgctgcaccacgatggctagggtgtgccgggagttcgggtagtccgcggtgatcctaaggaatcgccggccgggtacatctcgtggctcaacggggcctgtgcccaactcaatggcattggcaagcgaatcgacgaggccttgaagcaagagtgtcgtcgagcgagccgatatgccggaggacacatgctggcttgcctgcgagatcaccgcccgcgcttggatctcgaatttttacgtgaaggttttttacattctcggaggaacccggcggagatagatcaccttgcgaggtcgatgtcgccgttggccgagaagattttccaatcaatggactggcgttggccgtcttggtaatgtttgtatcctgcgaccaaatattttaggggaagatgtaatgcagcgaaatatctatgtataaactgtaaggaatgttttgtgaataaagaaattaatctttaacaaatgttttcttactctggatgttgtgcataagagtgtgttctcagttaacgactttggttagccgtttgagtcgtacactctccctagcccccagccttgtcgtcggagggatttcctcaggtggcaaggctcttagacccttggcatgtcttggttgaataagctctgatcctagcccccagtcgtgaaggtggaaagctcggttttcgattacacggcttggttaatacgcacggcgagaactcttacacgaccagatctgacatggtcttttgtctctgaaggatctgataaggccttatcggctctgggcgtccctagccgaagatcccttaggttcctcggaggccttgtcgagacggcgtaaagggacataaggacaggtttcaacgctaggtgtcgtcagagtaaggggtcattgggtgaaaacactttggtcgtcatatgagaccaaggaataggctttattgatactgtaagggtgcttacaggtatagcggtattgactcatacatagaatttacgtagttggtcaatgttccacgaatttgctagttcgcgaccgtcgccgtcggcgattttgaatgcgcctggccgcaagacttgtgtgatcgtgttgggtccttcccattttggtgagagtttgtttcgccccgcttgagtttgaactcgcctgaggacatagtcgccgatcgaaagtatgcgtgctcggatgcgcttctcatgataacggcggagggcttgttgatagctagctgctcggacggcaactcgctcacgatgctcctcgagaaggtttacatcgatatctcgctgattctcctggttctcgtcggaatgcttctgtactcgtgtgctttgatgccgtaactcgtcggggagcatggcttcagaaccgtacacgaggaagaagggtgtttccttattggacgttgtcggtgtagtgcgcacggcccatagtactgatgggagttcttcaacccattttttgtcgtgtgacatgagtctgtcgtagacgcgggttttaatcccttgtagtactatgccgttcgccctttcggcttgtccattgctttgagggtgagagaccgaggcgaaacatattttgactcccaagccgatgcagtaatcctggaaatcggcgctgatgaattgagagccgttgtcggttatgatgcggtgcggtagtccgtatctgcaaaatatccctctgacgaacttgatggcgttatcggccttgatttccccggtgggtactgcttcgatccacttggtgaacttgttgatcgccacaaataggaatctgtagccgccctgtcctcgtgggaatggaccaagtatgtctagcccccagcatgagaacggccaagtcagagggatagtctggagcgcttgtgcaggcagctttttgtgcttgctgtggaattgacaggcttcacatcgctggaccatgtcgcatgcatctttaagggctgttggccagaagaacccttgtcgaaaggctttgccgaccaatgttcgaccggcggcatgtgacccgcatatgccttcatgtatgtcgaggaggagttgtttgccgtcgtcggtagagacgcatttgagaaatatcccatttggcgctttttttgtataaatcgttgccgatcatacagtaaatctttgctttgcgggttattttctcagcctctgtatcgtcttcgggtaactcctcgctgccgatgaatttgattaatgggctgcgccagtcgtctgtagtttcgatgtcagcaacttcgcattctgcctcagtgacctctgagctgatgtcgggggtgctcgggccaacttcgccgctaacttctttcaccgatggctttgtcagaacgtcgagaaaagtgccgggctcgagcggctctcgtctggatgcgcgtcgtgctaggtcatctggctcgacgttgtccttgcggtagacgtgccgaacctcgatcccatcgaacctcctctctagctttctgacttctgagagatacttggataactcggggttggagcatttgtagtctttgtgcacctggtttgcgactagctcagagtcccctttgatgattagtcgcttggccccaagtgcggctgcagctcgtatcccggcgagtagtccttcgtattctgcagtgttattggttgccctgaagttgaggtggatcgcgtgtttgaattgatctccagaaggagatgttaagataaatcctgcccctgctccttggctgttgagtgcgccatcgaacgccattgtccatgtctcattttcgccttggctgtctgacttgttatctggtatggtccaatcggccacgaagtcggcaagcacatgagatttgatggctgtttgcggcacaaagtggatatcaaattggcttagctcgactacccattttgcgatgcggccgacaacgtctttgtttctcacaacttcgccgagtgggaaggaggagacaactgtgactctgtgggcttgaaagtagtggcgtagcttccttgatgtcatgattactgcgtagagcagtttttgaatctatggatatcttgtctttgcgtcatggagagcttcgctgacgtaataaactggtcgctgcactttctctctctcaacgacaatgacggtgctaacggaatatggcgtagcggcaatataaaggaataattcttcattaggttggggagcaacgagtacagggggttttgataggtagcgcttgagtgcaataaatgcctcctcagcttcctgtgtccatacgaatttgtcttgtttcttcagcaaggcgaagaaaggctgtcctcgttctcccatcctggcgacgaatctgcttaatgctgccatacatccggttagcttctgtacctccttaagtcttgtgggcgacttcatgttctcaattgctttgatcttctcgggattcgcctctattcctctgccagaaacgaggaatccgagtaacttgcccgacggtactccgaacgtgcacttctctgggttgagcatgaggcgatatcgtcgggggttgtcgaacgtttcccgcaggtcatcgatcaatgagtcgcttgtcttggttttgacaacgatatcgtcgacataagcctcgacattgttgccaagctggttgctaagtgcgccctggaccgtgcgctggaaggtattcccggcggttatcagtccgaaaggcatcttaacgtaacaaaataccccgaatggcgtgatgaacactgttttctcctcgtcctctttcaccatactgatttggtggtaaccggagtaagcgtcgaggaagcttaaaagctcgcatccggctgttgaatccaccaactggtctattcaagggagaggaaagtgatccttggggcaggccttgttgaggtctgtgaagtcgacacacattctccattttccgttggccttccgcaccatgactgggttggctagccactctggatgaagtacttctctgatgaagccggctttgagaagtttgtcgagctcttctcgtatggcttgttttcaatctggtgcaaatctccgcagtctttgctttactggcttggcatcaggtcgcaccattagtttgtgctcaatcacctccctggggacccccggcatgtcggacggctgccaagcgaacacatcggcattatcgcggaggaaggtgatgagcgcgagttcctatttctcatctagtgtagccccgattttgacagtcttgtcggggttagcaatagagagtggaacgatcttgatggcgccgtctggcttcggcgtcttgtttagcttgctcactttcttgggtggctcagacgtggcgggtggggtgggcatttgctcgaccatgtcgaggctccgcttgtcgcactgcaccgccagttttgcgttcccttgaatagtgattgttcccttcggtcccggtatcttgagcacttgatatgcgtagtgggatgcggccatgaacttcgcaagtgcagttctcccgatgatggcgctgtaagctgtatcgaattcagcgacatcgaaggtgatctactctgttcagaagttgttggcttggccgaaggtcacaggcaacgtaatcttgcccaaaggtctggacgatgattgcggagtaattccatggaagggctgagtggttggtgtcaactcactctgcggaactcccattgcatccagagtgctggcaaagaggaggttgatcgagctgcctccgttgatgagaacccttgctaccttgacgttccgaatggtgggtttgaccacgatcggataccgtcctgggataacagaggtctttgggtggtcttctgccgagaactctattctctgctcagaccacttcatcttgggtgcagccccctgccaagtcgaacagacttcgcgttccactttcttgtattctcacttggaggaatacgttgtggagccaccgaagatgtgtgagacatggaggtcggagtctgggtacgcagaatctgattcgtgaggaggtgactcctcgttcttctcgacaacacgtacccgcttgcctttttcaaacgccatgtgcttctcgagcgactttttaaaaacaaggcaatcctccagagaatgtctgtccgttttgtgtatagggcaccatgatttttttgtatcgctgccttgtgggtctgggcgcttgggagggttcgcgtactctgctgcgaggacttccgcttgagcttttctcttcccgtttttgtgatttttcttcttgcttgactcagatgcgtctgcggttggtttcttctctcccccggtcttcggcttgtcgttcttgcgtcttagcgcgtcatccacgtgggcgcaccgctcaacgatctcgaataacctttgagtagttgtgatgcgtcttgttgccaacacctgggtagtgtagtgatctctgacaccggacttgaaggcgcaaattacagaagcatcggtaatctcgggaattgtgtttctgcactcgttgaagcgtcgaacgtatcccctcaatgattcccccgagttatgtgttaacgcgtgtaagtcgtcttcgatcgcgtggcgcttgtttgttccttggaaattggcgacgaactgttgccataggtctgaccacgaagagattgagtaggaggggagatgcatcagccacgaacgtgcagaacccttccacgcggttggtaaatagttcgccaacgcattgtcatctgctccggcagcataaagcactgtcgagtagacttgaaggaattcttctgggtcggtgctcccatcatacttttcaatagctccgggtcggaatctctcaggccatcggacatcacgtagggaacgacttaaagccctacacccagcactgggagcggtgggttgtcggtggtcgcgtgaccttctggatgtctgtctgacgatgaagaggacgcggatgatgatgatgatgacgatgggtcgcttggttccggcgtacgattacgaggatgacgacctggatctcgggaatcctgtcgtcgtctctcgctgttgtcttgtcacatcttgatttttgtttcaggatttataaattatttaataaattaataatataatttatattaaatgttctttaatttacaagtgaagttaaatgtgggaaataaaatttcttaaatctaaagcatggatggatttaatttttattaaattctccatgattaagtcaactctctgaaatattctcggatttttcggagctcaattcctaaatgatacaaagaacagttcagtaattatttgatcattaatgatctaatgatatttgttaagagcttttcttgtttaaaatccttaaattataaattgttgtttaaaaggaataattagaaaagatcttaaaagcctaaaagagaagatctaattttaatttgctaaatctcaacataaaattgggctagataaaatttcattaaatactttgcttaattctataattcctagatttttctgggatttatttgagctaaggaagtatttttaataaatggaattgcatttcatgaataatttaaattgaaaaaggtttttaaaagtcttcttttggctttgggccgaaagtcggcccaaaaccgctccctcttctcctcggcccagtccggcccagtccgatgagccgccgctcttctctctcggtgtcgctgacaggcgggacccacctgtcagggtcgtcgtcctcctcgcgccgccggcgccgcccgaaaccctagcgcaagccgccgccgtctccttccaaattcggccgatcctttccttctccggccgaatcttttgaggggaaatgatctcctcgatctcctcttccttttctcttatagaaactccggtcaatttcgtttggaaatcgacggacttgagttcgattcggatcgatctctctcctccgaacccttgctttcctccgccgtcgctgaagaccgccggagcaccgtcgccgccgtcgacccgatcttctccggcgctttttcctcgtcgccggcgccgtccgttgcttctccgccgcttctttggtcaccggtgagttcgccgcgtcgcgctctacgtcctggtgctcttcgtttgcgccgccgcgccgtcgttcaccggcgagcatgcgttgccgagccaccgccggtgctgacgtcatcgctgacgtcgttgctgacgtcatcgtcgccgtctgccgtgagccggtcgtggaccaatcgatctcggccgtccgttttggatagggtcgatctcggccgttcgtttccgtgagccgccgccgtgcgcccagttcaccgtgaacccgacccgctgacgcaataatcctcttttccttttcaaaaataattcattattgcgtcataattccattaaaatccatataagtgttttaatccgatttaatctttgaaaattcataactaattcactgtaactcagtttaatgtggttcaagttgcaaaaaattatataaaataaagatctacatattaaaattgtccataaattgaattaaatttatttaattctttttaaatgggctttaattagatttaatcttgtaaaattcgtaataaattcatatgaagtcagaatgaggccgttcaagtctcataattcatctaaaattatgatctacatgtttgtttacttttcatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttacattgattactttattccttgataccttgggtgattataacttgactagttgagctatatatattggttcagctagatattagatatgattgcttagccatgcttagaaacattagcacactattgggataacttatgactcattatttaaggatggtttaatggtagctcatgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatggttcattgcggagcaccagactgagaagtggcggagataagcccacgggggtcgctggggagtccatgcctctggtttttgagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcacaataattatagatgttatacctggtaataatttgcttagctcctggtttggagattagatctgtacagccaggtatggttgcttcagaatggttgggcctgagcagcatgggcgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaataaagatcccgaaggagaagacgtttggcttataccccagttgagctgcctgtgggagtggagccggagcttcgctagattttattttccgctgcagttttcttcttggtgaggactaagtgcctcataagtaagtatttatcattttagttaatttgatgaatctgcatactaaattgtcagtttgtgtacctcggctgattcctggacgaggattatatgcacaaataagttcggaaattactagtgaatttctgggcgtgacatgtctcgacgccgatctccttcatcgtcgtcgttgcggcgacggccatgaccagtgttgtctggcccccgccggtcgcgatcgtcgtagtctcggtcctcgtttggacgatttcctcgatcatggcgtcgtgaggagacatgacgccgggaacggtttgcgtcatcccgtgtgcgtcgtgcttctcggcgaccgttgatttgatctcgaagatcgccagtgccacgaggtggaggggtagcttgttggggtgattccctccgttccggattttcaccattggcgtcgccgactggcgatcgattttgttgtgctgcggtggcggcttcttcgaacgcattgctaaggtcagtcaccgatgcccgtaatcgttccgtccaacgctcgaggtcgttgttcagaacgggatcgtaaggtgtttccctcagtatggcttgaacaaccctgatgtgctgggctggagtagtcgattgattcgccgtctccgcattggcttgtgctgacgtgccaacttcatcgatagccaataccttccgcgccgcgcctgacgtcgatgacccatagtcttcgaggagatgtaagacagatggttcgtggggatcgagatcgattaccccaacgaatcgatctgaggccggagtcgctccttgttccttgccgttatccctgacggggacgtatgacttaggagacggagttttcatggcgccgaggagaactttgcagcttgagaggtcgtgattctttgtcttatggataggacaatagtcgtcccgagttggagaagtacgctgaattccacgttctttgcaggcgcgaatttcagcacggacattgatgaatacccagcaatcttgaaaggtatgtttcttggttttgtggataggacaccaagacctggtagcttcggaagttatccttatcggcccgcgattcatgtcagaaggacaaagcttggccacatcagaatccttcacgagtttggacgtagtcggcaatccgttctccgtttcaacgggtggatttttcgacatggaggcgtcttggttcgtagccacggcgttctcgtttccagtcattggaggaccggttgagatcggcatcgtggtgtaaaccgggtagacgatttcgccgacttgagtccataccagcattgttgaagtaggaaaaacttggctgaagctggtgttggcgttgttgtcgacgatatgggattatatggtggaaaacacaggttacaaaggaaaagatggaactcggggggtttggcgagattgtagtcgagttgattcgactagctctcgtcgatttggctcctcgcaggctccggcttcgtaggctgtgtgggttgtgttggctctgagattcgatgatccatggcctccccagggggtcccttttatatcgcaggtctgatgctctccgagtaggactcgaatatactagacctggcacgacacgtaggtaacccaattcttgtccgagaaggactctcctcatcaatcgatttcacgaaaggtttcctttaatcacaaaggaaatatccgcgtacgcatagatataccatgtcgttacgtgacgtacaccgaagggtagtgggtatgcctgacccgtaaccctgacagtatgtattgctcatttggattgttttcgaatcagttttgtttttcttatgcatttgtatttgtgtacttgtatttagtgcaccaatgctaattattaaactcttttttcaaggggaagatgatgaagatgacactgagtttgtggagtttccacatggtgtggtggcgagcaacttgtaattctttgatggtcttgatgttgaggaggatggtgttgccttgatgctgcttgatagaagaaaggagaattgcttgcgtattttggtgctgatgttggcaatttggcacgaacttttgtgattctgtgaattgtgatggtttgatggacatgaaggactggattgtaatagtaatatttaatctaagctagttgcattgcatggcatagtagcatttttgcatatttgcacggacgatatggacatgttactatcatattatgtcaactatggagtatggatagatggacttatccgttgaagttttccccgttgcatatttgcatggatgatggattgatggacatgtaaataatcatgatcttcatcccctaacttgctggacatgcaatatgggcacgaatgttgatatggctcgtgacctaaaagccagcttgaactggctgtcgagctgagccgagccagcctcctagcacgttactataacgagacgagctgagccaactcggtatgctaacgagctagctaggctgagcccaaccgagctgagctggcttaatattcaccccctagctatgtaccacataatccgcgtgcttattattaggaatgaagagcgtcaataaaatcccaaatttacaaattcatagatggacttattacaaattccatgattggctccatgcatgcatggctctcttgtggagcaattttgttttcttgtttcattattccttctatgttcgcaacacaattacaataatttgaacactattagcagtaaaagggccactcacatttatttcgcagtcgaaaatgttgatggaaatttcttgacacatcaataattttatagtaagtaatacttcatatttaaaataccttctttctagctatatgcacctagactagcccaagtgcttagctagctagaaagatgatattttagagaccgagggagtactagcacaaactgcattgtcaatccaatgagagtactactaaaaattttgttactagaaatctctgatcacattgttaaatgcttttcactttttcagacaggtaattggattttaagaaaatcttttgagcgttgtatgatttcgtttgctactatgttctgtgttattaaattgtccgtacatttttgtttggagtcctttcctgtgttctaccaagggaagtacttctaagtctttgaatttttcatattctgaatggctgcagactatggaacacaaactagctaacccaccccatgtgtggatagaaaaaattgaagtaatagtttcagggtatatgatccttttccattgttcataaaaataattatgattttattcagtatcctattatacgtctttgtatcattaaatgattatgttggatgatacactactggagaaacccacaatagtcttggtttgcaaccccctttagtcccgggttacaaatcgagactaaagatgtcgatctttagtccctgttgttcctgttgaaataaccgggactaaagatttatctttagttccggttggttttttccattgtttgcatattgatttcgaaccaaactcaacaataaaatcattcacattcacataaacatcacaaaatcatcaacaaattcacaaatcgaatgaacatactcaaattgacatcacaaattcacaattcgcatcacaaatttacaaatccaaagacatcacaaatcaacaaattcagagataaatcaacaaataaataaataaatcatccactcgtcgacgccagagctaatgccgcgcgggctgctgccgcccccgcgcaggccgccttcgctcgctcctcgctactcccgcaaggataagagagaggaaagagaaagagaggagagagaggaggaaattaaagatgaggaaaagggaggaggagtggaggagaggataagtgtggaggagaggatatacagggggacccataggttcccggtatgcactggcatacccataagtttgaaaattttgctaggatcagctctgcaccaggaagtcaggaactatgcaggtgtatgcagtatgcagtaggctgcttgctcaatgctcctactgtactactagtagacttcctttctctctctcaatgcacgagctccaaagcaagcaagctagctagtactgtagtacgtacttcagctgtcagctactcagctgtcaagctactcagctgccaagctactcctgccaatgctttgatttggtttgaccttttatatatatctattgttaggttaatctactgtttgtattattctcctaaccatctattgcatcaagtctcgtagtactactttactaacagatttgaatcatctccaattcaccaattgtagcttaattttgaatatattaattgactttgagaaatcgacatcctaattgttttaaagaagattttgcatgatttgaatttagagtttagatagaatcaatatattgacattgttatcaattgaaaagatcgttttgatgaagaaaccaattaaattagttggttgtaatttctattttcattcaatacatatgagatgatggtttaatttctatagtaactttgcatgtataatttgatattgggattgcctttatttgtatcatgtaacttagatttccaattctacttatattattgtatgagagatatgtatatatgtattagtgcatacccagtgtagcttttctgggtccgccactgattatatataaagcaacaaaagatagtaggggccagatgctttttaaaccgagactgttggtattaaagatcataaagtggcgttgggcttttcaaccagatgctattggaaccggtactaatgtgatttttggccgatccacgaaagattagttctctagtagtgatagtgttgagtgtgattttgtataatgggacgatgcatacggttatctgtttacattgcttgatgaactattgaacttaagagcatttttatttgcaaagagtgacgtggactccatgtgcatagacagcatagtgacttggtataaggaagcaaaacgaactcctgaatataacaacacaaactggactgataacgaactgtatctgaccaacctgacagcagcctcgccatcaatccattagtggaaactagtggtctcactcacaaagatgcttggccgtgcataaacagcctatcagcaaacacataagttgaaacattgtgcttttttagtttttgaaggattgcggaccacaagtaatggatattagtgacatttccaatgtactgcactaacatgtcactcaagttaaaccagccaatggctgaaggtataggtggacgtatatttcatttgctgcaattcacaggacatacccaagttgttaggaagcaataataccgttgttggtactgtgtgtaaggctgagttgttttgagcaattcaaagtttcgttagcacatttttcaaactgttaacggatgtgttttatgaaaactcttatatattaagaaaataaaatagatctattttttatgtttaaaatatttaatagttcattagtcaccactaatgatctttctcgttttcggtgccatagaaaatctaaccggggttgctcaaaccggagtttaaaattttatgataaatataatactccctccgtcccaaaataagtgcagttttgcactattcatctccaacgtttgactgttcgtcttatttgaaatttttttataattattatttttattattattagatgataaaatatgaatagtactttatgtgtggctaatttttttaaaaaaaattataaatttttcaaataagacggacggtcaaacgttggacacgtatttccacggctgcaattattttgggacggaggtagtacatgtttaactaagtgcagcttatggagtctcgaattgaggaaactagtgcgcttgcttgtattcggtggccagtttaacttgagtgacagcattgttaaatcaggatatatgcactgcttaccaaggaaaatgaccttcaccaagtaagtcaaatcgccactcattagaacgttgtagaagaccatgcatatgggcagagcactacctgcttggatcacaagctttcctcggaagggtcgtatagttcatcaagcaattcgaaactggaattaattaggaaccacgtttcaggttcgtggaacacgttctatatgaagtaacaaaactaaaattctgtttggttgaacgagctagaatgtagagaattaacttgaggcttcacgttgttatgtgtatgtggtttttttttctattccattgtaataaatactccctccgtttacaaatataatagaatttaggccgtgtttagttcatgtgccaaaatatttttttaaatatacggacacacatttgaagtattaaacatagactaataacaaaacaaattacagattccgtatgtaaactgcgagacgaatttattaagcctaattaatctgtcattaccaaatgtttactatagcatcataatgtcaaatcatggtgaaattaggctcaaaaaattcgtctcgcaattttcatgcaaactgtgcaattgttttttttcgtccacatttaatgctccatatatgtgtccaaatatttgatatgatggaatttatggaagtttgaagggaactaaacactgtcttagtgccattccatttatccaccaatacgaaggattttaaaagcccaaggagaaaactatactccctctatcccattttaagcgtaaccttgagtttccatgtctaattttgatcgtctatcttatttgaaatattttatgactagtatttttattgatgttagatgacaaaacatgaataatactttatgcgtgacttatatttttgtttttttaatttttagaaaagtttttaaataagacggacgattaaagttggacacgaaaactcatggctgcgtttaaaatgagatggagggagacattgcctcgggcgtccaatgaatcgttcaacgtgtcacttgtcagtgctacctaaatttgtactaaaagtggcaaaattccgtatgtttgtgaataatatgaaatgatttgtgttaaaatatagtataatggattattttgctgcctgaaaaataaattacatccttttaaaggtgggacaatcattgttcatacttttggaagctccaccattacatacatagtttccgtcgttttcacgtcctaccaacattgaacaaagcacgattgactggcatactcaatttgaccatattgttttgaaaacttgcgtattattttactagggggcatattgcataagccccactaggtagggttcttgtatttgtcaatctgccagtacatctcgtctaattgttgttataccactagggttcttgtttcatccatacgttgctagaatgccattggatcaaaaacagtaacactggaagatatactgagggacaagaaaggagagagtgccggaaatcaattgagaaaaaggggttgtatgatcgaatacaagaaacaaacttagcatagaaggtgaacggtagtaacacaaaaaaactattttttttaataaaaagaacgctctaacttgatagagtgtgtcgttggttgaaccgctggaccaacactggttagatcgaatcctatccaccggtcggaccgctgtgacaccactggttagactacttgccttatgtcgctctgatcgtcggggtctagaaaaacacaaatctgatccgaatccgatccaactcgtagaatctgccagcctgactgttgagtagccctatcggagcgcaccaaacccactggtctaaccgaccacccaatgccaaccacactattcaatgtctgaaaacacttcaccatattttcacaaacaatcgcctttgacaatggttcatcaccgcgattaaatcatcacctgattctacggacactactatagaaatacacatagcgatatagtgccaaaaaatagttaaaaatggcacctatagtgctttccccacctccgcaggttgaaaacatacaaaaccggtacctttaagcaactatatgtgccttttttagagaaaaaccggcacctatcctatagctaccgtttaaaaaaaaggcacctataatatattatgggtatcaattaaataaaaaccaatgtgttggttttctaaaaagccggcaccatccttaaccgagctgaaccggacgagccaatcagagcccttctctctctctctctcctccccgcaactggcttaagcgacggtggcttctcccaaggaggatccaatggcgaaggcgtcaatgacgggcggggcggcgtcgtcagcgggcagggtgtcatcggcggggtctcccgcatgtatcgggcgtcgggacgaatgggcggcgtcgacgggtgttcccgtggcagatctggcttcggcgggctcttccgcagcggatccggcgtcaacgggtgttcccacatcgggtctgacgtcggtggggtctcccatggtggatccagcgtcggcgggggttctcgcggcggatccgtcggcggcggtagggggaacaacgttagcggttgtctacccctctttcttgttcatgtgagatattgttgttcttgttcatgtgagatttgtgttcttgttcatgtgagacattggtgccggcatcacttattagggccgcctacttggtgccaagttggaaactggcatctattagggtttcccaaccggcaccaagcccgattttttaccagtcagtggtaaaggctgggatcaaacccaggatcactgggttgtgtgatgcatgcactaaccatttaacaaacaagagaaacctagcttgatgaactactacatcgtacaaccttgaaaatatcttgggaattgacttgaatatcctcatgaacgttggtgcatctgccactattataggatgtaacttcaacgtaaagagaatgtaaaaaatgagtaaaaatcatatcttaattatttaccatcaattacaataatgtaaaaaaatgagtaaaaatcatatcttaattatttaccatcaatcacattaaaaattacactgcaaacaaaataatgtagccggcaacaggaaaacttgcatttttaggtgtcactttattaaaaagagatactaaaatggcaaccgtttttcttctactgaacagaccgctggttagtgagaggagattttgcgagagaagaaataatgttggtttttaagcttcgtggaacaaaaacatttagtagaagacatcgttggatgagaaacaccaaagacaacaggtcgagactcatatctcaatgtaaatcgaatgaccaaatattcgtgtcatttcatcaagtaaaagcattttgtaatagcaaaatctaaattaagaggctctcgttttagtgctaacgagaaaccataactagacacgttaactatagttctagtccatcaagcaagtagaaaatatattcctatcacctatgttgcaaataattttttttcttaaactactcatatgatctacgatccgattacatggttgtgttcgtaagaattaaatctttataacaagttctcacatgattatattttgatgaaaaattacaaattacttttataatatggttgtgtttagttcgtgtgccaattttttttacgtatacagacacacataataagtattaaacgtagattaataacaaaacaaataatagattccgcctgtaaactgcgagatgaatttattaatcataattaatccatcattagtaagtgtttactgtagcatcgcattgtcaaatcatggcgtaattagactcgaaagattcgtctcgcgatttacatgcaaactgtgcaatttgttttttttcgtctacatttaatactccatgcatgtgtccaacaaacatttgatgtgacgaaaaagatggaagtttgaaaaaataaataaatctaaacacggcctatatctaaattatttttagatttcactaaattacttgttatacatataaaagtaaattcaataaagtctaaaaataatttaagaagtaacttaaaacaaaaatgaagtaactttttcatgacattagaagtagattcgttatggaggtaaaaacatgagtctatctagaaattaaatttaatcaacacaaattatggaattggctaaaaatagtaataaaataaacagcgcacaacattatgaatatataagaagtaatttaataaaatcgaaaagtaatttatatatatgataaaagtaacttacatatataataaaagtaatttacaacaaagatatttcttttatcaaaatatagtcatgtaagatcttgttgtaaagatttaattacaacgaacacaatggtgtaatcggattatagatcagataggtaatttaaagaaaaatccataagaagaaaaaaaaaagacatgtatcatttggtgtactagtaggcaaccatgtatgagatgagtttctggttaagacaatatagcgtgcagtctctatgtaatcacgtccgtttttataacttgcttaacaggatctctatatcactacgtactcaaaaacagcaagtgcgcacttgtcgtacaaacttcaaatttatatcatcacgaacgcacgatgcaaagacaaagttgtcacgtcaattgtttcattttaggcaatggcattgccattttggaagtgcatagccgcaatccacgcctatataaaccccacaacacttgcagtatccagcaaacaaaccaagctaaacaatcacccacttctatagttagttaaagtagcaacacttaattatttgcaattaatctaattgcatatatatgatggcttacactaatctctccaagaaactagccgtagccttggtagcactggccgtcgcctgtgcccacgcactcgcggcgcgcgaacttgtcgacgcggccgccatggcgcaacggcacgagcggtggatggccaagcacggccgcgcatacgccgacgacgccgagaaggcgcggcggctggaggtgttcagggacaacgtggcgttcatcgagtcggtgaacgccgccgcgagccagcacaagttctggctggaggagaaccagttcgccgacctcaccaacgccgagttcagggccacgcggacggggctcaggccgtcgtcgtcgcgcggcaaccgcgccccgacgtcgttccggtacgccaacgtcagcaccggcgatctcccggcgagcgtcgactggcgcggcaagggcgccgtcaaccccgtcaaggaccaaggcgattgcggtaagcgtgcgtggtgttcgtcccattttgcgtgaggtggcgttcgccgccatggcgagctgagagcgttgtgctgcgtcgtgcgtgcgtgtgcagggtgttgctgggcgttctcggcggtggcggccatggagggagccgtgaagctggccacggggaagctggtgtcgctgtcggagcagcagctggtgtcgtgcgacgtcaagggcgaggaccagggctgcgagggcgggctcatggacgacgcgttcgacttcatcatcaagaacggcggcctcgccgcggagtccgactacccgtacacggcgagcgacgacaagtgcgccaccgccggcgccggcgccgccgccgcgaccatcaaggggtacgaggacgtgccggcgaacgacgaggcggcgctgctcaaggccgtggcgaaccagccggtgtcggtggccatcgacggcggcgaccggcacttccagttctacaagggcggcgtcctctccggcgccgccggctgcgccaccgagctggaccacgcgatcacggcggtcgggtacggcgtggcgagcgacgggaccaagtactggctgatgaagaactcgtggggcacgtcgtggggggaggacggctacgtcaggatggagaggggcgtcgccgacaaggagggcgtctgtggcctcgccatgatggcctcctacccgacggcgtgacaaccatcactctgaaatctgaacgagtgaatggcatgcagctagcaggttttaaataagcagtatggtattatggatggtgctctgtttctgaattcggatagtacaaaacagaactggaatgtaatgacaacttgtgcaagatcaaaatttcttgtcttcacaactggaatctatctattatctatctatctatctatctatctatctatctatctatctatctattatatactaaaagtccattaacttttctaaaatcgctctcaagctgacatgtaacatcctaaaagcgctctcaagctgccacgtggtgcgaggagaggagatgaggacccacaaaaaaacgaaatcctctcccacaacgtctgcatgtacgcatgcatgtggatgcttttcttccatgcttagcggcaggattaccaagtattcagggttttacattaataaggtttttttttctgttatttggatcggtatgtaggagtccaagttgggctttagtccgttcagctggctaggcctttgtgccacctatatatgccatgttccttgtattaggagattggtttttagttttcctctgtgttgtgccgccgccaccgcctaggtcaggaaggagatggcgattccatacgttttgccaccatcgttgctgcgttggttaatttggtcctaggcatgttctgatttctgacgaagtcttcttgctctgatcggctatcattcttgctgcatgggtggagtttatgtacaggtttcgttagtttattcattataaactgaatcatctatctgtttatatttgatgctactggagctattcagttcagtttatctggagtaaatgatcttatgtgcgaccctatatactttgctggacgagatctctatcttaatattgatgctgctcttgattcaactggagattagggtgtatatatatatattctcgttgcattagaaaggacacatttatcccataccaagttgtacactcaacatagttatgtttacatccaaattttaagagatcaaaaacatttcaagaacaattgatagaacatagacctccaatattcccaaagaaacagaaaggataactggaattcagacaaaatttgggctaaatttaaacaaattttgttgaatccaaagcccaatataaattgaagaaatcatttgaattttttttgcttaaagttctataactattcttaagaacacaaatttcttaaagtttagaactccaaaacgaagatttgatatgtattaaaaataacatatagtttagatgacaattcataggaaccaacttcatttttgcgacataatactttcctataattaaagattgtgttgcaaggataattagcattcaaaatattcacaaacaaaatattgacaaaaaaacaggttgccaatagaatcaggaacaatcacgcatatacaaacattatattcatatgtgtagagtaatatttcaagcacattaaattagatgcccgcgcatatgcgcgggcttcctttctagttatctaaacagataaataatcgcgctctttcaattaacgcgtagtcaaagctacatcatcacttgatggattatcattataaaaaaaaaagggctgctatataccggtatcccgttgggatgtcccaacggaatcgctccatgtccacctccctcagacgcgagagcgctccacgtccacctccctcagacgcgagagcgcaggccaccgtgggagcagcacagaggcggctaacgccggcggcgcggacgcggccggcgccgacgagctccggcgtggaggacgtggccgccggcgacgagctcccgcgtggaggacgcggccgccggcgagctctggcgtggggcatggtcgcatggacggcggaggatctgcgtggtgacagagacagtgccggcgaagagctccggcgtggggcgtggacggcggaggatcctgcgtggtgatggcggcggcgccggtcacgagctccggcgtggaggacgcggccaccgggtgaggcgtggacaacagacgcggctgccggtgacgagctcccgacagaggacgcggtcgccagcgcgcgagctccgatgtggaccatggacgggggaggatgcggctgccggcgatgaggttcgggttcagtacggagcgtggacgggggaggacgcggccgccggtgacgatgcctcgacacctcgatgcctagctcctggtatctagtaggtatcatatgaatacgatacctcacaagtatcaccccgatacgtcgtagaaatcgcacgataccttataggtatcacatgatacctcacaagtatcgtctgatacgtgataggaatcgtctgatacctgatacgtggtagaatcacatgatacctggtaggtatcacccgataccagctagttatcaggtgatacatgtagggtatcatacaattcttaccacgtagaagatgatagttgcgaggtatcaagtgatacttgagtaggatctcacggcttaggagctcagcctcgttcctatttggatgggaaatatggacgaagggtatcctgtcccgacggtataccggtatatagcatttccgaaaaaaaaaaaccttatggatgatggcatgatgcaatatttctgcattctgatacttgttcagattgcagtgcaataagccaataacaacttgtacaacaaaataaacaaagctcgttcagatttgtggttacaactggtcaaggatgcctcttcatgcagtacaagctgcatcaccacatgatagaggaccaaatcaatctggcatgctgaattaaccaaatgacaggattcacatttcgtagaagaacaaatcggaaaaatcacattacgtctattgacaattgacacgcatctctgtgcatgatcagtagagaaacagtgatgcagaacctgaaaatataacttgtagatacaaatggaatatgagaaggttatctctgactctcagaaatgagatcacaccttcacatcagcattaagccacgtacttatgtaacatcagtatcaagccttagctaaccaaagaagaggcatgaatccagaattccagatagagtagttcttactttttagttgttaggcagcaagcaaaatttacctctgtggaatggcacttgttggctagaataaacttgctactaaattaaagctaatcgtactacactactaatgagaccaaaaaccctgtccagtcttgagcacatgccaacaacaaaaaacaatgccttgcatgtggagatgtagatacacctatcctgcaaacataacactaacaactttcagagaaactgagcttggatggatcacatatgtaggcacctctggttcctagtacacaaaagggtcacggatagaataatctgatcctctctgaaagctccaaatcagaccaccttctgagtcatcgctcctatagacctgcattgaagagatcttactggcccatctcacagatttgaggatcttcgctgtccagagcgtatcaatggagtatgaagtgaattgtggattggccaacaccacagccacattcttcaccatctgcgcattctggacgaagtacttcaggaaggatatcgcgttggcctcccctttgaattcacggaatgtaagcacattgacatgggacacgatgctttcgattgggccagcatcatcccagaaattggggcttaccaagctggtggcttcagaacattttgcacactgcagaaatggttaaatcagtaaatgtttcagagttcagctagcaactaattgatcatgcagtagcacaagaaggcaatgaggcaggttcaattcataccacaacatgcagggactcagcattgggaaagcatttgaggaagttgggcagcatctgggcatcatgcctgactccaaaattcacattcaaccccaggatcttgacgctcgtgaacaatgcgcttgggctcgacctgatcccagcctgaaatccattaagatggaaatggattgttcagatattcaaatatcagaatttgggacatcagcaattcagaatcagagtgaacaaacaaactgaacagtaagaggttagagatgatggcaatggcatacgcacactgacaaaggtgtcatggatctccagcatgtggaatcctgtctccaagtttcccaacaagcgcagcctgggggcatggacgatcttgaccctgacgcaggagtcatccttgctcaaagaatcatagagcacgagccgctcgaggcatggcgcgtccaccacggcgagattctccacgcaacacgagcagatctgcacgcaacgaaggctccggtgctccaggcggaggcgcaacacctgcgtgttgcctccttggatgttgagggtctccagcacgggggatctcgccacgatgaactcgacctcgcggccctccttctccatggcgacggcgtagatgccgagctcgcgaaggttggggaaggcggtgttggtggggaggccggcaatgtcggggaacttccacatgccgatgtagaggcgggtgagggtggagatgcggaggatggcggcagggagagccgcctcgaacggccatgggcggttgacgaggatgaggtcgtcgacgcccttggcggcgaggaaccggagccagtgctcgagctgggcctggtacgatcccatgaagccgcagaggaggtggacgcagcggaatggccccgggtgcgcggcgaggatgcgggacacggcggcgacgatgcccggcgtgtcggcgcgcgtcggggcagaggcggagacaccgaagcttcgacctcgcgggaagaggtgggcgtccacgaggacgagcggcgtggagcgccagagcgggcgccagcggcgggagagcgcggcggtgcgcgcggcgtccttgacggggaggcgggagacgatgttgcggaggatcgcgtcggggagggcgctgatgcggtcgacgccgtcggaggctgcggcggcgcaggcggcgtgggtgcgggcggcggcgatgggtacgggtgggccagggagcaacccgtagatgtgcgtcatcaagtacttggtgcactcctccagcttgcgcgggtcgtcgccgcggcggcgcgcttccgccaccgtggcggggtcaaggtagatgatcggcgcaccttccgccatggattccgacgacgccgccggctagggtttggtttggggttctggacggcggcgacgagtcactgttgtgtgagggagcgagtgtcccgagtttggaggggacgtgtcgtcgtgtgagtggtggtttcgggtccgtgggtttcgtgtcctatagcaggccaaacgggcggcccggcccagcacgacacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtagaaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctgacgtgccgtgccgggcctgggctggctacagtactgtcgtgctcgggccggcccggcttggcacggcccatttggccaggtatatcgtgtcctggttgggccaaatgtcggtaatgagttgcacctgggcccatgaatcagtaactccacgtttctatgttcccattttccagatatttaggcgttactttggattttgttctcactcaaatttaacttgacgaaatatataagaaaaaaaagggaaacatttatatcagaattagtttcagactatcagtaaggatttgtttgaaattaaagtccgtttagcttttgttagacggaacaaaccagcatactggttgcattgatatccatctaggtcacctcccacatgtggctgaacggactactagaaaaataattttttacaacgaggcctataaaatttataggtggaccatattttagctgcgattatccacctgcgcagttacgtagagagggatccgattttcccccactcacagacggatggtttaaagggatcgcctgcaataatattcttaattttcacaggtgaaccactaaaacccccgcctgcaaaaaccgattgccggacaacccactaaaaaaacaaatcctcacgtatgtccttatccccaagtctccaaaaatctaagtttaccacaaccactccctgtctatccttatcctctccctctccctctccttaccatcctctccctctccctctccttaccgcgtgcaagcccagctacaaagagcagcgatagttcggcaaggaggagggccgaaggcggcgacaaaaaggatggcaggcggcagccgccgcttgacgaggagcggcgatgaggaagaacgcccacgatggtggcggcttggcaaggagaaggagggctggcagcagattgactcctccactcccgccagtggcagtggctctgcacaagggtgacggcgacctacttccgcaccgagctaaccgtatcgaccaacggctatctctagagctccttcgttgttcttgttcctctaaatccagatctaaaaattctctttttttcctttgtggctttctactaaaagccgggtatttgacctctagtctaaaaaaaattctctctttttttctctgtttatctggaatatgggaatcttgttcttctcatctgagttgtgacattttatatgaaatatgtgaattttgttcatcttatttgtgtggtgacatttgatttgatttgtattgtgcttgatctgtgcaaatggcagctgaatggggatattttcaaatgtacttttacttttttttgccgaaaattattaacataggcggttagttttatctactcacctgcaaatatcacattttcactggcggacggcttaaaacagccgcctgcgaaaatgattttttgtaggcagacaagaggcccacaagcaaaaatcgttgattttcataggccttaggtgcaggctgaggttttggtcacatgaaaaaaaaaatatattagtagtgacgacagcatgaaatccaccatcgcatgccaacacgaagtccagcaacccgaaatcctcatgcacggctgcgccctagcaatgcgaaatccaccagcaactggctcctgcttcttcttcagctcagcaccggcagggctctactgcaacgacacacatatctccatctcaaccaattcactgtccgtcctcgttgtcttccatacaaggccatgcatctatccagcagcaacagcagctcaggttatctatcaagaaatcaagacaaggctttgatttccatgattttcaaaactccatcgctgcatgcactccatctacattttgtttttgtgatcaatactcttcataagaagagtgcgactctccatcctcaaaccgggtgaaatgcggcagccacccagcattttgcacacacgatttcccaatgcaccacaaatttctgtacacataatttcaatccacctttcaagcaaatcactcaaaaacacaccagctattctaaataatctggcctgcccaaattactgacagtgttaaattatgtcataaacaacaggtacttcgtacctcacagcatgtcagcatcagctgagcatgcaacttgaatatttgtaactctcttttctcttttgaaaggaacaagaggaacaatattgcagcagaaagagacaaaagacagggtaaggttaaaatcttctcctcaagtgcaatagaattaccagatggacaagatagataattctccaccggcaatctatggaagatgagttaacagcaggcttcactttatcgatttagcccatttgatcggaggtcaccgaatctcgaaatttcagaaatttcggtccgaaattttgaacaaaatttagttgaatttgaacaaatgttaccaaaattcatgaaaaatttgaaaaatttcggccgaagtaatatcgtatcggaggggaccgaaataaccaaaatttcggtccgaaatttccaaccctggttaacaacagaacaaaaaaaaatggggtttaagtcttaaattaagcaacatttggtgaaagatgcctcgtaaatcgcaatccagttgatggtatcatcataaggcataaccactagagatgaacctcaaagtagaagaatccaaatgattatacataatctgatgataattgactttacaaagctaataattaactctatgaaattggaagtactaaactgtggtaccagacagaacaaaacacttcgtttaacatccaaaagacatgtataagattccaaacaaaacatgaacttgctcagatattagtgattctaactagcatcaaaggaattattgagcaaagtagtgcactgtaacatcaacatgtaaaacagtgaaggtaaagtacgataccatactaccagatagatcaaagcgtccagttaacatataaatcacattggtatgattgcaaacgattgcatgaacttgctcacatatcactggttctgacaagcatcaacgaaaaatttagcaaaacagtgcaacataacatcatcatcgtccaacaacaaatgaaacgcatagcagacacagtagttcttagttgtcatccagaaaacataatttgacatttgcatgatagataacactattcaagcactaatttcaacacttctcaagacagtataatcaagtccgctgtccaatcttcaataaaagggaagccgaaactctaacatgaataccatgaagctgcaaacagagcactaaccacttccaaagatatttgtcttggatcacaaaatgacatggaaatgcatctttttctttcagtagtccgtgaaagggtcaaaacgagaaaaatcagatcctctcttgaagctccaaatgttacactcttcaggttctgtacttggggtgaccaggactaaacaaccagtcggccgttttgcagccctcagaacctccaccttggaacgcacctcatccatcgaagaaaaacttccagtgtcaaacaaaatgaccactatcttcagcacccgcgtagtctcgaagaaaaacttgagaaagttaacctcactccgagtgccatgaaaatcatggaaaacaatcatctggatgcttgaccgaatgcactcgatgggaccagactcctgccagaacttgaagttgagcttgccagtggtttcatcagtttttccagactgcaaattggttagatcagtcaccagagatttgttcatcagctagtgatgacagattaagatgcaaatgaatgtggatggaggtgtaatttcaccttgatgtggagcctctcaatgttgggaaagcatctgaggacattggggatcatcttggcatcgttgcggacaccgaaacgcacctccagagcaaggatcttgacgtttggtaccatattgcttgggctcacctttgtcgcggactgcaatcacagaacaaaatgcacccaattaaggctgaaaaatcacaaattgccatcgttatatttaagaagttgtggaattgaaacgagcaatgcaccttgatggcggttttgccaaccacaagaacgttcgctgcagggtccaagtacccaaacacgcgcagagccggcgcattcccaatcttgacgctgccggaggaggcgccgtcatgcctccatgtgccggagacgatgaggcgctcaaggcacggcgtgtccaccacggcgatctcctcgtaggaggagccgatgatctgcgcgcaccggaggctgcggctggcgaggcggatgcgcatcctgaacaggttccccttgatgcagagcgtctccaggacggggctcctggcgaggacgaaatccatgtcctgcgtgtccatgacgacgctgcagaggccgagctcgcggaggttggggaacgagacgccgcgcgggaggtcagccgtggcggggaacttccagagtccgaggtagaggcgggtgagcgtggccatgccgaagaaggtggcggggaggcccag

SEQ ID NO: 30978 - DNA, 11093 bp, Oryza sativa
gcggtgcgcgcggcgtccttgacggggaggcgggagacgaccctgcggaggagcgcgtcggggagggcgctgatgcggtcgacggcgtcgtgcggggcgagcgcgtagaggcgcgcggcggcggagacgggcgggtcgggaagggcgtagtggatgtaggagagcacgcgcgccaccgtcccctgcacgtcgtccgggtcgtccccgcgccgccggaactcggccgccatcgcgcggcccatggggacgggcggcacgcgggtgtccatggtcgccgctcgccgccgccggggccggaagggaactagggaaggggacgagccgacgagggtttggggcgtcgtgtggtgtggactgtggagtggagtggaggcgagctctggtgtgtgtaggcggagtgggaggtgctggtttgtcttgtagtggggtagtttggtcgggatgcgaggaaacctagggtttcggtggtttggttgggccaaatttcggatgcagattgctcatggcccaaactctctccgtcacaaaataaatatataagatactttttacacgttactatatttatatcataataagtttatttttgatttatatgtgttaaatatttaaccgttcatcttactaaaaaaatataaaaatatatttagtcacatataaaatattattcatgttttatcatttaatatcagcagcataaaaaatttaaataagacaaagagtcaaacgttatatctaaaaactgaaaaatgaactttttacgagacgaacatagtaagaaatatctcatcctatcttaaattgttgataaaatttccttaagaaaatacctcgagtaacttaaaagtgtggtacctcccaatattttcttaaggatagtaaaattgccctagattgtttattttgggatggaggaggaaatcggtcactttgttcttcctaatgcaaggtacactcgactcacaattcttgctagaattttgcgatggatagattttgctagaatttatagacaccgatataattcttgcgaaattcccgtaatattcatgtgttccaatgaagtccttcgaaaaatgtctattttgcctatacttaaatttggggagttcaatgtagtatagaaattgtttcgaaaattatgaagtgctacgggtatatcactatgattcgtgtgataattactccctccagtcacgagaatatgttgattagggtttgttacaagtaagactttggccgtgtttagttttccctctattcccaactttccatcacatcgtatcacatcaaaactttcctacgcatataaacttccaactatttttctaaactcccaactttcttcaaacttccaacttttttcaggaattaaacacaccctttaaaaacaaagaaaacaaatactccttccatcccaaaatataagcatttttagatcttgtcattgttttcgagatgctattttgaccaacaatttgtataaaaataaaatattttaaataacaagagtcgcatattataatagtttattaatgataaatctagtaacatcaattttatatgatttattttttttattttattgctattaatagtcaaagttaaaaattgttgatttagcactatactgaaaatgcttatattttggaacggaggaagtatataggatccaataacgctaaaccacgtgcacgtgtgccataatatacacgctatgagtacaaaagatttcgcaggtatatcctgcacaccgtggccatcttgatctgaaaatatttccggggttttcaaaaaaaaaaattctagagttgcagcgacaacattagtcaacgcagcaggctttctaggccgagtttatttccaaactttttcttcaaacttttaactttttcatcacatcaaaactttcctacacatacaaactttcaacttttttgtcacatcgttccaatttcaaccaaactttcaattttggcgtgaaaacacacccctagtttctttatttcatcttctaaggacgaatggcagatataattctcctgtatgatctgcaaagaaatgtattgaaagaagatcataactgttggcattcaaagttaatcatcaaacttttgtataaattcgattcacattccacaataaagtttattcacattccagtattccccagtagaagaccaatagatagaccacgggagttctgataaaaacagacttttcactttggactttgagacgtccactaccaatcagaactgcaactctccaagcaacagaatgcgctactagatggaacagaaacttcataaaatgtggtaaaggaaattggtaatgcagcatataaacatgaattagctttgatatctctgatttttaccaacacgaaggcacaattttaattagcagaaactgtgtgacgtcacatgctcacaggtcaatacagcattcatcttagtcaaaagagagtcctgttaaagatactaccagactgaagaactctaccgaacctcaaaacgcaaccagaaaaaagaaatgcagaagttatggaagaaaaataatccctctcacgcagaaactgcaacagaacactagcaactaccagagatgtcaaacttcgaagatcggatgatgattgtcaaagggtccacaaatctctgatgaaattgaccttacagaaatccataccaatcaggactgcaactctacaagcagtaaaatgttctaccagatggaacaaaaacttcatgaaatgtggaaaaagaaattggcaagccagcgtacaaacatgaagtaattttgatatctctaattcttaccagcacaacagcaggatggcacaaatctaattagatagaactgtgtgatgtcacatgatcaatgccaggtcaatacaacattcatctgagataacatttgtcttctgctggaaagacaatactgttggagttgctacaggattgagagcactgataaatctcaaaattggaacaaaaaacagcagaagtcaaggaagcaaaacaatccctctcatttagaaactgccacagaacactaacaacttccagagatgtcaagccgagaagatcggatgatgatcgcaaaagggtccataagtgaaaaatcacatcctctctcaaagttccaattgctttctcctgcactagcatcactctcaaggaccactagtgaacaacatttactagcccattttgtggcgaacagaggcttcagtctgaaatttgcctcatctgtcgatgcaaatgttcctttgggagacacaattatcagcttcttcagcatccgcgcactctcaaggacaaatttgaggaagttaatctcaccccgcgttgctcggaaacgacgaaaaatcatcacggtaatgtgagactggatgcattcgatggcgcctgcatcctgccagaacttgaggttcagcttgccagtgagctcatcagttttccgggactacaaatgagtcaaacaatcgcacacttgaaagttagagatggataattcagccaaccaagtagaacatttttagataatactcgtaactaagtagtatatgaacgctaaatcaagcaagctgtgtctcacttcgacgtgcagagtctcaacattaggaaagcatctgaggaaactgggcagcatcttggcttcattgcggactccgaaacacacaattatgccaaggatcttcacacttggaaccatggtgcttggactagcccttgttccagcctgcaattttgccaatatgcaatgttgtaacaaaatcaaagaagaaacttcacacattggcatcgatcagcaatccacacattttgaccatctgcactgaacagattaacggtcataccttgataatagtgtcgccgatctccagcacatgggtttccagatcaaggtatccaattgcacgcagcgagggagcacggccaatctttaccagcatggaggagccacaggagtagagcatgatgaggcgctcgaggcggggcgcgttgaccacgttgacatcctggtcgaaccccatcatcatcaggcaccggaggctgcggctggcgacgcggacgcgctgaagcgtgttggcctggaggcagagcgtctccagaacggggctcctggcgaggacgaagtccatgtcgtggttggtgatgccgatgagggagaagccgaggtcgcggaggttggggaagcaggcggcgcgcgggagcgcggccgtgtcggggaacttccagaggccgaggtagaggcgggtgagggtggccatgccgaagaaggtggcggggagggtgaggtcggccgggaacgggcggttgacgaggatgagctcctggatacccttgacggcgagcacctggagccagctcgcgagcagaccctggtactggtccatgaacctggaggtgaggtggaggcggcggaacgggccggggtgcccggcgatgacgcgggacacggcgaaggtgactgcgcgggcctcctcgcgcgcggcgtcggtgtcggcgtcggacacgccggcggggaggaggtcggcgtcgacgaggaccagcggggtggagcgccaggcgtcgccccagcgggaggagagcgcggtggtgcgcgcggcgtccttgacggggaggcgggagatgatccggcggaggagcgcgtcggggaggaggctgaggcggtcgacaccgtcgtcgtcgtcgtcgggcgggagcgcggagaggcgggcgtgggaggagaccggcgcgtcggggatggcaaagtggatgtaggagaggacggtgccgatggagctctcgacgtcctcggggacctggccgcgctgccggaactcggccatggtggcctcgtccatggggatgggtagcaccctcgtgtccatgtccgccgcccaccgagccgacgccggaagggaagagggttgggctgtggggatttggggttttgggtgatgtgttttgtctggtagtggagctgaattctggattggtgtctggtcgtctcatgatcaggggagctttgcgcctttgcaaaacatggaactttcaaacattttaccggcactttcgctagtacactctcagtcgtaaatataatacagagtaatgtcgttaacttttttttttttagaattacacagtacaacgcagacactcacaacgcacgcgcactcaccgctatgaacacacgcacgcaaaccctagagagattgacgaagtcaccacaggcgcctgcaaaccctggagagattgacgaagtcaccacaggcgcctcgctgtcgacgggtacgtcacctaccactgaaagcacaacgctgttaaatcctggaaaagtcgctcccatggggagtcgaacccaggaccttaggtgctactaaggctcttgtaaccactaggctacaggccctttcgcaatgtcgctaacttttgaacatatatttaaccactcagcttattgaaaaattttatgtaaacgtataagatttaaattatgcttaaatcaggggtgaagctagcataaataatcaccagggtcaacactaaccaggtctatttatcaaccaaaaccaatggaaaacgacactatttcgatgtttcgatgtgggacgaaagtagattagagtgaaatttcggatagttttcgagaattcaaatttgaaacggcaaaagtcaaacgaaattaatcaaattttggcaaagaaaagtcatatggtcgggttcggaatccgatattaaatcgaagaggtgaactctgatacaaacatagtttgtttgaacgtagctaaccattccctcccaacacgtaaaatggagcgaggattagcacatgattaattaagtattagcttaaaaccttaaaaatagattaatatgattttctaaaagtaacttttccatagaaattattttgctagggaatttgagaagttgtgggccactaggcttatgcatgatctcaaatttgaaagattcaaatgaatatgcatattcggctgatgtataatcataagtgctagctaattttctattttttaccgctagcatcgttcctagttgtcaattgggttttaacacgacaattaacaattaatgtcactggggtctaatctttcttatcaccggtgtcatagccagtaaaataaagagaaaatcctttgtatacctctaaaaattttagctaatcatttatatgcccccgaattttgcttacttccttgtatactttcaaattttgattttgatcccttccacacccctcccgtcagttgaccgtgagttgaccatctaaattctataaaaataaccattttatcctttgaatgaatatagaaatttatgaatatattactgaaaatgtaaaagtctgttacgagtttgctgtctgatacattatttatgaaaaatagataattaactaaaaatatgtatttattttgtttttaaaaattcataaaaaattaggagcaatcatataaagataggactactaatgctcatgatatttttttatgaatgctcttgataaaaaaaagttcattgtccaattaaaattttaaacaataattttactttattacattttttgattttcaaaatttatgtcaaaattttttgcactaattatttattctcattagtttcataaaatacacatactgtgcactcaaacaaaattttcaatcgtttttcaagtttatattcaaacctaaatcatcaagggcataaaagacattttcaaccaattgtaacagtgaaaggaaggaaaatgtaacgataggggcatggaagggatcaagttaaaatttctaaggtatagaatgaattgggaaaatttcaggggtataaaggggatcgggtgagttttcaagggtacacagagaatttactctaaaataaagagggcatataaagttcatagaaaattgtcggtgtcccgataaataattgtagtgttgccctggcttaaactactttgtggggtaaaataactcaacaaaaaaaattataattacatattttttttagtaagtcgaatggtcaaatatataataaaaattcaacggcatcatctattaaaaattggagatagtataaatttgcatgaacacttattgagatttatatgtaaagtggttatattttgagacaaaggtagtacttattttaaaataatagaagtttaagatttatagagcatgtttgacacggctctagtctagctccacctcttttggagttagagcccaaccaaatagtttcaacttcacctgaaataagagttgagctggcgatagcgctctcaaaaagtaaattacagacgcggagatgcatttatgcagctccacaactcaactctagacctaacaaatgaagttaagtttaagagtttgagttctacgatattaagaaaacatgtgaaattgagatggtggattgtgatttgttgattagaaaacataggtgaaaatgaaatgaaaaagatgagattggttgagaagataatgtaggtggaatttttttatatttttagacaaattttaaatactaaaaatattatattttagaataaaaggcactatatttatttaacggtctaatttctagcaattatttggctcattagatggttatgttatccgtgcaattatgtgtacttgtattttgtgggcatgggtctgcgcaacggtgaatttggtgctcatatgtagaaatttgacagcctgaaatttttttacgtcgttttgataagatgccactgtatgataaaatgctattccctttgtctcattttggttatttctcatattttgtaacggatagagttgtatactcaatattttttcccgtgactaatgccgagtgggtgtttctattttgtctggtagtggagctaatttctggattggaggctggagcctgatgtgagttgttcttttttttctctctctcttttaagtaagggtttggctgcttcaaaaaaaaaaaaaagtaagggtttggcaccattgtgttaatagagcagaaagtatggatgaggttcttaggctattttttttagataatagaatagaacatcgcggccttggctcaacgagctacaaccaattattataatctaacaatcaaaatgagtgtagtttagagaaacttataaagacaagaccagccatatacaagaaacaaactaaaggttgccaacacaagataaagagtacacgattattgaattatgtttgtgaacctctatctgaaattgacaaaaagttgcataaccgttgtcaagattacgacatgcaacctttaaaagctcgccatcttcatcacatttttgtagttgtgcctaggaccagagccaatatgttgctctgaaaattacctgcatttataaaatagatggtgaattgtcaaaaaccatgtcgttcctgctcaaccatagagcccaacatatagcagatgctcctataagaataagttttctacttttttttgttaacctccataagccaattttcaaatatatgatgatgcagcaacgggggttcccgatctttcgatgagaggaggataaacttcgatttgggggaggacacgacgttggcggtccgactacaactaccacagggcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaactgaaataaaccaaaatggggttctgaatactagtatccgggtggtctagccgacacatgcgagtacaaggaagtagctgcagctaaacttacatcaaaacaaaacccaaaatgcaaaatggtggctgctaggagtttatataggtggaggaatgaccaggagaggaggtgggagcaaaccctaggttttgtggacccctaatgggctgtaaagatacaaggcccaagcctaagtttctgatgtaaagaactattttcgtcattctgagcagcctgggtcaaatttgatggtgaggccacacatagctgaaagtagacgaggagatctttccaacaagtactcatttgccccgtttgccctccggagtgaagagcattgacttcatcaaatcagtgctgctagtgctgcttgcgatctgattcctctcccatattcctaacaacaagtagatcacaacatccatttagtagcacccaattctgagaagaacttgtatgattagctaggaatgactttacctgataattaagttcacgagctcgagctctagtcattggtccttgctgtgcaataggcatggttgtatcgttggaagggatgtcctcgtcatcctccccttcttgcatttgagtcgtcctcgactctaactcatcttcttctcccaaatatggctttaaatctgcaatgttaaacgtggggctaaccccaaaatcggcaggtagctcaagcttgtatgcattatcattaatcttttgtagcactttgaaaggaccatcagctctaggtagcaacttagattttctcaaattagggaacctatcctttctcaaatgcaaccaaaccaaatcaccaggttcaaaagcaacatgtttctttcctttgctcccagcaagtttatacttaatattcatgctctctatgttctacttagtggtctcatgcagttttaacattaattcagcgcgatgttttgcatcaaagttcactctctctgaagttgggaggggcaaaagatcaattggagcacggggtagaaggccataaacaaactcaaaagggcacttcttagtagtagaatgttgtgaacgattataagcaaactcaacatgaggcaaacattcttcccacattttaatattcttttttaaaacagccctaagcattgtagataatgttctattcaccacctcagtttgtccatcagtttgggggtgacatgtagtagaaaataaaagtttagtccccaacttagcccacaaggttctccaaaaatgactaaggaattttgtatcgcgatcagaaactatggtgtttggcactccatgcaagcgaacaatctcacgaaagaacgaatcagcaacatgtgtagcatcatcactcttttgacaaggtatgaaacgcgcaatcttagaaaatctatctagaacaacaaagataatgtccctccccttctttgttctaggcagccctaaaataaagtccatagaaatatcctcccaaggcacactaggaacaggcaaaggcatatacaaaccatgagggttaaggcgtgacttagctttttggcatgttgtgcagcgagcaacgaacctctccacgtctctcctcatcttgggccaaaagaaatgatcagcaaggatatcctccgtcttcttcacaccaaagtgtcccatcagccctccaccatgcgcttcctgcaataatagcatacgcacggagctagctggaatgcataacttagtagctctaaacacaaacccattggtgagaacgaatttgttccaggtccttccctccttgcaattcaacaacacatctttaaaattatcatcgtgcgcatattgctcttttattgtttctaagccaaaaattttgaagtcaagttgggatagcattgtgtaacgtctagacaaagcatcagcaatgacattttcttttcccttcttatgtttgatgacatatggaaaagattcaataaattccacccatttagcatgcctacggttaagttttccttgacttcgaatgtgtttcaaagattcatgatcagagtgtataacaaattctttgggccataaataatgcttgcatgaatccaaagttcacactagagcaaacaattccttatcataagtagaataattcaaactaggcccactcaatttctcgctgaaatatgctacagggttgccttcttgtaacaacacaccacccaatccaatcccactagcatcactttcaagctaaaagttttgttgaaatcaggaagttgcattaaaggagcgtgtgttaacttatctttcaaagtgtcgaatgcattcctttgtgttgcaacccaa

SEQ ID NO: 30979 - DNA, 2085 bp, Oryza sativa
ctgccaatgaaagcacgtaaaacttcattcattaatctcatgaaagtactgggtgcattagtgagaccaaagggcatgactaaccactcatataggccgaatttagttttaaaagttgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatctttcttaggaactaaaagcacggggacagcacaaggactaagagactcacgcacataccccttgtcgagtaactcttgcacttgacgctgaatctcctttgtttcccccgagttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgaaacaagatcccttcagcttaatctcatttttattattttgaatagagttggtgagtttcttcttatgcttctcaagttcattagccgcaataagatgctcactcctagtatgctcctgatttttttgtttgctagctctagcatgttcatcctttaaaataacttcaggagacataggatgtaacacaagttttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtagggctgcggatgtggctatgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgttttcctcatcttggtggggcgcgtcaccttcccctgcgttgttagttgcaagcaaagcataggtttcttcatctaaatcactagcggaggagtacccaccatcagctctcacgatcattacacgagtgcttgggcagtccttgcgcatgtgaccatagcccttgcagcgtaggcactgaatatctcttgtccttcctgatgatgctactgatgatgagctcttggaaggtgtagcagcaacccctcttgttggttcactcgggcatggtgtagagtttgttgtagaggaacgcagcttgttgcttgaggacgatggtgctgctgctcgagttgacggtgcagcagcgttggaaggtgtccaagagctagcacgacctgcagaaatgttagtcctgaagctagctcttcgtccctgtacttcccttttcagctttacaagcaagatgaaacaaacgattaattgaattatattctttgtaggctagaatgtcctgaatttctcggtttagcccacccatggatctagccataccagcatcatcattttctaccaaaccacaacaaagcattcctgtttgcaaagcttgataatactcctctacatatttgtttccctgtctaagttgttgcaatttgtgcagcaaatcacgtgcatgatatgaaggaacaaatctagctcgcatgactcttttcattgcatcccaggtttggggagtgttatttggattggaacaaacaaattcactccaccaaatggatgcaaaatcagtgaactcactagtagcagcc

SEQ ID NO: 30980 - DNA, 21059 bp, Oryza sativa
ccatgccatggcgctgccggcgctgttgtcattgtggatgaccaagtacctcctcatcatgctcggtgtcagtagcgtactccaggtcttcccttgctgcgatgctgctattagcatcatggcattgggttgtgcctagccgatcatcatgaccatcttggcccattctctccaacgtattcaagatacctgcaagagaagtgttcacagccacaagggacctctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaattcctatcaactattggagctagttgttgtccatctccacttctaccaaacttgtgcaaacgagttcttacatgttcttactttgttatgtaaaaggcgttggcaaacagcaagaacagcaacaatggttagtagtaccggagccgacaacaagcacgatcctgtgatatagcagataaaaatttgtggagctataggtggctgcaagtaatatcaaggtacagctagaaccacattaatcaaagcaagttgaataatcgttcaacgatggtattgtgctggtcctaggcaaaaccctttagagacgcgagcctagtcacaagcatagccactcaaaatagcacgaaaataacacaaacaaaacagcaacaacaacaacttcctctcttcccttccttttttttttccttctcttcacttctgattgattttttttctttcttttttctttcttttttttttgtacagcaagctcaaagcttcagccaacaagtcaaaacaagccttagcaaaataaccttatctcaaacattttcgaaatttcacaagcttcagccaacaaatcaaaagaagtaatgatgggttggttggctagttacatgattcagccaacaagtcaaaagtgagagcacttaaatgctttcttgggaagggctaattcacttcaaaaagttgcaaaagggttggctgttggtggaggcagcaataaatgcatttgggggtggctgatgtggtgatgagggggctgctggttgtggtggacgaaatttggcggggttggaggtggattttgtggtgaatatggtggtgatggtggcagcgggatgaagataaatgaagtgatggtggaagtgtttgtggtgacgaaatcgtgagcagaactcgaaactctaaaggactaaactactagaaccagcaactcaaccagtcgatgcaatcgaaaactcagcaagcaaagactaagtagaacagcaaaggctcaacatgttttggtgatttcgggtctgacctatttttgtggtttttcttttgggctataggtaaaaacaaagaagtgataaaatctctcaccgagcaacttgagctctgatactacttgatgcagcaacgggggttcccgatctttcgatgagaggaggttaaacttcgatttgggggaggacacgacgttggcggtccgactacaactaccacaggggtgctgcgccttagcaaccggtacaccaactccacgttgttgctgttcttgccgtgccaagaacaaccttgaacctgcaagcaatcgaagaacaagttgacaaggaaacagctcacggcacttgtcaaatgatgaaactgaaataaaccaaaatggggttctgaatacaagtatccgggtggtctagcaacttggcaacttggcttatagaatggttagagagatacttccttttcaataagtcctaccagaccccttgctcatttattaactcaaacaaccatttactcaagagtcatttattttggatctccaaattatgaacacccaatccccccggatctttgagttggcaaataatatcccatcttgtaagtctatacgttttcttatgaccatctccttgccaaaagaaccgtgatctttaataatcatttttttaaaaatcccatttttgaatctaaaaaaagatatcataaacataggtaaacttgaaagtaatcaaaaccagtcttcccccaacggacatatggttgcctttccaactactaagtttcttctcaattctttgttcaataatattccaacatttatttccaagctttctaaaatgcattgtaataccaaaatatttgtcaggaaatgtacctagctgatagccaaagatattagaatattgatcataatattcctttgcttgaccaaaacaaaataattcacttctatgaaaatttattttcaagccagataatttttcaaacacagataaattcaattttagattcttgacttcatgtaaatcatgctccaagaaaatgatagtatcatctgcatattgcaaaatagataaagcatcatccactagatgaggtattaccccacttatataaccaacatctttagccctcttaattagtaaagctagcataccagccactatattaaaaagaattggagacaaaggatccccttgcctaagccctttatatgtttgaaaattattgccgacttggtcgtttacttttataccaacttgaccaccttgaatgaaagaagttatccattacaaccatttaggtgaaaagtagttggagaaaagggaagtccttaggatatagtctggataaaaggaaagtccttaggctatagtttggataaaaaacagctatctaaccaatccggttaaacaaaccgattgggactacactaccatagaaaattagcaatagacttgtcacacgtgtggtgcctcccacgataagaagaacaacatccgagcgctacactaacatcaaaaactccttttggctccactctaccattggtgcaaccacttgataataggttctcatggtggcacagtaggcgatctcagtaaagcctccacaggcagtttgatgattttcatgaaaaacagtaaaattcgataaaacgtgatgactggtggggccccaaatccaccagcgggaaggtcggattcgaacagatccgggccacagcatggagccactgcggaagaaaggccacggcgctaccctggagaagtgagatggcattagcagtgctagggagcgtagggagcaaggacggctacggagcttggagcgccagatatgccacccggcgttgctcttccactaagtcgaccacgacgacctcaagtgcgacgatgacgacagcaacaaccatgtcgaccttgatttgtgatttgtgatgccgtgagatttgtgatgtctgttttggatcctttaatttgcgatgatgtagatttgttctatttcttctataaattcatgatgctacggatttggaactttgaactttgaatttgtgaatggaaattttggattagattgaatgggaaggcttgaatggaaatggaaaatggaagcttccaacccggcagaaacgacgtcgactgcttctgttttagcgctgaaaatcattttcacagtcggaccatgtaacctagtcgcctatgaaaatcaattttcgcaggcggttttcgtctgcttgtgaagatcgtctattttcactagcctatggttgctggcggtcaggtggctcactagcgaaaacgtgttctggctatcaggaaaaatgtgatttgtagtcgtgactgaatagcttttccttcttttttgtttatcaaaacaacttttcagtttgacaagaatcatgcagatagatgaaaataagttcttgaatatatccacttattatacatacctattgtgggacaacagaaatgaacttgtcgtgtttggtgcctgcgtcgataagaagaacaatatcctgctagtgccacacctaacgtctcatactctgtctttgccatcaactgacaacatcatcagcggctcatgtgatggcaccaatatactactatgaaacaggctccacaaacttcagcatcaaaacatccagctatccatatcattcctggtaccatccgttcccaactagtacacggcacacaatggtacacatgaagtagtgtggcttcgtcgcccactcgctttctagctatctgaaaattgaagtctagcctccttggtgaaatactgcagggagggagaattcttgtgttgcataggaaatgtaagtagcagatgattgaatcatatgcatgtgtgcccttcattctgccctagctggctttatgtgtctttgcagtttgacacattgagataaccctttgtctttaatccgacgactgactgagcacatgggagatagtgaaatattaacacttgcttatgatctgactgacttaacacgtgagaacatcactgaccagctccaccaggtaaagccttacaattaaacaacccaagttaatgcactttgcaaatacaaaccaagaaaggcagggttttacctttccgaaagggtacgaaatccaaggacctggttgtaacaccccaaccatttgtagcttctagtgtggtgtggtttaggcctaaataacctagaattagtgtagtagtggtggttcagtattaccttggaagtttaggtgaggacatgtttattagcttttgtgctccaatcatagtaccctcgagtcgaaactaggatgaaagtgtaacagggtactgatgcagatttaagaggcagggtgttacaccggtggtttgttgatttttgtgggaattgataaattaaaaaaagggcagattttaaaaacccaattgaattcgaatgctcttgctgaatactgaaaaccaattgatctcattgattttctgaatgaaaagacagaactccttcgggagaggtctgtaaattgaatgagatctcaatcggtttaaaccgacatatttgtgcaaacaaccagtaataactttttatttgctgaaaattggaggtagtatcattttttatgttgtgacttattttatcattaaatgtatttttccatcatttatattttgtatatttatactaaatttttaaatatattcaaacattatattttgaagttaacaacatcatatatttatatgtacaatagatggtggtagttctctatggaagacagttttgatgttacgatttgtggaggacatatgtaccaaatgcccacatatcctgcatatccgactacagatataggaggtgggctagacccatacaatatataatagaatagaacacggtcgccatgttctcttgtaacccaatgcaggtagtagagcctcagccatagactaccatgtaacagactaggaatccaatgatttgtctggctaggatttactccttgtaactctgttacctaacctgtataaaacgggtaggaagcctttcaatggcaacaatcacaacacgatcaacagataagtgcgccaagtaggggttgcatcgagtgtgtcatcgaccagcacgatggaaccaacttctggagtcgccggaatcaacttcccacgggctaggttttatgcttcaggagcttcaactttctcgctgacggcttcaacaagctttccctctccaactcggatccaaactagttggggaggcccaagaccacacaaatcctatttcgtctcccgaatgtggcccaagacctactttagagtggctattcttgactcggattcaaaccagttgggcggaacccgcctgttgacaaaaaacacgaggcctgggagatctgcttaactccagtgcaggtccaaaactcgccttcaaatgtatgagcgtgccagttgatttactcctgtaataaaaaagaaacaaagacaaagaaaccgtggttaaatctataaatgatagccgatcggctagatgccgatgatatatcatttatcttaagccgatgtcatatgtacatcgaccggcaagtattaataagcaaatcagaactaaatctactcgatcggctgtagatattaataatatataatccttatatcgatatatacttaaatcaagtgattgggatagatcggtcaccttgccgagatagtataaatcacttagatcgaaatatatattaataatgagattttatatatattcatagcatagccgatcagatagatctagcatgtatcggctaatactccgataccactctatattaagatattaaagcaagtagaatgttccaaacaggagcttaatatacttaaatgcaacaagatcttaatataaacggcagatttaacatatcaatcaggcatataggatgaaagtaattaaatcaggtaagatcggctgaaactccgatactaatctaatcggcaaccagaaggcaggctagatattatggttctaagcacgacttaatagatcaaactcaactgatgcagcattaagtattaaaagaagaacaatatctagacaatcaagccgctggatgtttcatagagtggtagatatatcacataatctaagtcaatgtcgttatttaacctaatcgactgccttctattgacagaggctagccgattataggttagatgacgatatcattaaagattatgtgagatatatgataaatcgacgaattacataaacaagattagagtgtcataaagatggaagcactaatctcgagaacacaagtcgtcataacaagttttacctcttgttgaagatcgaaaccgatgcagctcaacccgaaagcaagaactcgtcgaaacaaagcgaaagtaaaagggtggcgatgcgccgagattgtattgaacgtgtgtcttctttacatagggctcggggtctatttatacccgagaattacaagatatgctcataccggacacgactattatctctaacaaactctaagataccataagtctttgcggcagacttttgcccacatttatctctaaggaatttacatgaaatatcctaattaatagatacaattgctttctcaggactctatccatgtatggcaatcatcttgaagcacatcaactcagacccggtgtcgtaaacgagtcatattgtcgtaatcggttgtatcacttaacctagtctgactctaacttagccgatcccatccatggccgatccggactcagccgatccatgctctattcttgaattgatcttcgcctctgactccgcttcgatccaacctccctttccgatgctgatattaccaaatttggtcgttaacaccgccccgtgctcttcttcaatcggtttctccaagaacgtgctgacggtttatcctagaatcatcatgcaacttcctccactcctcattgcaagttttgggtctacttcaaccctatccccatgggttcaacttggatatgacatgactctatcctagtacgtgcttagggaggtagcagaccatattcacccggtcgatgatgcaaatagtaatatcgacaacatcgatgaagaatgttatatgagtaagaatgccttcgtaaggaggcggtaaatgcaaagcaatggagagctgagcgtatccgggacttgcgcatgccttcaagctatatgcaaaagaatattctccagatagagcacgaggagcatgacgtcttactcgtcttagtcaaacctcagcagaatgtcatcatggcggctgttaccttcctcgatacagtcatggagaccacaccagatcactagatttctcaaactttggcaaaagtaaaggcaatgatgagtgatgcagtggtgcaacagcaacaacatatttctccaccttcttccatcgcagttccctcccccatccttccactgacattgaatgcccttcccgttgaagctcccaaatcattgtttatccttctagctgaagtcttccaagagatgcagacgaagcttaagggaccacctctgagatcagccgcattcatgtagaactggtctcgacgacgaacaaaatggagaagcttggggaggatatggagagagcgaagtctgataatgcccaccaacgccttttggtgcaagacaatgaggtcatccacaagaagagtgaggcagcactatcattccccctcctcttctcgatccggatcaaagccctggtgggcagcacagctagatccgtcgctcgaggttagggtcgatcgctagatctggaggttagaggccaccggatctggccacccccacctcgaggacctcagtggtttgatagttcaggcaagtagcagtgacgccggacatccttttctacatggctacacgtcatcttgacattcttggggttttttttcacacgtattttgcatcggtgatgggccgtgttgtataaagtgacgagtcaccattagaacccttcaatgataaatgtcattagtgataaaggggacccaacacagataaggttttcacaacattgataactatcatccatgaccaggcgcccatccatcacgcataagggtcataacccgtttcaaatggctggttgtagtgacatgtattgaatcatagggtagaggcagtcgtttgccaaattttcaaagaaaatccaatttatttaaataatgtggagtgtggatattttaaactatcgtatgaaaattacattttttttctcaaatttgtctaagtttttatttatatggtctcatgacctgtaagtatgtttaacttagaagtggagacggttcgatgggcctcacacgtagtaaaccacgcatagaagtggctttctatctatgtttccatctataacgtaaaacgtagacagggctgattcttacacaattatatattcatgagtaaatcatttttgtaaaattaatctgaatttaaatatttagctacgattgtacctgacctggtgaacagtgcacatccaacacgtacggatggtagacattttattgctgtatgtgacttgtcacgtgacacttttccgttctttggccacgtacttggtactagtatcaaattttcaagcgttccagcgaactaaagcacacaaccgcgtacacgtacggtcaatacctgtgagaaactcgtgagccggccgggactagggccctgttcgggagtgagggatgggaaccctaaccccctagcacggaaaatggaggaacgattagcgcgtgattaattaagtatttgctaatatttatttttaaaaatggattagtatgatttttttagcaactttcttatagaattttttttttaaaaaaaacgcaccgtttaacagtttgaaaagcgtgcgcgcggaaaacgagggagacatgccatctacatcattatcctttcttaaattatattctttttaatatatggtaccgtcaattagtaggcatacgtttcgaccattcatttcatttaatgtaaatataaaaactacaaaccatgcttaaatatcttttacgagaaaaataagtaaaaacaataataattacacattttttaaaaattgtaggagtgatgaaatgcatatgaaaagttaatggccccatatattaaaaacggagggagtattatacttttcggttttatccgtcttcatataagttcattgcgcacaaatatttcttcaagaaaatattcattatacgttcctccaacaaacggtcacttttatctcactgcatagttttttccttcttttttaatttaggccgagtttagttctaaagttttttttttcaaacttccaacttttttatcacatcaaaactttcctacgtatataaactttcaacttttccatcacatcgttacaatttcagtcaaacttctaattttgatatgaactagacacacccttgacaccttctaactgccatgtggtcacggtttaattagctagtgtggtgcatgggctaccgtcgcgtcacctgtttttgccgtattggcagtggcagtgcacgtactcaaatcattcaagacggtacatgtattaatcggcaagggactgccagtcaacaaccaaacattaagatataatctttaacagttcgttgtcgatcgtgaaacgataaatcagtatcgattgattattcaactgttaaagattagaccaatatatagtctcaacccaatagaagtgatccttaacaatatttactctcgtaatataaatctcaactaccaagtaattcacacattaaaaaaaatgcaaatttggaatcgacatattaccaaagtttctcatacaatagcaaatttggagttcaacgatttgccatcaacattgtctctttctataatataccgacgattttatcaattaagtgatccttaacaatatttactctcgtaatataaatctcaactaccaagtaattcacacattaaaaaaaatgcaaatttggaatcaacatattaccaaagtttctcatacaatagcaaatttggagttcaacgatttgccatcaacattgtctctttctataatataccgacgattttatcaattattctacaatatgttattgggctggaccttcttttcaaaaatacttaaaatactcctagagacatataagattaacaattgatttaattatctcaccagaagtttcaaaaaaaatatgaaaatttttatgtggcctccttatacaatatggaagtttgtatacaagtttcaagttttttctgtatacttagcttttagaaaaaatatatattgatgtgatatatgtgagagaatttgcttatacaagagcacaaaaatatcttatgtagtgtatgaaagatgatttatattaaaaatagtaataaaaagtattttatatatcatataacaaataagttatattttttataacaaataaaaatgtaataaacttgaaacttctatataaatttccacgttgtgtaagaaggccacataaaagttttcatattttttgaaacttcaaattagataaatcaattgatatattttggtaatatgatttatttgttttggaaatgcttctatgtcttttataaacttagttaaacttaaaaatgtttagttaattaggaaaagatcaaagtgacttatagtataaaacggagggagtatttgatttctttataatatataatatttactttgtccctaacatgacagataatccatcaacttttatccaccattcatctaaaaatatatttattttttgactttgtgaaattccacaagtttgaggctaatgtgaaaaagttgggatattatttgctttaaacatattatcacaatatcacaaacttatattattttataaacatatttaaatttaaatttgatattcacagttttaaaagtttgatcctaaatgtcaaacatttagatcagcttgtactcgtttgagcactaaaaggtttttgtgctagctgctccgtgtcatggcacgaaacaattgacacatgaccacctatagtgctcctcttgtgacggaaacgtaactttttggacatatgaatcgtactttgaaccagtttttaacttcttattacataagttgtatattagagaaggtagcaaatgttttcgcatcacaccatatatattttgtttagccctagttaaaattgtagcatgcgtacgtaaaaagaggtggtcctgtatatgcagttgactctattttaaattaaacttcaaaaacttaatgtgaaaatcaatatgctttgaatattcaatttcacgtatgaaatcataatattgtagttatattatgtttctaaaagtgttttgtattttagttaaatcactggtcacaaagttatattttaaagaccatgtgtcgagttcaaaacgaagggcccctttaattaatttggagaaaaaatataggaattttagaggatttgaatcctataggaaaatttcctacgaagccccttgaaacaaatgatcgaatcatatccaatcctttgaaattcctacggaatggacaatcctatagagattttggaggaaatttagcaagagttttaacctcttggtaactttcatttgagtctatctctctcatccaattactgtgtttttcctattgttcagtcaaacggttattcgtgtgtttttcctgtgttttacaattatctattttgcacttacatttctatcaaaaccctacgttttttctattcctacgttttctcaatcatgcgatttaaagggggtctgaaatgtttttttaggggaaaaagtatatgctatatattgttccttctgttgggacaggtgcagtgtaacaaacatatatgtaacctgccttgtatccattgaaaaaaaaaatgaacaagagaaaggaaaggaaagtaaagcaaagctttgcaataactccattgcacgagcatcctcacctacacaacccaacccaaccaagcaaagccaagaatacgtgtagtacgatcatcacagcaatttgcaacgcttccgtttccacggaagctcagctatctatctagctagctacccattagctgtccacgtactttcttctctcatcaccatcgatcacgagcactacacctctcattttcccccttttaacaaccctacacatctcgcctccatgacacacacacgctcgcacgtacgtctccacagcatctaggcatctagctagctatagctagccatgtccaccgtcgtcgccgccatggccgtcgtggctctgctgctcctgatggcgctggtgccggagatggcgctggctgatgctgccggcgaggggaggaggcagcagccgccgcgcccgcggccgccggcgttgctggtgccgttcagggcgcggtcgtcgtcgccgcaccgccggcagcagccgccgccggcgttattccgcgggcgggcggcgaacgggtgcatgccgagggggttccgcgtgccgccgtcggcgcccagccggtacgccaactaccacaccctcgacgccggcctgtgcgacgaccacggcggcggcggcggtcgccggaagccatgagcctaccagctgcaatgcaaccttttgtttgtatatcatgcatgcatgatgatgatttctttggaggagttgagctagtataaacaaatgcaagcatatgcatacgcgttgtggttgtttaattttctttgggcataaataatgtttgaatttttttctggaacggaacatatgtaataatgtaatatgttttattaatatgtgccctttcttcgaagaaaaaagggttaattcggtatggttttagtccactgatcacttccagaattctcgtcctttgggtcattcatatcccaatatggcaacattgacaaattagactcttagatcaagcattaaaaaaatttccgtacaagatcaatgtgtacataaaacttcatttcataaatgaagttttaaagatatagctgaggggtcccttttctttgtgctaacttctccccggtttggcggatagctggcgttgtcaacttttatttagaaccacctccccctgctttgctaacctccaaaaccacccccttatttcctctcaaaacaaaaaaaaaatcccacatcctctcccctctcggccatttcctgccgtggtaggaccgtaggagagcttgctaaggccccatattaaatttaacccatatgttataacaacttgagactatatatgatgtgaaagaaagatgaaaattctcttcgtaattgacataaattaggttgataaataatactgtgccgcacaatttattatacaagtgacaaactcatgcattcgcacggctatatattgatgttataggaattccaatattagtgtgggatatatattacctactcaaataacattcggtagaaaattccttcaaattctttcaaatgtaattatagtgtaattgcggcgtaattatatctttaactctagagtaactaccgtataagctggcttggtataggctagcagcggagaagcttttattcccttgatcaaagggttcgaacactgcttcatacgtgggtttcaaatttttttttctcccacgctgcatgaatcttaaagcacatctgatggtccaaattcgaatgttttgaaagaaaaaataaattattagataatatttttattttagtgtacatattcaggtataaaattatttacaatatcttctattcataacctaaagtccataacaaatcagtctataagtttggaattgatatttccaagtatataacgtgttatgggtgctgttccacttaacgtttcttttaggagagctttaggaggtcagaatctaacttattggcacgaattatgtgcttctattgttcatatccagttgaataactcttctgattgttttagatggagttatcatcagaatggtcagttttctgttaggtcaatgtacttagctctaattaataatggttacattgacagaaataagattatttggaagcttaagttgtcgcttaagatcaagatctttatgtggtacttgcttaaaggggtggtgttaaccaaggataatttggcaagacggaattggaatagtagtctaaaatgttgtttctgtatgaaaaatgagactattcaatatttatttatggagtgtcattatgcaaagtttatttggagagcagttcagttctcttttggattacaccttcctagtagcatatctgatatttttaatggttggcttctgggggttgacaagaaaaagagtaaactgatacttgttggagcctctgccttatgttgggctctacggttgagcaggaatgatagggtttttgataattcaccatctgtttcctatatgtaggtaattttcagagcaacatattggctccggcagtaggcacaattacagaagtgtgatgaagatagagagttcccgattgttgcatgtcgtaggcttgacatgatggttatgcaacttttttctaattatggatggagattcaccgatagactggaatagtgttctcattgtcctgttcggttttcttctattttggtttggtatgtttcgctttattttggactatactcttttagagtgctagattgtaataattgactgtagctcttttgagcaaaggtcaggatgttttattccattatctaaaaaaaaaagtatataacgtgttaaccatattcttttctttatcttatatactttactgatttacatttcttgtccattaaattagttatatatttttgatatcttttttttgtatggaataaactttgttttgtaatgggacaatttattacataattcgaaagaaccggattcaatttcagcatgtgtcttatgtattacaaatcttagaaataataaatgaactcaagaaattttaaattttaatttcacatagggtttcactatataaatgaaaatttaaataatttttaaaatttgaaaacatatttttagtctgcacaacgttgccacatcacctaaaaccgcccccaaattatcgtcaaggtttaaaattgcactttttaaacagtagggttgaataatacgcagttaaactatataaagtttacggtcaattttgtggagttcaaccaaagttcacggttgtaaatggtcttttccatgttccaaatattcagatattcccatgcatatttgtactccctaccactagtttaatgtttgaaaatatcggaatggctaaatggttggcgaatgatttttaaggccaaaatcatgcagattactgaccttgggacttgctttgcgattcgtgctccggcgaccttaactcttctcctccatctccggcgacaccttctcctactccagcgaccccgaggaaagcaatgaaatcaaggtttagggtcccgggttgggatgggtgggagggggtggggggaggaggaagagggatcgccgagtttagaggaatggccgtgggaggcggtgaggcaccggcggcagcgccgaagctgcgggaatggaggagggcggtgggccggcgttggcggcgcgggcaaatggctaggagacagcggatccggtggttagtggttaggaggcggcggctagtggtgggggatctggctgcgggaagccacaggaaatggggaaaacggcaggacgagggcactcatgcgtccattggggaagagagggtggagggggtaggggaggaggccagcctggaggggaggggggctcgttggcaccgttaaccctttccagccagccgacgagtccgggcagcggcggaggcaacgcacacgagaggaggcagcggcggcctggaatgactaggggagagagaggggttagggttagaattgccatcatgaatcttaaaagcgttctaacggtccagaatttgcatgatttgtgaggtgttttttttttcaaatgccatctagacggtccatgaaaatatttggtcatccaacataatagaacttgtacgtcccatcttgtgccatgtgctccaaagatgtatttccacatttgctaagcccagctccctatttaggttgcaacaccacatggaagtgttaaaacagccgtccgggcagccaacatatctgtctctcatactcacacaaacaggctaggtggtctggcctagaaaacagggagaacttaaaacaacagaaaggagatgattagctaggtagtacttgcaatccatggtgaatgcttttcttttcttctatcctttattggttggattttaggacaatagtatgagtaatatctccgggcattgctacagttgtttcaccaactcattgttacacaaatgttgtactagtaggtacgttgtagctcttatgacaacgcaaggcgtttgttgtctgtaggctagtcttttcatgacatcttcttgtaataacttttttttctcacttttgttataacgcaaggtttttgttgtccggagcacttgacagtaggaaaaaggagaagattgataacataagcaaaatgagatgaaccattaatgcattattaattgagtatcaattattttaaccttaaaaaaattaatatgattttttaacaacttttcttagaaatttttttgtaaagtatacaccgtttaatagtttgagtagtgtgcgggcagaaaatgagaagtattttctctcaatcctgcaaaattattttattattagaaagaataaactggtttacacaaactgatctgccgtgtttccacaagcttacttcatgaaaaaaatatgtagtgcaaacaaaaaatgaaaacttgaaaactactgtatgtagacccccgattttagaaatcggaaatcttctgtgtttatccgtaccaatccctagatcagtagttggtacacacatacatagttggatcacaaattcaggctaaaagagttaaatacttacattagggccaggtaggccaacaactatcagaaaacaacagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaatagcaaggatgagtaccaaccgtactcagcaagccaccacaacaacaatgcgtatgatagaaggtatttcaaggaatggcttcaggttcttttgcataaagctagttttgcaattcttttcacaagcctaagacctagcatagactgatcaagttttaataccagcgttcatattaaacaacgacggttctgtccaccatccattgtaatcccaaggatagcttcccgttattgagtcgtcatggttttctgaggacgtccaccttccctcctctcaggaagtggctccaacagcataaaatcatcatgcaataacccattccacacaagttaagaatttagagtctagccaagtgtaatacatgtcccggtgctcaattaccgcgagcacggctattcgaatagatttggtttactcacactgcagtggatgtatactttacccgcactccgcgactgcccaacacatgagcctcgtcccaacacatgagacgtgtcacggcaaagcttttcgataacctcgcattggcagtacccgctccatgaacttttcatcctcatgcactctagacgtacatagtttctagcagtgagaggagttctagcgcacccgggaagggaagactcacacacatgcattaagttataattatgttcaacttatcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaaacatggttacgaaggcataaggggtaaacaataatcaaggcatggcataatcacaagtgggatgttcatccttacatgcaattttatttgtagataaaataatttcgcaattgggatcaacatgttcaaagaatagtgatgacttgcctgctcaggataatccttattattgatataatcttgatcaatcttcacctcctggaagttgcagacgttgcctcacgactaaccgatacacaaggtctataatacgcgagaaaaaccaatattcaaacaacaatcaaatatgcacaacaaaatgtactatttgtgtttgctaatgaattccaatcatgctaagggctaaagtttcttaatccttctattgtcatcgtggtctatttaggagttaaccaacttagcatttataggatacatatatatttggctaatcggtggtttagtctatcaaatggctatggaagtattatggctacacatgcatttatctaaataaagtggtcatatactagaggttcggttgtcggatggatttaggatcaatcaaataattacagtgaatcatttgtattattattattctattgatgggggctttactttaattatgaacaaattttatttgtcacaataaattatgaaaggataataattatccatgctttgaatgttagagttgtttaggttaaccatattatggttacagattatcccttaatgaacaatcctaatttacagttgaactataattataattatacgaggtcaagatttataactagtatttatctaatatacatgcttgtcatatactccctctaatttaatatatgcaacacgcaaattaatactataccgtacaactataatgggatgtatagtatatgtgtaagcaacaatatcttattattggatcatatatttgagtagttgctttttagtgtaagctatacaatacatgttgattttaagatggctctgtttggttaactaatggatgtcaaccgactatatatatattctacttcacataacattgtatcgactaacttttaagtggtccaaatacaactagctctgtgattattctcctaaacaagttaaagattcatctatgtgtgtttatattttagttacaaaatatgaggctaaactttatgtaaataatttataagtcatggatttagttatatttggacatagaccagtaaatggcactaatattttcctatacacccattaatttgaaggattgattataactaatttatgtggtttctacagtgacaaaacatgttaaagaccaatattattacatctactctactgtacaatatcaaatctatttattagcacatttttaagttgactactatgcattatcttgatattaattgtttaataattataaatatattttattaaatagtgaattatataccattggaaagcttatgaatttatatgaatttaggatcaagtttcattcaaatccgagttaaaatgagagagttatgctagtttaaagattcaaatttgaataattgcgaaacagtactgttcctaactcatttatttttattccataatttacattgactgacctgtgggaccggcctgccatggacacaacatatataagtgaattttcatagatttttaatcatagtgaccccacatgtcatagactaacttacttgagattaatatctaatcactgtgcgctaatcaagtagggcccacatgtcatatccttctctctctcgttctttctctatcgtcttctacctccagaccgagcgggagcagcaggggcggcgcagcgcgcgcggcaaggccggcggagggcgacccgacggcgaccaggggagggagcggcaaggctccggcgtccacctgccggcggtcacggcataggacggcgcgggggcgagcggcgctgcaaggccgccatggccgggcacgggtagctaggtgctagggcgatacggagggtttccgaccgaattggtgagggcgtcagcatctacggcgtgtgagggttccattttgctagctagatggagaggaggggctccgggatggcttgtccacagcgagctcaccggaggcaaaacggtggccggaccggcatggctacggttgctaattggcgaaattaaagggggctctagtttttacggaaataggagaggacataggagcgaggacttaccgagggatggaggaacgacgaagctcgacggcgttggtggagcggacaagaagctgccggcatgcacacaaggtgtttgagaaaatgcataca

SEQ ID NO: 30981 - DNA, 1993 bp, Oryza sativa
acacgactagtgcggggctcgggccggcgcggggctcggtacgatgatggcgtcggcacagcagctggcggcagcggcgcggggcttgagacaagcagtgacgcgacggcgacacgcgacaacgcgacggtgacggcgatggcgcgacagcggcgtggggctcggcgcggcgggggcgacggcgacgtagcagcggcgcgatggggtggcgcgcggtgcggcagcacacggggcgcgagggcgcgtaggcggcagcggcacggcaggccgacggcaatggcgacaaaacgacgcgcggtggcggtggcaaagcgaggcgacgacgacgcggcgcggtgatggcgacacgacagcgacggcgccgatgcagtcggggctcaaggccggctagggcggcgcagcagtggggagaaagagagctgggatggctaaaaaccaaatcgaacacctaggggctaatgaacagtgctagccaataatttttgattttagagggtactttacaattaggaaaaatatactgttgctactaattttgtcacaatgtaaaaatacaccacgtctaagttatttcatcgaaatttatattcaaattaatattgtccaaatttaagttttattaaagattctataatttcctaatgagaccgttattaacacattagcacattagctcaatttatttatatgttagtttattttatatggaggggtttaatatattaaatttcaatccctaaatgcaattaggaacttggtgcaatatcgatctacatatcgaattaaatactcccataattctattatatatacagagagctcagtttatttgaatgatcatcattccatgtgtactcatattatggcacccacctttattattcaaatattttaatatttgataaaataggttaataataacttttcttttatttgattttaatatcttgtgcataattatttgtaggattaaatatattctcgtaaattatatctattgcttaaatttagatcttttctttactttctttgtgatcttttacggtttggcaagcaatagcaatcataacaaccagcatgatgcaaaagttttaaaaagttcaaaattttagtgatttttattgtcaggaattttcaggatgttacactgtaggattcaaaaataaatccctaagatttgttaatgtcatcatgagtaaaatttttactcccactacaacttttacttatggttaaatctgggtaaaattagttcccatggtcatgcaaacaaatctcaaacgtccactgtagttttttgtttgcactatatatatttttttagtgtgcaaagctttggtaagaaccaactagaagtacaaactttctacgtgcaaagtttcgacaaaaatcacaagaatttgaatgacaactaaaaaaccaaaaccccatgtgtgtgcaaagttttgtcaatattcactaggaacttgaatgaaaacttaaggaataagatcactttgactccctcaattgaccaccgaatctaaatcgtatccctcaactgcaataccagaaatcttgaccccgaactgtcaaaacaggtacaatttgactcccttagtggttttagagggcggttttgctgacgtggtgcacatgtggcagtgttgacttggtcttcgttccacgtggcattgacgtggcgcttatgtggcattaaaataaaaaaatatatgcgggacccatttgtcattcacacaaaaaaaaattgtgggtcccactgacatgtgggtcccactgacatgtgggtcccacatgtcatcctctctttatcccttcttcctcctccctctcctcccttctctatctctccctctttctcttcgtgcgtagggatgggcgtccggattggcgacggcaacagcgagcgatggacggagcagcagcggcgggtgggatggcgggtggacagtcgctggagttgtggaccacgagacggtggcttgtcgggcgg

SEQ ID NO: 30982 - DNA, 12764 bp, Oryza sativa
  unsure (1)..(12764): unsure at all n locations
agctgctcccgcgcctgtcgcccgaggtctaccgcccaccgccgccaccactccggcacccgcccgctgccgcctccactcgagcccccgcctgccaccggctcatgtcaaggggggagagagagagagaaataaggaagagaggaggaagaagggtagtgagagagaggtacatgtgggacccacatatcagtggggcccaaatttttttttgtgtgaatgaaaaatgggccccgtatatatttttaattttaatgccacataagcgccacgttaatggcatgtgggacgaagaccaagttaatactgccacgtgtacgccacgtcagcgaaatcgccctctaaaaccactaagggagtcaaattgtatcggttttgatagttcggggtcaagatttctggtactgcggttgagggatacgatttagattcggtggtcagttgagggagtcaaagtgatcttattccaaaacttaacaaaagtccataagcccaagtgtggcccatttactgatttacagcagaagcctctggggcgcaaattgacccagctatgcaccaacaaggaaattattgtgtcgcgccctctgtccctaagacttaggcccttctgaaatgcatgaaattttaaatatagatagagaaaaaacatgtattctcaatttctacaggaagacaaaccataagaaaacgtcaaaataggtgtttaattgcaatgttggaaaaacataggataggattgcaagagactaaaggatcgaaaaaagaagctatcacttattggttatttttcttcaaaattactataggattgcagttccataaaaatttcagaagaaatgatgtgactcaatcctttcataggaccttttttttataagattatagtcctccaaatttcttaatccttcgtctcaaagagccaacaccttaattttatattaagcgtagggtagggttcattggctctctttattacccttgttttctctaatcgttagatgcaaacatcaccaattaaagtttgaatataccagtctagccaaccattaattcctaaaaaaaagaatgcaatcataaagggcatatatttgccgtttaatatctttactaatctgtcttagactgtactatacattttcaacttctactctcccattttctgcgcacacgtttcctgacgtactacaatattttttgaaaataaattatagaaaagttgctttaaaacattatattcattcattttcaagttttttttgctactactccttcagtccccaaatatatatatatatataatcagatgggatatattctaagactatgaatctatatatgcccctgtctaaattcatagctagcatttatcctatttaatcgtaagtttctatgttttaaaaagtaggtagtatgatctggtgttccgtttcatgtgccggcaagggatctcaaacccacccacctccaaaacgaacacagagaacacagtacacaggaaggtaatccatgttccgaatctgatcctctgcgtcaaatgcaataaagatcccatgctggacacatcacgtcagcaatggcattttcactataatcttgttgtgcatctgtcatttgttacaagtaagacatgaaagaaacaacataggtggtgtttgggacaccaccatactccatccatcccaaaaaaacacttaatcttggtgtggatgggacatcacctaggacaacgaatttgtgatatcccatccaagttaaggttgttttttttttttttttggatagagtgagtatctctgtaacagtcatttagtcaactcgtacgtaaggtaatacaaatcaagaagggatctttgttaatgccagaaataaaaccatccacattttagttattactatcctcctttagtgagcttctaacaaaaatgctgcaaagctacaacaaagattcaaatggggtacacatgaacattatcatactgttttagttttttttagttcttgagatgtgaagtagtctcaccctagcaaaattactctgatttgcttgagaaaatgtgtataacagacggagttacaggttggatgagcgattggcgtattcctcaaccattgcaccaaacagggatggctgctcaatcaatcttgagggtgaatcaaattcttttaccagacctgaacataaatactttgattttaggatagcattctgtgagctaaaactagcaatagaaatacagtgctttccctcatctaatagagagagaaacaaatttcaataatgaagagcattttaaacaaagctatgtgcattttttagcaatatagcgaaaaggactgaaagacctacctgcatccagcaccagaactctatcacaatccatgactgttggtattctgtgtgcaatgctaattattgtacatgaagaaaattcttgtcgtgtgatcttctgtatcgtggcatcagtttgagaatcaactgaagcagttgcctcatccataaataatattcgagtccgcttcaatatgacgcggccaagacaaagaagctgcctttggcctacactccagttctccccactatcagccactgtgaagaatcaagaaaaaatggccggtaaattcaataaatttgagttccaaattttgatagatgtagattcgtttaacaatgtctatgttcatttcacatcaaatatggcaagaatcacctggatttaatatttagtttcgacatggaactgcatgcgttttttcttttacattgtacaaaaagttgtgcatacttctagttatttgaacattctaatgtatttaatcagttcaatattttggaatactttggtacttggattttgtaaatgatcaacgagccaacttcttcagacatattaacttctggaatactctgtcctcattatacagggaatgtacgtttggacatgatcttcagctcatgtttcatcattaatttctcatataatacattgttaatagctacaaaaccagtacggtgtgaaagctctttgaatatgagtcgtgttataaattttcatacattaaagtattaaacatctcacaatttgacgaactgttggtcaaatctacaatgtttggattttttttaaaaagcatgcgcgcactatattcagactggaaaatgaagcagcaaattcaagtaattaagactaagcagtaaatgcaacttaaagtcaacatagatacagcagaagcatataagtagcaaacctagagcatcaagtttttgaggttttgaagcaactacatctttcagttggcagccctccagagcctgcgaaattgaagtaaaattcccacaggtaattaacacaatacaagtacacattcataagggattaaggggaaggctgaatgaaacattatagttacaccatacccgccatatctcagcatctgaatactgcccaattggatcaatgttgcttcgaattgttccttcaaagagaactggttcttggggaataatgccaaagcgggacctcagatcatgcagacccaatgtgcatatgtctattccatcaatgatcattgtcccctgcacaggctctacaagtctgaacaatgcttggatcaaagttgattttccactgcctgttcttccaacaactcctatcttttcaccaccactaatgcttacagttatgcctttcaaaattagaggtgtattcggtcggtacctaacctgaaaggataaaaatgctatgctcaaatatttttttttgactgggaatactgctagggctttgcccagcagtgtaaattttataaaacgcaaaaagcatttacaaagttacagagaaagaactaaaggaaaaaagcaacaaagctacaaggtttgaattctccgctttataggatggatgtaatggagcggaatccctgtacaaatcaaaataataatagtataagaccatgcagtttaagtacttaaccttcttacctttaaatcatcgatgtcaatatcaccatgagtgggccaatttggagaaggaagatggtcttctatcttccacactgcctcagaaggaagggtactgaactgattaaccctctccacagcaaccatatcattttccaacatacagctaatggatattgcaaaatacactagagaattgagggagaggccatatgaaagagacatgccaacaaattctgcaaaagcatagtgaacattagttcatccagcctatgctaatgatcataaatcttgacagaataaaatttactaagcataagaattgaaaaaatatttttgtcagatgattaagatgcaaggagtaaaaggacaaacaaccatgttatatcttcgacctacttactaacattgagacaaataaaaagagaaggaattagctacaccgctttaaatatataatgcattaaagtattcctaaatgagtcggttttttcatgagactgctatgactaccagtctcggttcatgctaagaaaaatgatcaaatctatcatatattggtacctttcttgataaaattgctaggcagactaatcataaggaaagcagttattgccaatacgagtgtcccaatcaactccagacggaacccaagccattcatttgctgcataattgtggaagtacatgcgcaaacttgaattgattctgtccaaattttcttggaaaaattctttgtccttcttgaagcatctgatggttgtagcacctagaacagtctctgaaaagtgatcaattactggtgcctttgttactccttcaagtctagttagctcccgagaagttgcaagatagcgattctgcacatatataaggaaacaattgagtgtctcaatgaatataataatttttttggagcagaattagcaacagtatctgaggcaaattgctatagtaggagcataccctgtaccaaatgttcaatagtacaagtggaattacagctataaccgatggccaggcaacctgacaagtaacaattatggtacttaatactgaaatgtacattgaaattgtcagaccaacaaaaaaggacagcacaatatcaatggttgtttggtccgatgatgcctgaaaagtacaagaggaagtatttcatcagtagaggataaaagaaatgtggcgacaatctcttcagtattcagaaaagagaaagaaaaaactaaacttgatctatactttttataaatgtgaagagtacaagcagtgccagtttacaagaccaaactatttcatactgaanagggtggtagcattgttcatgccaatttaattaatagtaaaattaggtttgcagatgaagaaataatcaatttcaataaggtatcaatagtactgatgaagattgagcaaatcgcaagttaacgttatcagcaaatgaaccataagtagagaattacccgactgagaatcctccctgaaggtgtggtatcaaaaaatgacatcggggcatgcaaaatactgtcaaacatcttcttgaaaaagatctgagcagtctgaagtcccaatattgtctcaagaagactcttgattacttgaaggataattgaaacagcagctatagcaacatacactccaataaatagagatggattaaatggaatgctgcctgatgtttcatatgacagccaatagtcactagccatttcagtaacttgccatacaattgcaaaagcaagcatgccgacaaccccccaccaaccccaagcctctgtcatatataacttgtacacacgccaacttacttgaccactttctctttcctcttctcgtataattttagaagtagctgcttctatatcaggtgcaacaagtaccttctcaccctttccaatggatctagagcgaagagaaggaattctggctaccgccttaggctgagaatattcagttttgacaacttgtcgactttgatccaccagttccattgaactatcatgagcagcaacaagagctaagaaatctgagccagcatctagtaactcatcatatttccctgactgcacaatcatgccatctctcatgacctgcacaatcacatggaaaaaatgattaaaaatcaagtcaaggacaaaagtgtatgttctactccctctgccctgtaatatgaggggtttgaccccttaaatttgtcccagaatataagggattgtgatcccaagacaatactttattccccacctacccacttttgtactagtttattcctccacccacccactttgtactagtttattccttgcccattaagttttgtactagtttattctttcaactaccaccttttgtacaatcactcatactatcgttacttccttaatctttgtaaaaaaaaaaggcataatcccttatattatggaacggatctttccacgagaagagaggagcgaaactacctccaactgttgcttacaattctcttctagaaggaagctccaataacatgattacatgatgaaaagcatgttaacatcagaaattcattggggaatcctttcaatggttgattatgtcctttttagattataggggacagattatgtggggattatttgtaccgtgcttccaaaactaggatatctcgaagaattttctacattacattgcttagatcacttgttctaaacaatgttagctttataatatagaatatttaattcatacgtatttttggaccaaacagtttcaagtatataaaaagaatatgagtatatatgccatagtttttagagatttttcaagataataatttaaaatttacttgcttgttgaaacatggtacaagagtatgctgaaaataatcatgctagaagacttacaaatatgttatccacattatgcaagaaatccacttggtgagttacaagtaagatggtctttcctttgagcatgcctctcagacattcctgcaggagaaagttcattgttgtgataccatgcaaatatgttagcataacagaaaaatacttagttcatcctcgatatatagttatcccaagaagaaacaaatatatttatttaacatataattctagcctcctatgtacatcatagcaacttttttatgggcatcatagaaacttttaaatctatttatttcttctttaggataacataaaaatattctcacaaatagactgaattaatttaactcaccacaacagtagtaaatataaatatttgtccatttcttatatgttactatattgacatgcacttgatagtgcagtggcaaggggtgtgtgatttcaacccaaggtcccgtgttcaatccccaacactctcaccatttcatcttaaaaaaaatgtttggagggacatctctccctccaaatctttttttttaatgttatatcctattttcattttttttcattaatctcctacaggtaacggtcctttattccatatacacactcatctattttctcaatttaagaaggattgagtttgctccataacaactgataatcattcttcatccttcaaacaataccaaatgcagtaaggtagggcatgcatgcatccacgcagcgaaaatcatcaaattatcagttgcatgtatcaaatggcatgtgaagctagctgagtgaaattttaccttaaaaatgcttgagccagtatgtgcatcaactgcactgaagacatcgtcaaggagatatatatcacaattttgataaactgccctggcaagctgaatacgttgtttttgtccaccactgagattgatccctcgctctccaatctctgtctggtcaccaaattccatcatttccaaatccttttccaggctgcaagaccgcagaacttctttatatctttcagcatccattggctgcccaaataagatgttctcttgaattgtgccattttgaatccaagcagtctgtgcaacatatgcagtgctcccgcatatcctaacctgtggagaatgcaaaaaaggataaagaaaacaaaaggacggtgaaaactatagagcagcttgtagtccaggtatttatttagacaatactatctatctatcttctattatatactaaaagttcatgaaacttcctacaaacgctcctaaagccgccacttggcgctctaataaattagagaaatcaaagaaattctgagaaaaaaagcaaaacattctatccttgattttcacttaatagagtggacccattattttccaccgttagatttaaaaatattccaccataccctggcgtatccaaggggtggtccgggtggtccccggtccacccaaaaaatcgccagcccaaaacctatttacggtgaaaaaagaagataagaaaactcctgtgcgtaagttggtcaattggttcgtctacagataggagtccctcacccgtttgcgttgtttcctctccctcacgcgatcgcacgcttgcatcttgcggctgctggccagggatcctggtgaatggcgacggcggagttgtggactgcaagggcgaagcccatgcatgcatatggtctccgcggcggacggcaagggtgccaggacgctagagtttgcatgctgcaggtcaggtccattaggagattaactagctgattaggtttctttcttttttaccgttctcaccttaccatgaatgcaatgtgtattgcagattaaatatgaagaaagatggacataagtatgtatctcttttaaaaaacatagagcaaataagatgaagatcgctttccaatcaccttcttccttggttgtggcagaagaacaatctcttttaagtcggattttgtgactaatatttcgtgatgaacttttctaaattatatactggcaagttctatatctactgtatttaaaaatattatataaattggaccacccatacctaaaatcctagatacgccaaccccccccccccacctcccaggcatcctctcccccttatgtacatatacgtaatgtacgtacgtaaatttgtccgtccgtccctccatctcatatcttctatcattcttttcatctttaaattttctacttagcaaaatttaatacgaaaataaaatcaaacattagataactagatgattataatctatatattatattatatactaaaagtaaaacactcttacaccatcacgtgaggctcaatgaaaatcagacaaatcctaaaaatctatctatctgttattatatactaaaagtatattaaacttcctaaaaacgctctcaagccatcacgtgggactccgatagacgttcctaagtcgccacatggcaatctaataagtcgttcataaacacaaataactaaattaggtgtacaatctcatggaacaaaataaaaactacatcctcgtgacttttctttaagtaaaaaaaatatgtatactgcaatatgaaaaaacataaattaaaagacaccaataatatacaccctacatataattaaaaacatatgactaatatatgtggcatataatctatgtatttattggtctattaaagcatatactcaataagacaaattcttgaaaattttccttatgaaggcacaacattctacgtgtaatttatcattagtcaagtggtcatgttattcgtagctatcgaattatttctacattataaattataaataagcatttagattaaaaacaataatccaagtgtgttaacaaattggaaaaatacatcaagttatatttcacaagtagtaaagaaccatcataaggtatttacggttatagccaacgaggaagaaaaaaaaaaggctatggtaccccttattagttaaaagaaacatagagagtgggaagaaggttagggtaagattgggtaaacaagaaataatagttgtttggatatgacaagtagtactactctaaaatcccttatattttgaaacaaaatttaactttctcggatttatgcgacgaagtataatccatctagctttaattatatgacatagttctattagctatatgtttaatagacaatcttaaattaatttatcctaaaatccagaaagacatagatagtataaaagcaattattacttaaagtatagaaatacccatagtacaaaatatagaaagtttcatagaaattcagaactgcacgctttcacacaattttagttaacaaatttttatgttgcaagggaaactagaagaaaatcataaccaacattcatagaaatcccaaataaatttgaatagagtataaaagatatttcaataaaaaaaccaactacacataaacatgtttataagaaaatttcaagcacattaaacaagatgcccgcgcatgtgcgcgggctaccttcctagttctttcaaaaagccaacacaagttgtctaaagttcatgatcttcacaagaaaactactcttttaagaattcatggtggggtcaaagctgaaaagcagcatatcactcaaggtttagtacagtcaacagtcaacacattgttcacagaagtccacagtttgccaaagctgtagactgacaatagaatcaaccttcgatattttatcaagcattaaacaggcatagtctaggtcaaaccaacagaggcgttgtgtcaaacatctggtgtgcattgttactatgtaaaatatgaaagcgtacctaaaatgttggttttccaactaccttgcattctccttgaatgctagtccccatccattttacaacagttgttaataatacaagcagacaagcagattaccactaccttttttggttcttccagaatccccaacccaaacaaatggcaaataccacaaataaaaaatggactcaaccttctctaggtatcaatttgctcaaatggaacatatggtcttgcactgtgggtgcacccacctacccctgatttgagccgttcagacggaaatgtctaatgtcaatgtgatataatcatctagaccaacaaatgccatcacaattaatcttgagtgaattcgcattcacctgactaactaacccctgatttggactgatcaatccaaaattatacaaaatttgtgctactgttaaaagctattttcgccgggccggagaaactattaaaaactttgactgctcataaaaatgcttggtttgaagataactgacaagaatcacagacataccttcccggagaccttgtccatctcccccatgatacatgacagcagcgacgatttgccggagccaaccgtcccgaccaccgctgcaagctcacccctccttacctcaatgttaatccccttcagcactgtctccagaacaggcgtctcctcgacatctttctcctcctcctcctcctcaccttcttcatcatcctcgttgtcgtcgccctcttcattctccttcttgcccctcacgtcccatgcaaacacgccatcgcgcacttccacgaccacaccatcagggttaatcccagcgtcatcaacacgctccaccgtggtatcatcaagctccacgtcgagcagatacctgtcaagcctccccagtgacacggtcgcctgcgtcacggaggcaatcgcctcggggaagctctgcattggtccatccagcatgtggaagaaggcggtggccgtgaacaccttgccggcgtcgagcgtgacgccggtcagcacacaggtgccgaacacgagcacggtcatggcgagcgggccgctccagagcacgacggtgttggcgcacatgaagtacatggacttggcaagccacccgagctcagcctccctgagctcgtggatcttgccgccgaacgtctcctcccacccctgcagcttgatcacgcgcatgtagttgagcagctcggtgatggccttcatgcgctcgtcgcgcttgccgaggaacttgaactggtactccaggttgcggcggttggcgagcgccacgaccacggtcaccacggcgatcgcggcgaccgcggtgagcacggcggggccgaggtgggtgtacagcagggtgagagccacggcgatctccagcggcatcagccacaggttgtggagctcgtgcgtgacgttggccacctcctcggcgtccacctccatgtagttcacgatcgcgccggcgccgtgcgcgcgccgcgcgcccgtggacagccgcagcgacttgcggtacaccgcggcgagcagcgcggcgtggatgcgcatcccgagcttctgcccctggaactcgtagtggtgcgaggccagcgcctccgccgcttgccggcgaggaggacgacgaccagctgaagcccttccgtcaactccccgccgcggcggacgaaattcacgaacctgtcgacgagggaagggccgatatacatgaccgagaggtgcgccaggccgagcatggcggtgagcaagaactgcggccagaacgaccggagaagtgcggtgaccacgggatgcccggccttagtccccggcgccggcggcgcggcccagtttgacacgaacagcgcgtaagtcgcctcggcggtatcatctggcgccacgggcgggacatcgtccgcggcgagagccgccctggagcccttggagatgagcgggttgatccagctgaacgtcgcgagcgacaaccacgacgccgtcgagtacgacgccgccgccgcggcgtgacccggaacacagcttcggtcttccccgtcgggaatcgccgcaccaccgaggccggtggagccggtgacggagaagtagagaagagggagcgacatcaccagcccagcgaacgcgactgcatcgtcggggaggatgggctcgcgagccgcgtagcgcgca

SEQ ID NO: 30983 - DNA, 1638 bp, Oryza sativa
  unsure (1)..(1638): unsure at all n locations
agacgcaggtgtgccgggtgagaacgcgcggcgnccgccttttccgccatgacgacccccacagcggcgaggtgcgccacgaactgcgccacgaggaacgcgcactccgcggcgagccatgcggtcctcgggagcagcacgaccgcgagcacgagcagcacgagcgacgcggccgcgaaacacacggacgccgcgagcgcgagcgcgtgccgcaaccccccgcgcgggggcggcgggggcaccgcagccaccacagacggcttcgcgagcaggggctcctcctccgcgtggtccccgttgccgttcgcgataccctcacgccgggaccgcgacaagcgagcgcggacggcgacgaacaccaccgcgaggaggaaggcgaggtcgacggcgccgccgaggaccacgcgctgcgggcatggggagaggaagaggaaggcgaggcggtcggagagggagaaggaggaggaagacggcggaggcggggagcacgcggtggtggacagccaccacgggagcgaggtggccggcatcggcatggccggtgagtggtggcgcggtgtggcgcggcggccggagagcgttacatctgggtgtcgggtggtcggcgttgcagcggggaggacgcgtggcggttttgatggggagcggagcggagcagagcagagagcaggggagaagagaggtgaagccaggaaggggagaaacgttgaccgagtcgttgaaaaggagtgctacaggaaatttatctaatttgctggaaaacattataaaaacatctcattgctgaatacactttaaaaaattgataatttgttaaagaatactttcgactgaattattgagagaaattctaataaaaatgagaatcaccctagagtcaaaagttattgtggtaaggtggagtgaaatgaaatataatgtaggttaatgatgaaattaagagttgcataatttctaaaattttattctaataatgtcatgtttgaagcatgtggtcttatggtattctcgtctttcttaatattttatctcttcaattgagctgaaggtatcttctagaaaattaaagggttttaggatgtattttagccgtgatatgtttattcgacgtctatcaacaaattacacaaaatttgtgtcctttcgaaaaatttgtcaaaataaaaagttcgaatttatttctttttcctaccgcttcggatacagcaggtttggcccgggatctagggggctgtttagattgaggtttatttttactacaatctgaacatgtcctatattactttcacttacagggtgggtcccacgtgccagtcactagaaaatgtttagtgtgaacagcctgaccaggtggggctgaccaatactcgggcccacttggtcgtgggcttgcgtagtgtggcttcgtgccaaccaaggagacgcggcgtcatggaattttcccgtgatcgcctgggctgcgacggccgtcgtcgtggatttctttcaaaaacgtggacatttgtaatatttattactacgcaaataagatattctgtcccaatctatgtcgcaagcaacgtcatattatatactcctacgttggtcctgtttggatccgaaaggctattaaatagccctccagaatcttgttattta

SEQ ID NO: 30984 - DNA, 8642 bp, Oryza sativa
tttaatactcctaaatagtaagattccggagggctgtttaatagctcggaggatccaaacaaggccgttgtaccactcttcctatattctttcccaatgaaatctgttggaatatttattatcaccaacgtcttgaaacgtacgtatagcttgttttaaaatgaagctatttcttcacatatcctctctactcaaccaatcataactattttctatttaatgtattcacatttttttctcaaccaatcacaatatttctctaattaatttcacctattttcctaatactaatatttactttaaaaatgtttatattttgggatggagaaagtacggaaataagaagtagtacacgatatactagagatcaaatcctttccgtgtaggtcttcggcaattccttaacctcatggagatattttccataacttgagacaaattcctaacggcgtatacggaaaccaatccgtatatgtgaaggtataccttatcggtatattctataagtcgtaggatagagggtatgccttatccgtaacgatacataggattctagtgtcaataaagtgagtgcataatgacagatcatcaaatccttataccttccgtccagattcgttgccacatccctctaaaatttcttatattatggaattgtggcaaatcatctaataaaaaataattcggcacttactcaccaaatattcccccacgtattcaagcccgggtcattggcaggtattcaaaccgatctggtgagctcattaagaaaagtgactaattcggtcaacatacagatcggtgagaagtaaacaaagtgatggctactaggtatataatctcttaagtggcgtctactaagtacaacaaaagtaatggctacaaagtgaccaaatgtgatattttttcgtttcatattataatactttctaacattgcttatataaatatagatattaataaatctaggcacatctatatgaatgtgggcaatgctagaaagtctaagggcccctttgaaccgtaggaatgaaaaaacggaggaataggaaaaacataggattctggcaagaatgtaagtgtaaaacagaggattgcgaaacacaggaaaaacacaggaataatcgtttgattgaaccacaggaaaaatacaggaatcggatgagagagatagactcaaaggatttttaccaagaggttggacctcttgctaagtttcctccaaaatctataggcaataagccattccataggaattttataggaataggaaaagttcaatcctttgaatcaaagggctatatagaaaaatttcctataggatttcaatcatatgaaattccttcataattcctgattcaaaggggcccttataacatgaaacgaagggagtatctacaaagcaatggctacgaggttagtacactaaaacattttgccactagtaaaaagtacaccactacatggattatactaaggccccatttgattcaaaggaaattcataggaattttattcctataggaatttttcctacaaagccctttgaatcaaaggaatgaaccctatggaatcctatgaaattcctataaaatgcctttttccatataagttttggaggaattttaacaagaggtagaacctcatggaagaaattcgatgagtctttatctcttctcaaattcctatgtttttcctgtggtctaatcaaacggtcattcctacgtttttcctgtgttttgcaatcctctgttttacggtcattcctgtcagaatcctatgtttttcctattcctctgtttttttattcctgtaattcaaaggagccctaaaccgtaaactactagcataacagataatatacgagtactgtatggtataggtgagaaaacaagccaaagcgcgaatgcgcgatggctagtacggggtagttagtaggcctcttgcatacgtctgtgctgaggtcgatcgttcccgagtttttggtggccgccgccggcgatgaccggccgtctctcgcgttgaaccgaacgtcaggctgactcttagcctgcaaggaacactgatggcgcgcaaaattcttccgccggttaaagatgtggtcgtcagaaccactagaaagattgttaagaaacacagacgaatgataccgtgcacaacccgcgaatacaaaactcatatcttacctctatgagaacttttagagatttagatcgatattatatatatatcttgaagttgatgatatcatcatatgcatctcactcttcaggcatgtacacaatcaatttacgagcaagctaataaaggagataaatattgtgcttttatgggagacagagactattacatgacaacatagcagcaaaaagtgacctatatatatttaaagtttagaatgagattcgttcagaattttgaaagtttgaccatcagctttatattgacgccagtttatgaaacctaataacaagattgttagagtacttttctacataaatctacttaaactcttctttagaaaaattaagtaggtgagaaaaacgacaaatatttataacaagcgggagtaactctcaatcaaaatttatactcactaatataaactgtgtattttatcttctaattcctgtcaacttttagtcataaacaagtccacaaagagtttttgttcggttgggttttttccgacagaagtgtcagcaggaaagctgtcgaccatacagactccgcattcagcaacgaacagaacttcaaaacaagtgatgccagaaaagggattgaagtaaaaaccaaacaacagaagattgaagttacaaaaccaaattggaatgtcagagaacgagtgtttttccttcgaagcttcaatagctcatgtgcaaagagtttatgtacccagcaataacaaccgctattccaaccttttcgtgttgatctaagagtaactagtgaagtaactactaaaacgtcgacgcacacacaaacatagcaagggaaagcgtggaaatacaacacataatctcttcaaacttacaaaaatgtttcatatctagagtttatcctttttcgtgtagttagttttttcaggtatgtcttgtatgtttgtatgtatgactaatcttgtgattcttaattaattggctatcatcaatcgcgtgcctctgtgctgtaagagcgatttgcatactcctgaaccattgctcgaaaaagtgatggcctccccatcaacttggacggctcatcaaattccttcactaaccctgaaaataaaggcatacaacatcatactcagagctgtgaatagaagtgcaaaatcaaattatcagcaaatttctcaggatttgttttttatattgccatgcttttctttggggctggaaaaacattctggtaatactagaaatagtcacagtgtaaatcctcacctgcatccaacactagactctatcactgtccatgacagtcggtatgcggtgcgcaatgctgatgatagtgcaatcagtgaactcttctcggatgatcctctggatagtcgcatctgtctgagaatcaacggaagctgttgcctcatccatgaacaggatccggctgcgcttcagaataacacgaccaaagcagaggagctgcttctgtcctacgctccagttctcccccatgtcggcaactacaaagaacaacataaaagcaaatatgtgcaacagtaattgcagctacaaaaacaaaaaataagtgttgttcaattaaaaagcatacctagtgcatcaagtttctctggttttgtagctactatatcttttagttgacaacgctcaagggcctgcagaggaatacatatgttagtctcgacagaaacaaagagttgcaatagaaaaatccacacattgaaacatacagaagctgtaaccaaacttttgtacctgccatatctcgtcctcagaatatcgcccaattgggtcgatgttgcttcttatggttccttcaaagagcacaggctcttgaggaatcacaccaaagcgcgacctgagatcatgaaggcccaaagtgccaatatctactccatcaacgatgatatgcccttctacaggctccacaagcctgaacaaagcctgaactaaagttgactttccgctgccagtccttcccacaactcctatcttttctccgctgttaatgctaatagtaatgcccttcaagattagaggtgtgtttgatcgatacctaacctgaaaagaatagtattgatatggatcacttctatagttctattaatcgcagtgtacaaaaaggaagttcaatgaaggaacataaaatttctcacctttagatctttaacgtcaatatctcctcttctaggccaatttggtgagggaagacaatctgccacttcccatgctgcctcagaaggaagagtactgtactgattcaccctttccacagcgaccatgtcattttctatcatacaggtcattgaaattgtatagtacaccagtgaattgagagatagaccatacgaaagggacatgccgacaaactctacatcagaaacagtacaaatcaatgaagtgatctttgaaggtcacaaaggattaaactgataacatatattagcaagtcttttaatataattgatcatttagagactgctgtattttatcctctaccatacaaacaagtagctaccgttctgcgaaaatatggaagtttgcatctaacataaatttgcgcttgatctttgctaatgacacagaactatccataaagcgctatatctcaaatttagacatctatagattcacaactcatgctatcccattctacccagtgataaattcactaagaatcattcgtttatttctatatcttccagatgatgactggtatactttctaatataactactatgcttaggacaagactctattttccttaacagttcaaaattgtgttcaagggaacaagccaatttatacgtaagatgtagacaacataacatcaggagtcaacaattcgagtctcttctaccaaatgggacccgtataaatacttggtgcaacaatattttaagaatacctttcttgatgaaattgctaggcaagctgatcataagaaaagcagttatagacagtagaagtgtgccaatcaactccaggcgaaaacccagccactcattagctccataattatgaaaagacatgcgcaaattcgaattgattctgtccaagtttatttggtaaaactcatcctccttcccaaagcaccttacagttggagcacccaaaaaggtttctgagaagtgatcaataacaggtgcccttgttactccttgaagacgagttaactctcgagatgttgcgatgtaacgattctgaaaaacatgaagaaatgaaagcaatcaaatttattattataattcaattatggctgttatatgatgctaagtagtacaaaaaatgatttcagttctctgatatgcatggttgtagctggatcatacccggtaccaaatgtttaaaagcactagtggaagtactgctatgactgacggccatgcaacctggcaggtaacagcaatgctgctcaccacggaaatgcacattgatgtagcaaaaccaacatagaatacaagggcagtgtcaattttcatttggtctgctgatgcctgaaaaaataaagcagcaatagttcagaaaatgattgtgcacgtgctgtgaaacaaattaaattctactcctacacaagacatacccggcttagtattctcccagaaggagtggtgtcaaaaaatgacattggtgcccgtagaatgctgtcaaacatcttgttaaagaagacctgggctgacttaaaccccaagaatgtcacgaaaagagtactgatcgcatcacatacaattgaagcagcaactatcgaaacgtaaacaccaagaaaaacagaagtgtcaaatattgtgcccccagatgtttcatatgagagccagtagttactagccatactggagccttccgacagaactgatacagctaaaatgaccagaactccccaccaaccccaagcttctgttatgtatagcttgtacacttgccaacttactcggccactctccttttcctcttcctcgatcagtttagatgaacctgcttctttgcttggtgcaacactggtacctccattttcattactagaattggacttgacaggagattttgctggtacggtggtgtcctgagaatactcagtggtctgatcatgggacatttgctctgctgcccctggaacctccattgaactatggtgagcagtaacaagaactgaaaaatctgagcatgatgttagtagctggttgtagctcccagactgaatgactaccccatctttcattacctgctcaaacaagttaatattgtttaatttgtattatgtgtaaatgatatcagaccatggtgcatttgtcatcatatcataaacttggcatatgctgatacctaaactaaacttagaaaaaaacgcaaagaaaaataattcttgtccctactcctagaataaaaaacaaagccagtgctacagtgctactggtattgctcaatatggctaaacgattcataatatgtcagagttcatttctgcagcaaaaacatatttactactctatttcctccaaatgtaacaagtacagtttgagaatagaacttacgaatactgtatccacattctttaagaaatccacttggtgagtcacaagcaaaactgtcttcttcttgagtatacctttcagacattcctgcagaaaaaaaggtaaccattagagtactacttaaaaactgggttgacactacctacagtccatacttgttttcagaattttctttcgagacatcatagtaataagaaaaccattggaaagcaattaatattggaaaattaagtaggtcactagtcttttttttttgaggggaaactagtccatttggttgtaaactgaatttcacatcatcaacctttgtagccattcctactaaaaaattacaggtttttgtaatacaaggttccttttagtttaccataacaaatgaataaataaaatatggaacaaagtttcttgaaacagaaaggaaaacgaaagagcgctaaaattttccttcgctttcttctagacgaatccaacagaaaaaggaaaattgataaataggtaaactaaatgggatctgaattatgcaaatataaaatcatattggtaaggaaaactctaaaagcattttaatcaatatttttttaatattccgtttatgtagaaaaacagaaagatgccgtgagggcttgattcacagcatgataactaccatgccgaaagccagatggcattgcttgatgttgaaatttattttataatttacaagaatgacttttcctcttatctttcaaagaattcgaccttccatatttgatctttcctcatttattttacctttcggctttcactagacatcctgtaaatcttcattacaagttccttccccaagttcattttcacttgtggttattttgcatttgttctgaatttaaatcaactcaatgaaatagctaaacaccacaagaacacaaaagaaataaatgtgaatttaccttgaagatagctgaaccagtatgagcatcaactgcactaaagatatcatcaagcagatatatatcacaatcttgataaactgccctagcaagctggatgcgttgtttctggccaccactgaggttgatccccctctctcctatttcagtcttgtctccaaactccatcatttctaaatctttctctaagcaacaagcatgtatgacttccctgtacctctctgaatgcattggttgtccaaataaaatgttctcttgaatggttccattttggatccaagctgtctgagcaacacaagctgtgctcccacatatgctaacctgtatcaaatacgaaacgataacacagttattatcagataaaaagtaggaaaataacttggaaaaggtagcgacagaaaaaaaaaacgaaaatagcttgaagaaattggcaacaactggtatgctaatagataagcatatgtaatgagctcagtcgcaatattcagaattattgatgcatgaatgccatactggtattttattctgaatagtacataagtatggtctcaacatttagatttattgatatactacttctgataagatcagctacaaagtatgcaaagtgcgaagaaagagtctcacaaaaaatggtgtgaataaatgaatcacatcaaaactaccatctgggacgatagataagtaaaacataggaattcaagatgcaaggaggggaaggcatgagacctcaagtttgttttaatccagatatctatggagaacggactgtgtatagtgacggaaactgacagcagccagtttgaatcaatggtggctagtgggtctgctgtggctagcaagaggaactgaaagtgaaatggacaacatatgtggagattgatggcaaccggtgtgaatcgacggtggccaacaaggttgctgccgttagcaagaggaacagatagacaacggacggtgcaaatcagtggtggatgatgcagattggtggtggacagcaaaggggattgaccgtgtggttt

SEQ ID NO: 30985 - DNA, 18513 bp, Oryza sativa
  unsure (1)..(18513): unsure at all n locations
cttttagtgatgcaaatctaaaatcacatgacaatttctccaatggctgaatacaaagaatcccaaacaaggaaggccaaacgcaaattgagtgaaccaggcaggtttatgtcaaactaatttctggggaaataatcccacaatctgccgtgagcttaccaaaaaaggagctaaactaaagaatcttatatacagaatttaaggaacaaatagcttttacatcagctggattttattggcttcaataaaactgtcaagagagatttgaattattttgttgtgatagtaaacacttgaattcacattttcttatcagaatagaatgttaattattccttaatcacatgccaagaatttgatatatgtacactcaccgtgccggaaaccttgtgcatttctcccataatgcaggacagcagtgacgacttgccagagcccactgtcccaaccaccgcagctagctcacccttcctcacctccacctcaatccccttcagcaccatctccatctctggcccctcctctcggccattctccgtaccatggccctgccgggcatcctctgcaccttcaactggcacatcccaagcaaacactccattctgtactttcaccgctgctgcatcaccggcgctactagcaatgcgctccacagccgtgctgtcaatctcggcatcagacaggaacttgttcagcctgccaagtgacacaaacgcttgcatacacatcacgatcgtctgcgggaagttgtgcataggcccctcgagcattgagaagaacgcggtggccgtgaacaccttcccggcatctagctctcctccggtggcgaggtaggtcccaaagaccagcacagtcatggcgagtgggccgctggagaacacgacattgttggcgcacatgaagagtacaatcttggtcaaccaccccatctcagtctgcctgagttctcgcaccttgccaccgaatttctcctcccaggcctgcagcttgatgacacgcatgtggttcagcatctcggtgatggccttgatgcggctgtcgcggacgccgaggaacttgagctggtaggccaagttgagcttgttggcgaacgcggtgatcacggtgaccgcggtgatcacggcaagcgtcatgagcacggaggggccgaggtaggcgtacagcaggacaagcgccaccacgatctgcagcggcatcagccaaaggccgtggagaccgtgcatggcgtaggacaccgtcccggcgtccacctgcatgtagttgacgatggcgcccgaccgtgcgcgcggcgcgcgccggtggacagacgcagcgacttgcggtacagcgccgtgagcagcgcgccgcggatgcgcatccccagcagctgcccctggaagttgtagtggtgcgaggccagcgtctgcaccgccttgccggcgacgaggatggcgacaagccggaggccctcccacgtcgtgccgccatggctgatgaagtcgacgaaatggttgatgagcgacgggccaacgtacatggcggcgaggcgcacaaggccgagcgccgccgtcaataggacgcgcggccagaaggacagccacagcgcgacgcccaccgggtagcgcgacccctgcgccggccagttggacacgaaccgagcgtacgacgcctcggcgcggtgggccggcgacaccggcgggacgtcttcggcggcgagcgagtcgctggcgtaccccttggagaccagtggattgatccaactgaacgtcgcgcgcgacagccacgacgccgcgtcgtacggcgtagagggctccgccgcggtggtgacgtcagcgggttcgcgttcgcacgtacctgcgacctcgccggatgaggcggtgatggctacatacaccagaggcagcgagagggcgaggccggcgaatgcgagggggtcgtcggggaaaagcagcgaatcctcggcccagcggaccgcggccgaagcggagaagagcgcgccgacgagggccgtcacgacccaaaacacgcggagctgcagagggagggcgccaccggccgctcccctccgcgacgcgatggtccacgccgccacggcgtgcgcgacgaagtggacggcgaggaaggcggattcccaaaccctccataccgtgttcggcaggaggaacaacgcgagcgcgaggaggatggccgacgccgccgcgaacacccccgacgccccgagcgcgaccgcgacccggaaaggccttcccgacgcccgaggcttcggcagaagccccttcccgttcgggaccatccccagcgccgccaccgtcgccgcggggaagggcgaggacgacgagggacgcgacgacgaagacgaggtcgacggcgccgaggagcgcgcgctgcgggcagggcgagaggaagaggaaggcgagcaggtcggggaaggaaccacctgacggcggcgagcacgccgtggtggccatccaccccgggaggaggagagccatgtcgactcggtctcagtgtcgctcgccgtcggcgaacatttgggtttgggcggagacgcgcaatggcggcggacggcaagtccggtgcgagtccgggaaaaaaaaaggtttaatctggaggaagatggtccccacttcggccactcctttgactgctagtgctaacaccacaaaagattgtatatcaatctaaaatacagaaataccgtagaatgttatactgtttcaaccgaatagcacgaggtatcatggtaacatgatgacgtgaacatggtatttagatgccagatctaattcttatggggttcatatctagcattgtaggtaccagatctgatacgtatagtatcatattgacgtcagtatgatacctaaatatcagatatgatacgtacggggtatcatgtttggtatcgaatgtattagatctaatacctataggattcatgccgatgtgagttattccgtcgaaacgataataccgttacgtagtctccctttatgaaataagatcttctctttttctctacaatatcggtagttgttaaaatttaaattctaaaattttgattttcaagttttttttatcaaaatttatttttcaacattggtatttaaatcgctaagaatacacacataaatgtgttatccatatttggttaaacgatggggcctaaaacacacgacaaatatatgttgaaacaatttgctatatagctcttataataaagagagaaagaataaatgaagaggagaacttttatattgtgttgttagtgatttaaatgttaatgccaaaaaaactatgataaaaaaccttaaaattaaatttagtagtaagatttaaattttgactacggctggtaaaagcaacgatcaaatgacgggtggttttaaaaacaagtacaccttgaaccaggtaatcttatttttattatatcttgaatcacgctactcttatttttattatatcgaatcacgctgactcttttttttaaggcaaattttgctacaaggcacacaaaatttgtacaatttgctgatatacatcgcaaaaacatctcacggctaaaagacatctctaaaactgataatttgctggaggacaatttcgactcaattggaacaataaattcttcaaaagaatgagaatgactctagggtgaaaagcttttgagctaaggcttgagtgaagatggaatacgatgtatactagtgatctatttggggtgatggctaatttagaattgcataatttctaagtcttcactctatcactatgtttgaagcatgtgttcctaggggcattatcttttttcctaagaatttatctttacaattgagtcgcaagtgtcctctagcaaattattagtcttttaggatggctttcaatcgtgacatgcttttacaatttctataagcaaattacacaaattttaggtgtcctatagcaaaatttgccattttcttaagtatatgaatgatcttaagtatttcggtttttacttggcaatgaactcacatggttgtgtgtacaataaattgaatgtagatagataaaagagcatatagctgtccaaaagagctagaaaagtaaaattatctagtttttttaaaactagtgggttcgccctgcgagttcgctggctttggcttcagtgctcattgcatccctactgggctggccttaaggcccccgttgagcggagtgtctccgacatgtttgctgcgtcacattcttcgtgtcaagagatggtgaatcaactctcttctggactgaccagtggatcgacggtcgcctggtggcctccttggctcaagacctcctcgtcgtcgtgccctcgcgtctccggggttcacgcacaattggttctggcgtcgcaaacaattcctgggttagtgatatccgcggcgccctcattgttctggtcatctcctagttccttcttatttgggatgcagtacttcctacccacctctcgccgggcgtagagccgtagaggacgtcttgtttggcaatggacgagcgaccagcgttactcggtgcactcagcttaccaggcgttcttccttggccagcactcctttgcgtatgccaatctgctctggcacgtgaagggccctgctaaatgcaaattcttcctctggtttggttttcaatagcgctgctggatggctgatcttctccagaagcgtggtatcaatagccactcagcctgccccttttgccctcatgatcttgagacggcgaaccacatcccccttgactgtgtgttcgctcgataggtctggcaccacgtgttgttgcccgctggctaggctgccctctttcccccatggcagctggctttaggactggtggccgtcttctagggcctgcttacttgagcatcttcagccagcttcgactccctagtcctcttggtctcttggtagctgtggaagtaatgaaactctagggtttttgactctacgctctcttcggtctcagtggttctggagtccattctctcggaaggccatctgtgatcttccgctggcattgctatttttgagggcttcttgggagtgtagtgtggctctgcccttctcccactaattagagttgcgtttggccgcctgaatagtttttctttttcatagcttcagtttttgtttttcttccttctcctggataggcatgtctcactggttgcgttgtgtatcaaaaactcttttccttctaatatattcacatgcaatccttttatgtattcgcgaaaaaaatattgatcaaaacaaaacataggtaataaaaagttgtccaaagtgaaactcaaacctcataaaatacttaaaaatataccaatattttagttgtgctaccccactaaatttcacaccaatattttctttgattggacgaaatacacaacaaaatactatattatctttgattggacgaagtactcctcccatcccataagaaaccaacctaataccagatgtaacatatcctagtactacgaatctagatatacatctatctagatttatagtactagaatgtgttgcatccaatcctaaatttgtatttttttttacaaagggagtaccaatgttagatttttttttatatatatacgaagggagcacacgagaatacaacaaaatgtactattcaaattaaagtgttcttttctggactgcttagagcaagtttaatagtatagctaactattgacttcaaattatctatagtcaatttatacaatagttataaacatgtactacataattaatgtctggtcccacctgtcatacacatatgcatcttggaatctgtagcccgttgctttatctcttctcttttatctccttaaaatatgtttatagctggcttatatggagaactagccaagagttattttgagagctattttttagcacaagataatagctctccaataaaatagccctaagttgtttggatcccagggttattttgagagctatttggcctttaatgtaccttcctatagagagagatagagagaaaatacactttttcagtggccccacccgaaatagccccaattagcaccccttgggtgggatagtttttggggtgggttatttccaaatagccctcgaatagctcacccttttgatctttttgggttattttgttggaaatatggtcatgaattggcatattttaatccaaaatgttaagacaataatcatggcataagcagtgtagggtgatctgaacataaccagtagcatactaaagacatcatgcgcatcaccatgaatatcaagaacagaaacatagcgcacaaacatgctagaggcatcatgaatattaggaacaggaacatagcgcacaaacatgctagaggcatcatgaacatcaggaacaggaacaaagcagtagagcgctaatagcaggaacagaagaaggagaaggatataccccgagaaaggccctccgctggattgtgaggcagaattgcctccgttggtgttgttgttcgccgcaccacctccggctcctggcacgccacctccggctccaggtgcgccatctcctccagcagcagcagcggcaccggcggcagctccggctccaggcgcagacatggcgaggacgagcagtcgtgcgggaagcactccccaaaaacctgatcacccgcctacccggtgcagatctcaggcgaagccttccaatctctcgtgcgcgcaagagatcagaagcgaggaagcgagagcagcacaggcgcggaggaggaggaactaacaccggaaaagaagcaagcgattagaacggatcggactcgcggcctccttatttatcaggagagaggcagtcgtgggaacgtggacgcgctgttgcggggcagtcgtgggaacgtgggttagtggctgcaaaagagtagcgacgtgacgcacgccgccagccagccacgccacgcctcgcctcgcccacgccctcggcctcggcccggcccgcgcgcgcgcgtgtggctttccgacccccatctcaaccagtcaacagggagtctctaataacaacctatttaggttgagatattcctcgcttaaatcctgaggtggtattattatccttaacacttattatgggcctttgagatttaataggataagttgggcctagcccaattattctaacaatccccaccaaatttcaaggctcgtaagaaatgttgtgcctgtttgatatatcagggttttggtggagactgttaagttgaacttccacctaggaaatgagctacatcagaccacaactgaacaatggactatgccttgaattgtcagttttgtgtgatcaggtttcactcagaaccttgactagtactgggctaccgttcgcatcccctctgtttgaagcatataagtcaaactccgggcctttcatgagtatctagagatcgcccaacctcacagactgtgactagcagtcgaactcatataggtgtgttccttctaagatgttctgcaggtcaacatctctgcttagaaaagccactcggatcacattaaggcatgagccatcctaccatgcaggaaagaagagaagcacatcatgaaaatgagcccttttcaagggtctcttctctcagtcacacaatagtttgtttcgccatccaaattcacgggatctccgatcacaatggacaggtttccactattgtgcaaccttaggtgggtatcaagcccatttccctcgatgcactgtctatcacgttacatggtagccccttggtaaactgatctgccagatttctagccgtttggacatagtccaatgctatcactccggagtttttctgctttctgacagatttcagtcttctcttgatatgtatagatgacttcatgttgtcctttgagctattccctttaataatcactgtttgactatcacagttcattaggatagttggcactggtttttctaaccattggcaaatccatcaggagttctcgaagtcaatcggccttaactgtcgcagtatctagtgctgtaagttctgcttccattgttgacctcgttaagatggtctgcttgcaagacttttaggaaacagcgccacctccaagtgtgaacacatatccacttgtggcttttatctcatcagcatcaaatatccagtttgagtcactatacccttctagtagttttgaatacccggtatagtaaattccatagctcatagtgccctttagatagcgcattactctttccagagcctgccaatgatcatctcccggatttgagacaaaccggctcagcttgcttacagcaaatgagatgtcaggcatcgttgcactagccaagtacatcaatgaaccaatgatttgagagtatcttagttgatcccttgctattcttcggtttttccttaatagcacgctgggatcataagaagtaggagctggcttgcagtcactatatccaaagcgactcaaaaccttgtccacatagtgggattgcacaagtgtaatcccaccctcatctcctctttgtagtttgatgttaaggataacatcagcctctcccaaatccttcatttcaaaactcttggacagatagtccttgacctcctcaatcacattaaggctggtcccaaagatcaatatgtcatcgacatataagcacaagatcactccttctcccccaccatagcgattgtatacacatttgttagcttcgttcacaacaaagccagcagatgtaagcgtggtgtcaaacttctcatgccattgcttaggtgcttgcttgaggccatacaaggatttcaacagtttacacaccattccctcctgaccttttagtacatacccgtctggttgatccatatagatctcctcctccagcgctccgtttaggaaagctgtcttaacgtccatctgatggacgagaagaccatgagaggctgccagagcaagtagtacttgaattgtggtcaagtgagcaactggtgagtatgtgtcaaagaagtcctcgccttccttttgggtataacccttggtcacaagccttgccttgtacttttcaattgtaccatcaggcctaagctttttcttgaaaacccatttgcatcctacggacttgcacccatatggacgctcaacgacttcccaagtaccattagatataatcgagtccatttcactgcgtactgcttccttccaatagttagcgtcaagagatgaatatgcctcttctatggttcttggggtgtcatccatgaggtatacaatgtagtcatctccaaaaggattttgcaaccctttgtctcttactcttgcgagtgtctacaatgttgtcctcctcaggatttttctcagacgtttgatcattgtgttctatcggtgcaaagttctcatggggcatgacagtttcttgactagaagtgctaggtgtatgcttcatgggaaattcattctcaaagaatgtagcatctctggactcaagaattgtaccaacatgcatgtcgagtactctagagtttactattaagaatctataacccacactgtgaatagcataaccaatgaacacacaatcaacagtatttggtccaagtttccgctttttggctataggtatatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagcccagcagagtctaacatggcattcaccatctcagttagagtacggttctttctttcggccaccccatttgattgggggtgaatagggaggcgtcctctcatgaataattccaaactcttcgcaaaaggatgcaaactcattcgaaaaatactccccacctctatcagacctcaaccgtttgattttcctttcaagttggttttctacctcagctttatagattttaaagtagtgcaatgcttcatcctttgttttcaatagatacacatagcaaaatctagtgcaatcatctatcagtgtcatgaaatatttctttcttcctttagtcaacacgccgttcatttcgcacgaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacaaagtcgcgaatgccacacattagactcatcattcttgctaatatggttaacaacattatgattattacacatgtcattcaaagaaaagcggaacaagcctccgatgtcataaccttttccaacaaaagtcccatatttagatacgacacatttattggactcaaacacaagtctaaaaccttctctacacaatagagagccgctaacaagattcttctttattgaagggacatgctgcacgttcttcagctgcacggtctttcccgaagtaaacttcagatcgaccgtaccaacaccatgaacagccgcaagcgacccatttcccatcaacaaggaggaacctctcctgacctgataagaagaaaacagagaaatgtcagcacatacatgaatattagcaccagtgtccacccaccaatcaggtgagtgaaaaacagagagaactgtaggtaatattttaccgtaccccgatgttcctccgccctcgctaatgaccatgttggcagacttcctgtctttgcgctcaggacagtccttggcccaatgcccagacttgccacacacaaagcagtctccctttgcctttcccttgcctttcttcttaaagttggttgcagcattgggtttgacatcaggcttgacatcaggcttgactttcttgttgttgtgggatgcatgagggttcttcttctgtaccttattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggcaatttggcaataatgccacccaccacaaacttgtccggcaactcacagttgttgttctcaagttccttagccagcatctgaatctcatgagcttgttctactacagaacggtcatcgaccatcttgtagtcatagaactgctccatgacttacagctcactgccggcgtcagaaactccgaacttggcctcaagtgcatcccacatgtccttcccaaaaggcatgtgcatgtacaagtccactatgttgtcagctagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagttagaaccatcaaaagcatgcggtttcagtgcagcagcaaagccaactaccgaaaatgacctatcaggtttttggattgttggaaatatggtcatgaatcagcatattttaatccaaaatgttaagacaataatcatggcataagcagtgtagggtgatctgaacataaccagtagcatactaaagacatcatgcgcatcatcatgaatatcaagaacagaaacatagcgcacaaacatgctagaggcatcatgaatatcaggaacaggaacatagcgcacaaacatgctagaggcatcatgaacatcaggaataggaacaaagcagtagagcgctaacagcaggaacagaagaaggagaaggatataccccgagaaaggcgctccgctggattgtgaggcagaattgcctctgttggtgttgttgttcgccgcaccacctccggctcctggcgcgccacctccggctccaggtgcgccatctcctccagcagcagcagcggcgccggcggcagctccggctccaggcgcagacatggcgaggacgagcagtcgtgcgggaagcactccccaaaaacctgatcacccgcctacccggtgcaggtctcaggcgaagccttccaatctctcgtgcgcgcaaagagatcagatctctcgtgtgcgcaagagatcagaagcgaggaagcgagagcagcacaggcgcggaggaggaggaactaacaccgggaaagaagcaagcgattagaacggatcggactcgcggcctccttatctatcaggagagaggcagttgtgggaacgtggacgcgctgttgcggcgcgcctccttatctatcaggagagaggcagtcgtgggaacgtggacgcgctgttgcggcgcagtcgtgggaacgtgggttagtggctgcgaaagagtagcgacgtgacgcacgcacggcagctagccacgcctcgccctcgccctcgccccggcgcgctcgcgcgtgtggctttccgacccccacctcaaccagtcaacagggagactccaataactccctatttaggttgagatattcctcgcttaaatcctgaggtggtattattattcttaacacttattatgggcctttgagatttaataggataagtagggcctagcccaattattctaacatatttagcctatttaagatagggctaaaaaatatctctcggatccaaaacgggccatggtctgctattgtactgctctttatccgtttgtagatcacccatttatcctctttgtgcggccggcatggcactaaaaatgccatcggaatcaacgaaccattgaagcaataggttaatcaatgaccaattagtcaaacaaaattaatatcatcttgaaatattcaaatgttagattctctgacatcgtaaaaaagtattaaaatgtcagattcttctatctgacgctggctaatagaatcaatttgtcatttcatttgtactgacggccccaggttgcacaaaattgattgccaaaccctctagcaaaatgattactacgatgaaatgaagacgtatgctttgtttaactatgtgaatggtgtttgcttccttcgtttggaagaatttggagaagcagacaagaaatggctgacgatttcaagaaggcggcaacaagaaaaaaagaaactgaactgaaagagaaaaagacaaacgcgacctggatagctgtcctttgagtcgcgaagagaactagccgctctattttgtatgtcgggatgaagagttctccacgctcatcaccgaacacagcggtcacatttcacatgaactaacctaaattttgtatagcgggaacttggaagcagctttcaagttaggcctggtttagtttccaacttttttttcaaacttttaactttttcatcacatcaaaacttttctacactcacaaactttcaacttttccatcatatcgttccaatttcaatcaaacttttaattttagcgtgaactaaacacatccttaaaaaaattagcgtcaaactaaagaagcccaaatacaacaaaaacagtctatctactcaagtcaagtcttctcataacaactgcacctctgtaagccttgacaaaccagaggcaagaaccaatccatgcccccttgtcctaacccctctctctcgttttccgcgcgcacgcttttcaaactgctaaacggtatatttttttttcaaaaagtttctatacgaaagttgcttaaaaaataatcaaaataatctatttttttaaaaaaacttagctaatacttaattattacgcgctaatagaccgctccgttttcggtgtggagggtttcgggaaccaggtacagcgaacacacccgtcttcgagtcaaagtctacctactaatacaccgacgacatgcaacaactatatccatgtcatcacgtaaccaatgatacaacattttcaaactatcaacgtcaggaagtttacaatggaaaagaactcagcaaattgcgtggaaacggagccaaatagttactgacgtctcagtaaatcaacaaagctaaccaataaactagattaatggcaactgcatagcttttgtaagcatgaaaaaaactttggaaaaacgttgacatccttggtattctagtaattctctccaattctataatccttggcgttttagacattgacacggtctccaaaatatatctttgactatatttttctattataatatatgcaataaattactaatttttaattttattatagtactttgtaaaagaaatctatatatgttgttctaatacctttaaactaaatagttttaaagttattgataattaaagttataaaagtttgattacaaccttgtttaaaaggtcaaaaattatagaaccggatgaagtattatatttagggttaagtccgatttacccctctaaactcttgcgaaagtacgctttacccccctaaactatgataccatacataatcccccatttaactattcaatccgcacacttaaccccccgcgaccaatttcggctggttttacgtctttgatccgacgtggcacacccatgtggcaaatgatgtggcagttacataaaaatacccctcccctcctcttctctttctccctctttctctcccccatgaaaaattccccaccgaacccctatccctagcggcgcggagggagctgggcggcgcggcggcgtggtgaagaacgacacgggggcgtggtgaagggcgacgcaggcgagggtgtgtggcgcgagcggcgcggcgctgcgcaggcacgacacttgcacggcagcgcgagacacgcgcggcggcgcggcacaagcacagcggcgaggtacatgtgtagtggcacgacgctcacacggcggcgaaacgcaagcatgggacggcgcacaggtatgccacggagctcaagcatgtcactgatgcaaaggtgcagacggagaccaatcttgctaggcacaaagaacagacggaagcaatggggaagcaaaaggatgctggaaaagctaatctagttgctaaaattaatatcttagagaaggaaagatgtatgcattagtagcatgtgtatttataattctggggttgtatgttaagctgtgatctttctgtatatgcagtatactaacatgtaatcactgcatgcatgtaacatgtttctcaatttgtgatggtcatgtgtttgtgcaataaaggagctttgtcatcagagtcacaaatctgactacaaccaaaaatctatgtatgtcattaggctcactgctgtgcttgtgcgcgtgtgccttgccgctgtgcttgtgcctcgcctcgcgcgtgtcgtgcctgcgcagcgccgcgccgttcgcgccacacagcttcacctgcgtcgctcttcaccacgcccccacgccgcccttcaccatgccgccgtgccgcccagctccacctgcgccgctagggttaggggtttgggtggggaatttttcacggggcagagggagaaagagaggggagaggtaactgccacatcatttgccacatgagtgtgccacggcagatcaaagaggtaaaaccagccgaaattggccacgagggggttaattgtccggattgaatagttcaagggggtattatgtctggtatcgtagtttagagaggtaaagcatactttcgcaagagtttaggggggtaaatcagacttaacccttatatttatctggtgcaggagaaagttgagttgaaatggaatcgagattagttatcccggttcaattgccaggcatgcaacttctgttgtctttccatgaatgtgtttttttaaatagttttaaagaataacacatgttaggaaaagagaaaatccctcgtatatccctgaaattttagctaatctcctctgtgcccctgaattttgcttaattccgtataccctctaaaatttgattttgatatcttccatgtcccttctgtcagctgccgtctaatttctatatgaccattttactctttggatgaacatagaaatttatgagttacataattgaaaatgtaaatgtttgtcgcatgagactattatagttatgagtttgctgtgcgatacattatttatgacaatttatttttagataatgaaatgaaacatatgcatttattttttaaaaaagtcataaaaattgaggagtattcgtacaaacataggactaccaacgtccacggtatttttttatgaatgctcctgataaaaaaaaatccattgccctattaaagattcaaataaaaatttaatttattacattttttattttcaaaatttatgtcaaaattttccgcactaattatttaatctcattaattttacaaaatgcacatattgtgcactcaaacaaaaattttaattgttcttcaagcttatattcaaacctaaatcatcaagggcataaaagacatttgcaaccagacttaacagtgaaacaaaggaaaatgtaatggcaagggtatggaagggatcaagttgaaatttcaggggtatagaagggatcgagaaaattttaggggtatgaaaggaattgagtgagttttcgagtgtatacagggaatttactcataggaaaaacacatgaatagaaaaaatataggaattgaagttgcaaatttctttaatcgtataggagtgaaaagcataggaaatatgaagatggagccctttgacagcatcaccggaaactaacaaatcaaaggaaagttttcaacatgttgtgcttcttgcttatttttctatgagattgaaccatttgaatgtagtcctaggaaaaatttcgtatctttcctatgaatcaaagggttccatagaaaaaattctttaggaaattaaatcctccaaattttctaccgcaatccttcatttcgggccctaaaaggcaggaaattcagataaatagttttttttttatcatgacatcacctaggatttaattaggctccacccatacgttgtgcttcccattttaagtattacctgtctacctcggagccaccggttctcatggctgcttccttccataggttaaaattaagtaaaaatgctagcatctctgcatcaacatgacatcccccttaagaaaagaggacgttcagtgctactacactgtcatcaccttcaggaaaaacaaacaaaccagttttggatagtgaagggttttggacagcctccatcttcaagtttacaactaccatggctttaggtcacatattgaacaattgaaagattgcttcgagctaaaattttcatatagtacttagacaccttaaagtacaaaaccaatttagtcagttcagtacaactcaggatggagcatctttgagggagagaagcataacttttgttgctacatatatgtgttagttaacatggatgccaatagggatggcaatttccccggtggggacggggatccagcggatacccacccctatggggccggggacgaggctgttttttgccctgcgggtgagtcgggtcggggccccagtcgttaccgggggtgggggcgggtgtgaaaattaacccgtgggtgaccctatggagctccgaaagtgtatatcccattttatggcccattcaaaataaagactaataggcccaatttggtgtcacacaccaatccggcaccgccgtacaacagcacctgactggagcgcgtcgtaggagaaacggtgcgaaccgcttcctacgagaccgcgataacggtaccagtcctaggacatagagctggtacccacggtgacaataatgaagcattgcaatccttaatttaaatagaggacttatttaccttaacttaggttgcagctcagaatagcccgagaatgcaatcgatgacgcggacgaggaaacaccaacaacagcagcagcagtgaaaccaacggactaacacccaacaccacatgcgacggctaggaaccaggatgaaaccctaatcttcacttcactttatcttcagcttcaggtcggaggaactatatatatttatatagagcaagggtgagtacttccatactcagcaagtcacgggaatttaggtgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30986 - DNA, 328 bp, Oryza sativa
gggttcaaatggtatgctcgactacacatcatctccgtggttctcgcacctggaatgacaacgttctcgacacctgaagtcgcgaatggtcgtacgagttcattgttgagcagaagtcgggggctactgtcagggttacgggtcaggcataccctctacccttcggtgtacgtcacgtaacgacatggcatatctatgcgtacgtggatatttcctttgtgattaaaggaaacctttcgtgaaatcgattgatgaggagagtccttctcggacaagaattgggttacctacgtgtcgtgccaggtctagtatattcgagtcctactcg

SEQ ID NO: 30987 - DNA, 14581 bp, Oryza sativa
  unsure (1)..(14581): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgactgagaactatcaaaatgatgaaatttactccattctgaagtcagaatatctttcagatgtagagaatctataagactgaaaaaaggacataaatatgggctagtgttgttgttgttgttagtcaggcagcataaaaagggtgtgaattatagatacttatgtaccactgacgtagactgatcaacattttgggttacaaggaaattaatgattaaagtgcccttagcatagataattatgcaccactacgatagaccgatcaatcttttggttaggaaattaatgacctatagagctataggaatggcataatactcagagaaacaatacttgtaatggtaggtacaattgagttcatttttgtcaagaaaggtaaaccagcatgtttctttgtcacttggaccgttagtgaaatgcaggtacctttgcagctttgctgaagcaatgaacttgcagaaaacaaaaatgtcaaaatcatcgaatgcgactatttacttgaggaaacatgtaggtgaaccattattggtagggaatacatagagagttccgaaaatggcaataacatacgcttagtaaaaagaactttaatgaatgatatggtacgctgcatttaacccacttaggtatacacaatgatgaaattgtaaatcacaatgaatcaagaagactaaacacctagatagaaaccaaaaatcaacatgcatatgaagttctgaacatttcagtgtaattcattctcacccatgacgcgaatgtcttgtcatcctgctccctgtgggctggggctgagagacccttgttgaacctttgcacacatcttgaaataagaatcaatcaaaaaatgaagattggagtaacaagcagcagacgcgctgagtaaatagtgacaaggtaaataatgattgattggctacaccggagtaggagcaccaagcggacggcaatgccatgaggagtaggaggatgcggcagcccaacagatgaggaggatgtgccgacaacctcaccgctggcagcaatgccagctgctggagtcggagcaccaagcggacaacggtcagcggacagcggcgctgagatctgaccgaacttgatctcatggccccattgacaccaccattggctcgggcgggctcaccagacacgacgtcgcctatctctactaccgcgccgcgggaagccacggtggggcgccacctcgcgcagcaccgggcggggatcgaggcgcgcgcgcgacgtcttcgccatgtcgggggactttaacctcacgctattcaacgagctcgaggtcgagctcgtcgggggagagcctagtcgtaggtgcttgctgcaaggagctcaacgccgcggatggagggatcggcgatttctctagaatactcgattattttgccacaccttttcttcgggagagggcagggccgtgaggctgtggaagggcgaaggcgaggcttgattcttgaccctgaaatcgtatatagagatatctataatcaatctgtaaaccgaaattactgtttactggccacgcacggcattttaactcaaacttttgtaaccgaaagcacaaatacgtacgttaccgcgcatcaagcgtggtgatattgtctacaatctactatacagtgcggttatgaaaatgtcaaaaaaaacacaagactaaaactgaattatttgaatttagttcaaaaaagaaaaggaaaatcttagcccaagctttgcgaggtacaggtatccaagcaggctgcaaccgaacaatgggccgacccatgcggtccaaccgtccagtttttgggcgcatactgtcgaaccgggcaaggcccacgagtggcctaaacatttttttaactttacgctaaacgccgtctgatcgagttgattagcccttagcgtagcacaaaacttaaccaaaaaatgaaaaaaaaaattaatagcgccgttgccggggatcgaacccgggtcacccgcgtgacaggcgggaatactcaccactatactacaacgacctcagtgactaaaaacagtagtttactactcaaattcaaaaaagcttaccatgttttttttagaggaaataaaactactgtttttctttttttttttttaccttgtttaccttcgatcataataacaggaataatcataccttcatagaaaattggcctcgcttggcaatgctttttctgaaatgctaacatttttaaatgtgattattgagaataagtttaggtagaattgttttttttaaaaaaaaaacatggtaaccatgttgatgctgtaataaaggggagattcccctatacctgccattgtgcccgttcaaatacagagtagaatgactgaattttttttttaacaattgcttgtctcatcatgttttaatatctaactatcaatttgactctaattttttagtttacatatttgaccttgcttttcaaaactgaaggtcagaattaaccatattcgatgaatgctagagaacagtgttaattaaggagtaaattgtccttttacccttgctcaattaaccatattatatcatagctttttttatccggatctttttgaaataattataatgaatttggtatagctttgacagatttaaaacaagtttaacagatttgtcttcaagttgaaaagtttgattctatttgacagattttttacataaaattgacagcatattgtccaatagcaaattcagatccaaacccaacaataaatacatatccaacagcaaattcatatccaaacgcaaacaacaaaagcatataccaacaaatccaacagaagagagctcggtctagtcggcacaaccagaaatgagcagtcgaatgagcaaccaagagagctcgccgttcccttctccttccacacggcggcgccacccctccctccctccattcgcatgcagcaattgccgtcgtccctcacttctcacgccttacgcttctgcgctcctccgtgcaccatagccaccaccgctcctttctcccaccacatgccgtgccacccctccatctctccctctgcgtagcaacaaccgccgccgctccacctccctctgcgtgtcgatgccatctctcccctccttccctccctccacatagcaacagccatcgacatccctaccttcgtgcgtcggcgcctccgcccctccttcctctgcgtgccggcaccgccgcctctccctccctccctgcgtagaatccaccgtcgccgtccctcccttcacttgctggtgcacgctactccttcgcgcgcatcagttgtcactgctcctcctccctccatgcatcagccagccgtgccgctgagatgttgcatgaagactctcgatttgtaagtggcctcatggtcaagccagaaaggaaacacaaagtctatatcttccgtcctctctattactcgcttggaatgtggttatttataatcatgggtattttggtcaggtcatactggcatttttttttctttttcctaactacaaatctaacgattttgaaaagcgaaatcaaatgagcaaacttgaaaaattagggtcaatttgatagttaggcttgaaaataggataaataagcaattgtcccttgtttttttatggtgcaatgcagcaatgggcgatgtctaaacatggcattgccttaattttgtttcatgatatcccgtagacaaggaattatgttatctgtattccatctatatcaagaacctgttggggagcttttgacagatacaacttctcccataagtaaaaattctctaaacaatctaattttcatccaaattctaagaatatgtagttgtataattcaaaaatgaactagaagttttcccaacttgtaaagattgttcgagccatggctgataaacataaacaaaaataaacaaaaaataatgagtaaaatgtttatatatgggtgtttgtagcaatttaaaaggaaatgctaaaaagttaaacttcaatgaaaaaaccaaataaactttttgaactttactatttttaactgcggcaaataagttaacgaccaccgcttatgttgctcatataatagttcctgcactaccgtaggcaggagtcacagtacagctcagttcaggtgctgctgcatatggaagcaagtataatactgtagcccacggtttcgttttcttcagaacagggagaagctatgggtgcagtgcagtgcccacggtttgaaacctaaaatttgtattcccatggagattagagaggcactgtcacaacgtgccatgcttcattgcttcccctttggtaactagcaacttgacatcttctgacgctgcctgcctcgtgtatcaccagataattaaccggcccccaaatcctatttaggagtagtacatatcgtactcacactgcaccgtacgacagtcttgaacccgtgagccggcagtgcatatgttcattttttttttgtttttttacaaagatttttcttttcatgttcgctgattgtttgtagcatatttggaagacatgtacaatattcattgaaagatatgatatgttgaatgacacggacgtggaagtgcattagcggatcagatcatagttatagagaaccagaatttgggaacctttggtcagcatttcccctttggatgctctctgtccaagaacatgaaattgaaaaagaaaagaatcttgcagtactagagcagaagtcctcaaggaaaaggagcaagggcaagtggaccctgattattccaagattgatcttgaagctctcgagacatgtctggagatattttcgcctctaggagctatagaataatgagaatctttgtaaccccaagagcatcaacaaggatgctttgatcataacaacaaatcaggctttaattcccgcaaaattccttcattccaggactaaaatgatacaagggtatatataggttctgagcgtatggtatgagatattgcaatttgatttcagaaaatagaataatgcacctttgcaagtagcatctattgtcatgttactgaaacaagacaaaccataagctgacaacaaaaacaaattctattgctaggttgaacttgtgggtattaacccacagcattgagggtagcagaaggggaagtagaccatggtaggtatagaggatttgcaaaaatccaataagaattactcgtggagtcaaatctcaaaggaacacaatctatttccattcatgatgagctttcgctttcaaggctgtttaacaatttcccccatattttttaaataatggaaagccatttacattttcatcatggagtacgagttgcacaaagagaagaaaagaacatcgtctttcgcacgcttcccaaactaagtatttttcgaaaaaactttatgtagaaaagttgtttttaaaaatcatattaatctatttctcaagtttaaaataattaatacttaattaatcacccactaatagcttaccttgttttgcgtatattctcctcttctcaaacactcaccaatgtttactgccatccaatcagagaatattttccatatcttagtttcatgttaatcgccttgttgttaactgggttgttttgaaataaactttgaaggagatacatcgtgttgtgcatccaagtaaaaatttctggacatcacatatgtgcatgtcaggcaagaaactattttagcaagagacaaccaggcatggaaccaggtttacatactagagaactatttttgttatgcaagaagacagaaggcatgcgtatgcaaaggacatctcacatgtgatgcaagctataaaccaccagtggcgcgaatcacgttggacaggccatggtccaagatccagaaagccaggggagccatcttaagaatcggacaaaaacaccaaagaaatggctgtattttgtacagcaacgcaaagctggtcagggcacaaaacaagtggtgcaggaaaaagaatataaaagtttctttgcaatggtagatatgtagatcaggttgttatcatgattttctttttctcagggaagccccataacagtaactgcaaataaagacagatggaagattaacagaaccaaatgatcacaaaatctaattgggagccagtaacttttgaaggttagtgtaggttaatcaaatgaaaggtttcaaatctgatagcttgactcattcaaacaatcaacgacccttgagaacttgaagcaacagggacaagtactatgtgacatactatccaatatttgagccagcaatttcagagacatgcattggcaaattaaagatttcaacgcttctgacgatgaaaattagatgttggagcatgtagtgcataaatatgcactagaatgatttaatattaataatcattccaatagataggaggttcccgattagcaaatccaatcagctctagcaatagaaaaaaaaatacaggagtaccagaaaacattaccaaccatttattaagcttacaatttcatcaacttcaaccatccacaatctgggcatgcaagcaaaatgaaatggattttactgaagccacaagttcataatataatgcaagtactatagatatagttaccgtgataatgcgaagaatcggacaatctaatacatgaagaacaggtagacaattgaagcataaacccactcttcagctgcaaagacaagacacttgccaacacgaaaaatccgatccaactccaacgggtaaaggtaaaaagatcaatctccctacacaattaagaagcattgaggtgattgcatgcacacaagcagttgcctcaggctccaattcatccatgagtgttcacagcttcccaaaccaaattctttggcgcagcaccactagtggctttcctggcctgcaatgcagcagccctcaatgtcttccatgtcaacacattagcctgccagaacgaggcggcggcataaggcagcccatgcttcttgcaaaggtcacgaacaaatggcgaaaccttcctaaggtggcaccgcgggaggcgaggaaacagatggtgctcgatttggaactgcaggccaccgtggaaccaatccatccatggcgagcactgaatgtcgagcgtgcccgccgtctgcttctcgaaccagtcattcccctttggcggcccgacatacacctccgaggagaagtggttcaggcagaactgaacatgctgaatcccggtaatcacgaagctcgcgaccacgaacgccaccctctcccaccaattgggcaagcaggacaccaccattgggtaccaaacccagaacgcggcgacgcccgcgatctccagccccctctgtggcaccttcctgctcgacagcaagaagacggccgactgaataaggaggtttatcctggcgaagcacatgaccgggtagaatgtccagtgctggtagctgatcaagaacttggacgcggcgtcgaacaccagggtgcgctggtagaagtaggaccagaggccgaacagcttggaggagacggcgaagagcggcatgtgctggaggtccgggtcgtggtcgaggctgttgcaggcaatgtggtgggtgttgtggttgcacttccaccacgcgatgctgaggccggtgaggcagttgccggagagcacctggaggaggcggtcgagcgcggcgtgccccgtgatccggtggtgccccgagtcgtgccccatccacccggactggatccagatgaacccgatgagcccgccggcgaggaggtgcgcccacgcgctcgcgcaggcgaggacgcagtatagcgcggcgcataggaggagcagcatcccggcgacctgcaccttcgggggtgggccccacccgctcgaacagccccccgaaggagagctgcgcgaggaggcggcggaagtcggcggacgccggcgagaccgtgtagtcctctagccggcccacgaggaaccttcccaggagcgggcgcccccacggcgggtggtagcggcagaacgcgtcggtggcgtcctgccccgccagcgtcaggagcgggatgtccccgcccgggtggtggggcacccacgccgtgacgtcgtacacgtccccggagatggagatccacaggtcgtccctcgacgcgtgcgcgcggagctcctccgaggagatcatgcggacgccggcgccggcgcggctctgcgcctccttgggggaggccggcattgtggccgtcgggatcgccggaggcatggtcggcggcggcggcggcggcggcgggattcggagatgggggaacgtgaggaggaggaggagtaggaggggaggagatcggatcttaaagaggagggtggtgcctcgctggtttctcgccttcgttgagaggggaggtggttcggtttttttcttttcttttctttttctttttcttttttttttgtttgggttggtgggtttaataaagttttttttctctcttatcttttattactctccaaaagtttaggagagagagaccatacggagttgtgctatgacaggctgacactgacagcagggttaacgtactactccctccgtcccaaaaaaaaagacaaactctaatttccgtgcccaacgtttgaccgtccgtcttatttaaaaaaattatgaaaaaaattaaaaagacaagtcacgtataaaatattaatcatgttttatcatctagcaacaatgaaaatacgaattataaaaaaatttatataagacagacatttaaagttggacacagaaactcatggtttatcttttttttttgaaacggagggagtacggattagcagtaataaagtgactaaagcaaactgcttgttgtgagtactgtgcttatttgtttaggatcggtttaatatttgaatcgtagtttgaaatcgattgtagttcgtttctagaaataagagttggatgactatacaaggtatattatcgtttattactatccgacttatatttccctgttttttttccccagcacagcactgtttgtttatcttgtttggttatctatgccaatatacattgtaatcgaaatattgccctatacgaacacagcacggatccgttcagaacgttaggtgtttttgtttagttaaatttcttccggtttgattaagtttataaaagaatatttttaatacgaaataaaagtatcatagaaacatccataatcgatgatggacttaacgaaattaatttggtgttgtacatatttctatttttttatataaacttggttagacatagggaagtttaacttacaacaaaaccaaaacaccattattatataaaaggaagtagtttacattttttcaagagtagattatatttgatatatgactcttgcttcacagttttttataaatacaattgtactgcgtatacatttagcgagtaatctaggatatgttataatatgattctaatttgatcaaagtgacacatatgctatttttgtataaacgtggtaatttcaatgttcttagagcaaatgtaattttatgaaaatgacaatggatttatgcatggagcttttagatgctaaaatgaatgttatgtatcttttagaaaaacaaaatagcagactcaaagaatgtaatgattaaattaattttagaaaaaaaaaacaactatgctccaattatgttttctttataacacatctcaggtcttttttttcgcgaaaacacagattggtttcaatctttctaccttgagagatattgtggtacttattcttgcgttttgtttttggcagaataaatgaagaatggtatactctgcatgtccagataaacaagaaagtgatgtgcgtgggatgtagcggtgtagctagggggcaaaatatctaacgtactgattttgatgctcaagaatatatccttttggatcatttaataaaaatccttagggtgaggaatacatatatttttattttctcaaggacattcaataaaaatggagaatgagacaacgagaactcgcacgcacgatgcctgataaggcaagaaaaccattatctttaacatacaacaattctcgtcaactcgatctcgtggtgtttttttctctttaacttcatttcacataaaggcttaatttccttctcttttagaggattttcaatgaaatttttatcctataattcaaacgagccctcctaaaaaagaggtacattgaaagtcagttttgctcaaatgtgcatgttaacctattttgagtttactacaaccaattcagctcgttgtgttagagcgagtacaataacaagttacaagtcagctgtacgacacgtggaggagattagagaagagagaggagagcggactacagatttgtagtcagctataacacaggctccaatacgttatgtgtgtatgagatgtgagactatatattaacggtgtagtatatgattataagtaactattgtatgaataagctattagattggctgcagaagttggctatactattaaacttgcatagtacaatatcatcttcaattcataggagtgagtgtctgtgttttactatgtaatcctaaaaaacagaatcatccttctaacttacttttctgccttaaattcagagggaaaatgacgatgctgacgtgtaaccagcatcttaacggcatctcttttgggcaaacccagcgtgatgcctttcatcatctcttcttcctaactctctctctctcccctcgcgatacacatgcatacgcatggtccacagttgtacacgtgatgcccatcacttatcagcaaaacacagcgatcgttcagtgaggccgtgcctgtagatggcttctcatgtggttcgcaaaatcacaattggcacgtttgcccgcagaaacgtcgtcacttgcgtcgacgcgtacgtggtgcatgcccatacattcgtactgcggctttgtcaaggggaaactgtgtgcagaacgtgcaagagatttgcaatgcaaccagtggagtagaaactgccgtgaactagtgatgttattttaggggaacacgctacctaggtggcagataactctaaaacatgtactccctccatcctataatataaaacgtgcacacattcgaagattcaacatttaaaacatttgaccaaccttagtataatatgaaataaattttatttgttaaaaaatatatcattagattgagatttaaatttattttcatatgattataattttgatgctataaaatttatagtatatgagaaaatataagctaaagattagttttgaagaccgtgccaactttgaccgcgccttatattatgggatagagggagtaagggtattcacaatgcgtcaatgtggtgtaaccctaaccagccagcgaggagaatcccctccacacgagcgacattcatgctcccatgcatggaactccttatgtccactctccaacctatcccatcctatgaagatgcatgactcccattaggctttgttagggtggggtcacgtcacacacgcgtggaacaatgggtcaaagctgcgatgaggaggtcgtgcccctgcgacgtggtgtggtccccataccccatgcccacacccacaccctagtgtctcctcaaactctgatggccagagaacaagagcagagaggaaagaagagcgacctacctttccaacgtcgacatcaccgttagggtagacagagaagacatcgacgatgacctcgaccactccacatctaaagcccctaggagctctccttctcgttgcccccttaatccagctcactgagcttgtcaacaagccaccaagtccaccatcactgcccatcaccatcgagctcaatctcgatttgacgctcatcacctcaatgccattatatctattggtgcaaacatggcgagaaaggcatccagagcgacgagaggaaaataatcgaggatagggaagggaaggagaaaaaagataggagagaagttgatatgtagattcggtagaagagttaaggatattttatatcctttttattgttgtatgctgtaaactataaaagttttaattagtttaataatagaaattattataggggctgatatagaaataattagggactgaaaaaaggggaaaaggtctattttacaccctcgacctcttatgcttgtctaatacaccatcgaaccacaaaaccgggtataatacaccctcgaactgtcgataccggacacttaatcccccccaacccccacaggtgtttttacggtggtttttttgacacgttggatgccacgtcaacccataagaatatatgggccaagccctttttctctctccatgccctgttcatgcttatcaccctcacgagcattggcggcggcggtgacgtgaagttgcgagggcagcgatgttgccagggttgcggaggcttgctatggacaacggtgtgggaaagaagcatctctgacaggttgcgcgcggtcgccggcggaagctctaggtgtcgtcgccgcacgcgcctgtagagatggctcaacagggaagaaacagcttgatgcgggggggggggggggagcaacgacgagcttgagcttgtggagtgttcagccgacagaacaagcagatggaggagcacgagcagctctagaaatggcgccagatccaatctagacagaagcaatccacttccgattcaatacagagagggtccatttgattattctccagctactctatgcgagtgtcgtaggaaggcagcaagatgaatttcttggaatgtggataatccatctcggaagcatctgacataagtgagagctcgggtgagttggtaaaatattagtgtaatacatttgttgtttaaatagaagtaatattgtgcaaaagtttcttatgtattgagcaggatggtgacggctctttctggagttggtatgagctggaaacaacaccttatttaaggcaggtgttaaataatttgcacaatgaaagagaagtcagggatgagagcatatattgtgagtgcgagagcacaaatcgatgagctaacggctgcgtgcaatggagatgtggctgattggacaagaaaactaaaggagaaagatgattcagcttgtaaacttaaagctagagctattgaattagaggagggaaggaaatttcagcttgtaaaccctcaaagctgctgccgccgccaacgctcgtgtgggagagaagcactaacaggctcatataatcttgtggattgacgtggcatccgacgtgtcaaaaatcacgataataacagccgggtgagggggggtgttaagtgttcagtattgatagttcgagagtttattatatccggttttgtagtttgagggtgtacttagactacgagttcaagagcgtaaaatggacttttcccaaaccaaaaaaagtacgcctctatcgtgggtcagggtacacaaaagcatcgtacactgaatggcctaatgcacttatatatggatctcacgagtttgagggccattttgatttgaagtcaattatgctaccaaaatatagttgccactttaaataacacttaactagtgtttggtttgtaccaaaacatgccaacatcacatataagttgccaaaaggttcgcaataccaaaacatgactaggtttcggcatgagagcaaaccaaaaccaaccaaagagagcaacataatgtcaacattgctagaaaaccaaaataacagataacctggtgtgttgaaattataatgtgagcaccaaaatatatagtaacagcattatgccagtaactccaattagtatcttaaagggtttcaggcaacacagtaaccactcaagcattcttatttcgtgttggggtattctagctagagaacaaggtgctaacctagcagaaaacattagttgccagcctgagagctggcaacttggcaagtgaacagatgtacaatactagctgattgtcttgacagaactatcacatggttcatagaaatgtcttcaccaacaccagacaggcctgaaaaaattcaatcgcacaccaaattagatatcatatatgccattcgctgttttttctagtgtaaatttgtttacagtaaattttgattggttaactaaattatctttgtactatatataatatgatctgtagcatttaagagaattgaacaacaaaaataggatttctggagcatcctatgtaaggaacgtgtcaggaaataagaattaaatattgagtgaactgcaccggcggtccctaaacttgtgcaggtgtgtcacttaggtccctaaattctcaaaatgtatttttgggtccctcaacttgtctcgggtgtcatataggtccaaacgagctctaacctgtttcgtgggatgatgtagcatgccacggtgacgcttacgtgtcagtgagatacacatgtcagtcacatagaaaaaaaat

SEQ ID NO: 30988 - DNA, 16946 bp, Oryza sativa
agacaagttgagggacccaaaaatgcattttgagagttcatggacctaggtgacacacccgcacaagtttatgaactgcccgtgcactttgctcttaaatatttatctgggcctttaaaagatcatgaattaaactgcaaaaaaaatcgaatgacttcaacaaacccagtgaaaaatcagttgacaggtagatacataatatgaacaacactgatggagaatgacatttaaaaatagccacacagaagaggaaggcctaacaaacagacaggtttcaagaaaaggactgattgggagaagaattcaaaacatgatgtagtaagacaagcaaccacataattcaaaatttgccactgtaaaaccaaaggcaatattatgaacaaaatttgcctgtctgctctgtttgagaagtgtttcaaacaagattaggaagttctatgtaactactattatgcaacgcaatagcactagaaaatagaaactaaatgttgccatggaacacagaaagtcttggtagagaatacagtcatagatgttcggaagcaaaaccacagagcaagagaatgaagttaaaaaatttcaaacaggagacacaacagggagtagtagatggaggacaaagtgactttgcttactccaacatagaaatggtaaaatttgcaaagtattaagtcagtagggaaccgagagcttgagcccctccatattattaatttattatcagttcaccatgcagtatcaatcagcaccaatcaacagcgagatattgtcttttggtaaggtttacatgcagtccaagcaaataaagcacgctctcaaatttcagcaattgatgacaaactattagagatattatcttttggtaaggtttaaattcagtctaagcaaataaagcatgctctcaaattttcagcaagtgatgacaaactattgacaaacaaaaaatctcagtagtacttaagaaaaatgaaatcctgtgaccaatattcaatattgagctggaacctacagtccagctaggtggaacatgtgtcctagagccagaactaactctatagttgtagtcttgtagatttatgcacacctaaaaaaagaaaagaaaagaagagcgaactgcaaagccaacaaaactcaacaaatttatggaagacagagcttataaccactgctctaaacgcattgctgcataacattgggacgctaactttgtcttgtgctgcagtttgtttttcattttaagaaatgagatatagtagcggaccctcattgattagcttgtgcaagtaagaactgatagcctgagatttgataggtgactagaaacatcaatgacaacccaaacacccaacagtcatattgacttattgtcatgtagccaagtttaaccatgtgacaattattggtaatacaatccacgaaactttggcatgtcaaaggatgaaaagcatgctctgaaattccagcaattcatctggaacaattgtcaaacaaaaagacgtgaaacaacaataagatgaaatcctgctaacaaaggtaaacttggcgactttcttgtattgatcccttggaagcaagacatttttccatttttttaacagctgatacattgataaaaatgatttatctctgcacagtggtgttactttgttctgaattttacctttccttttggcatagtgagaagatctccaaagtaaatgaatgtacactcagaactaatcactgggaaaacattgcgtggattgttatatgctcaaaacgtgccacaggtaacctatcaaattcacaatgtgaagattcatgggtgcaaggttactcaagcaacttaatagcagccatagcaattccacatctcccttatgaaataattatgaaataaaacaggatatatcacaaagcagcagagccatgtacctatctatgtgtccttccgtgcacttcaaaagcagccagggattagctctaagtgaaagctgtctcagtgctgcgcccactggatactcttgaggtcaatgcctgccttggccatctcatacagtggactcatgtcacgaagcttcttcacctgatgcacggtgagctcaattgctctgtcaacctcttcctcagtggtaaagcggccaatgccaaagcgaatggaggtgtgcgccatgtcctcttctacaccaagtgcccgcagcacataagagggctccaagctggcactagtgcaggcactgccactcgacacagccacctccttcaggcccatcagcaagctctccccctcaacatatgcaaatgacaaattcaggttaccagggtaccgatgctccatgcttccattgataacaatatcatcaacctgtccacggatgccatcaagaaggcgctgctgcagaaccgaggctctcctgtgatcatagtccatctctttagccgcaatttcgcaggcagcaccaaatccaacaacaagaggcgttggcactgttccactgcgaattccgcgttcctggccaccgccactcatctgcggctccacacgaatgcggggtcgacgacgcagatagagagcacccacgccctttggcccataaatcttgtgcgcagacaaagacatgagcccaatccccatttggttgacatcaatcgggatcttcccgagcgcctgggcagcatcagtatggaagggcacgcccttctccttgcagattcgaccaatctcctcgagtggctgcacgacgccgatctcgttgttgacggccatgacggagacgaggccggtgtcggggcggatggcgtcggcgagctgcgcgacgtcgacgaggccgtcggggcgcacgggtaggtaggtgacctcgaagccttcctgctggaggtacctgcaggagtcgaggacgcacttgtgctcggtctgcgtggtgacgacgtggcggcggcggtcgcggtagaagcgcatgacgcccttgacggcgatgttgttgcactcggtggcgccggaggtgaagaagatctccctggggtcggcgccgacgagggaggcgacgcgggcgcgggcctcctcgacggcggcgtcggactcccagccgtagaggtgggtgcgggagtgggggttcccgtagcgggagaggtagaaggggagcatggcgtcgagcacccgcgggtcgacgggggtggtcgcctgcatgtccatgtacagcggccgccccgagatgcgcacgcccttgatggtcatcgcctcctcctccgccgccgccgccgccgcggcgggagcatcggccgtcacggcggccgtggagagcgcgcgggcgggggagagggagggggtggacccgcggcggaggaggagcgggaggaggcggcgggagagcgccatgggtggagggggggagaggtagggttcggggattggcggtggcggcggagatcgagctcccgtttcggcggaggggtgatttggggagaaaaaaaaaaggagagatagggaggagatgggttgaggagaggataggcaccgccgtggcggtgaggttggcaactgggccacgcaaggcgacgcgtctgactctgagcccgtcgcggtcgcggtcgaggcgacacaccggttcggcccgttgtttgttgttgggccgtggactactggtgagtcataaggtcatatcatattaacatagccaatccaaaatttatttctcttctttaaattttgcttttttaagaaaaggcaacctgccaatttttattaaatagagaaggagtaaacggagagagctacaaatcggacgtccgacgttgtaataaaaattggacagtcaaatatttcggttgactgttggtgcaacattaagttatacatagtgaaacaaaacaaaaaagtcagcctatgaaacatatagaactttttgtgaaacataataagaacacatggtgaaacatatttctatcacatatgaaatttttattgtctgaaatatatgtttttctttcatcaaaatataatcatgcaatatcttgttgtaaagatttaattataacgaatttaacggtgcgatcaaatcgttcaacgaataagtagtttaaaagaaaaaataatttttaagatcactaaatacttgcatcatgcgtggtgtgtgggagaaagctaatagaatagcatgagagagactaggggcaatagcgtctcatattttttcggtcattggtgaaacattgagttgcacatagtgaaacaaaaaaattagttattgaaacatttaattttttttatgaaacataacaaaaacacacgttgaaacatattgctactgtgtctgaaacattaaatttaacggattgaaacatatatttttctttcatcggaatgcaatgatgtgatatcttgttgtaaagatttaattgtaacaaatataatgatgtgatcatatcataaattggataaatagtttaaaagataaaacattttgaagaccatcatatgaatgtgtggagacatggggtactattagtagtttgttcatccgatcttttttttcgttggacatctgatctcctcaagcatttcgggagtgaactgtacaaagacgaaaacgagctcaagacctttgatccgagctaactaaaagaaagccaattatgaagatttttcacgcccgctaatgcccaatttttggcctgtcacgtccggaaattcactagtaatttccgaacttatttatgcataaaaccctcatctaggaatcagccgaggtacacaaactgacaatttaatatacaaatccatcataataataacgttacatacttacagaagaaaaaaaaacagcagtggaattaacggtctagcgatggcttcagctccactcccacaggcagctcaactggggtataagccaaacgtcttctctttctggatcctttttcttcaactgaggtttgatgattattgcaagatgagcatatgacatactcaacaagccacacagcaaatatgcaagtgcacaaggataccaaaggatggcataatataggctcatttgcaaaagcagcatttagcaaagatttaagagtaaaacagtagagtaattaattagaaattttaattaacactgaacagcacacccgtgctgctcaggcccaaccatcctgaacaaccatacccggctgtacagatctaactccaaaccaggaactaaacaaattattaccagttattgcatcaataattatttgtgagaggtgtgagactaatcacgaaaaacatttctcaacccgcccatgaccgcgggcacggccattcgaatagttttactctggccagagatgtaccactgtacccacaagacacaattccacacatgttgccatgccccgaagtaccaccacggcactacaaagggggaaattgtgacaatacccttcgcacaacacaactcaccacagtgcaccattcctggatcataatcaccccctcaaaaaccagaggcatggactccccagcgaccccacggacttctcgccgcttcttagtctggcaccccgcaatgaatcatgctatacaaaaggtaaagccgttgcccacgctggcttgtggttggcatggtaattgtttcacaacagtagctcgcgaaccggtccttaattatcatgagcatgaccttcaaaaccatgtgctcacaacccgccattgtcaagttttaattgtcaattaattatcataacacaattaaccatcgtgagctaccattaaatataaccataaataataatgtagtatgattcatcccattagtgagctaatgtttctaagcatggctaagcaattatatatatatatatatatatagcatttagctgaaccaaaccaatatataaggttccagctaagcaaattataacccataggaaaataaagtcatcttcggccattaattaattgggaaaggctcaccacccgatgacattcgaaaataatgcataagttgaaataaaacattatctttaaacgggttcaacatgctcaaagggttgtttggaatctgtgtgacttgccttgagcttccacaaacgcttccaaaccttcctcaacgaaaacgttctcctccggaacgtcggaaactaaagcaaatgaacaaaatcaacaaaacagtacaaaaacaagcataaatagtacatgtggatatttttaacatgtagatctcgattttagatgaatttagcaacttgaaccactcgaatccgagttatgatgatttagttatgaatttccgaattttaatcgattttcatctaatagagaaaactaagaaaaagggattaatgacgtcatcgctaacatcatcgccggccatggcacgacttcacgcgaccaccggcaaaagagggctcggttgggctatctaagggcacctacgcgtagaggacgacgacgcgaactcaccggtacaagaaaacacgacggacgacgacggacgacggccggcggcgaggttccaaggcggcacggttcgggttgacggcggcgatggcgctccggtggtcttcggcggctgcgaaggggcggccgaggttcttctcctccgtgcgcacccgacggcggcgacggacggcagcggcgacgatgctagcggcggcgcgacgcgaccggaggatcgccggcgacggcggcggctagagcaaggcggcggcggctctacgggcgacggctctacttgggacttggggcaaacggaagaggacatcaaggggatgctttatataggcttggactagagagatcggactccaaacgagaggatttgaaccggaaaatcctagggttagtttggagagataaactcgaaaacgaatccaatttcgcgtcgaattcaaagggataaagtcggatttttgggggaagagatagaggaggataagaggaatattccccctcaactaattttggtaaatacacgagataaaagaccggatttggaggggaaaacggcggctgcacaggtacaggacggctggctcgggctctgtccaagcttgaagacgacactgtagcagggaggcgtactagactttcggctgggcttctgctaccaagggctaattaagggagggacaccaagcagacttcgggaaagagagggaaaagactgcaggctgagagagagattgggcccagcaagtgagaggacttttcctaattcggcccgaaaaggaaaaaggggactttaattacttttctaattaaattaatcactgaaatgatccttgaattgttaaaaatacttctattgctcaaataatttcaagaaaaatcctgaaaatacttggacactcaaagtatttaaaaatattaaaactagaccatttaatgattaatttaatatgtggataattactgaaatgttgtttgtatgattaaaattaggaattgagctccgaaaaatccaagaaaattccagagagtataattaaccatggataatttaataaaaattaaatccatccatgctttatatttaggaaattttatttcccacatttaacttctcttgtaaattaatgaacatttaatataaattctaataataatttattaactaatttataaatcctaagacgaaaatcaggatgtgacatggcctcttccttgattttggccagaagggaggtggtcaatagctccttttgctgaaaggttttgcggtttctctcattccagatctcccatgcgaccaacagcgtcagtgtgcgaagagccttcttggtacctcttggatgtttgaggtagcctcccaccattttaacaccgtggaggtttgctgccaccgacatggtttcgatccctcacacgccgtccattccgcaattgcctcccaaattttatttgtgtatctacatcacacaaagagttgaagggcagtttcttgagatcgacgacataagggacatatggaaccgtttggccatcctctagttgctagtctatcggaggtctatactctgttttggatgattagccatgcgaaggttttgaattttttcggcgcccaggtcttccaaattaggttattaaagttggtggcagtggtgctgaggagttgcgtattgtaggctaatgttgctgtgtattcgccatggctggtaagcttccatgttattttgtcgacctcttgctcttctagttgtagcgtctaagtgacggtccagattgtgacaagttgatcagttaagtctatcgtccatcctgcatttgacggcaggtccaaatcatgaagccattggtcagattgcaaggcctgttggatcgtcctgttctttttcttggatgctgcatagactagaggagctacatttttcattctccttccgtcccaccaggccgaattccagaagcttgtcttcgcaccgtttccaattgctatggaggtggcagccaaaaaaggagtttgtcggtgtcttctttaaaatttgatgaataaccaaacgaaaatgcaacgaactgacaacttaggctgtctggctgtggctgtgttcgtttattcccaatcacaacttttactctcttcgaactactgtacttaaaacgggatgttcgtagaagtgcataggcggtacttaaaattgtagaggtgtgttatctgggtccctaaactctcaaaatacagatacaagttatataacttgtaaaagtgtgtcatcaagatcctaagtcaccacaacccctctaaaatcctacgtggcgctaatgtggcatgccatacggatgtgacctggcattatcttaactgacaaatatgatccacttaaaaattttatttttccttttttcttcttctccttctcttttttttttcttttcttctcctttctttgtgacctgagcaccccgtgtggcggtggcctgtagctgcagtgagaggaaagagaagaaagcaaaaaaaaagagaagagggagaagaaaaagaaaaagggaaggaaagaagaaaaaaaggaaaaggaaattttttaagtggatcctattcgtcagtcaagattataccacgccatgtccgtgtggcatgtcactttagcgctatgtaggatcctagaggggctgtagcgatttaatacctagatgacatattttgataagttataggaccttaattaacattttgagagtttagtgacatatgtgacgctacctatactctttacaaaaatattcaactttgaaatttatattaatgaactattccattttacatgcgcggaagggaaatttcccaaacttctctcccgaacacacccttatatgttctccctccataccaaaatactccctctgtcaacgtatatgaagtattttcttggttatttgatatagattaccattgaaggaaaaaactttaatatatgtcattaaataaaagatggttggaggtaagatagggagggaaatttaaatagaatgttatatttatgtgcaaattttaaaccccccaaatactccaaatatttatatttatatttatattatatagaactactattaggagcattccaagcaccaaacatgcatcggcccaggtccaccccaccccacgtcccgtcatcccactcctaccgttgttggagtaaacgatttactcctatcgcgcacctcaaccacccacctttattcgagtaaatgatttacttcgataataaaaacaactcccccgcttccgatcccaccccacgtcctgcatcgtgcacccaccattatcggagtaaatggtttacttcgatgaaaacaacttctctgctggcggtatatattctatttttcccgtacccaaccaaccactctcgcccccactccgttttttcctttttttcggatctgaatcgattcatcatcccagtccacagatcggtgacacaccatggaggaggacgactacaccgtggcggttgatggtggtgtccggtgagcgatggccagcggcggttgaggcgaaggcactacttcgggcctcgctgccggacgcaagacaacaccttaaccagcaaggaggtgttcacctgggccaatagcaacaatcagcggttgctccacgtcggcgacattgatagaacaagcaagtaaggaaatgacactttgatttgcatctgcatactctccttcaacttcacacatgaagccctaatttttttttgcaaatcaaattaacatgtaatctccaatattacctgatctcaattgatgggctgcacaggttctacatttgcacatcgtgctccatgtggctggccgtagaggatagggaccggtgatggagattgtttgctagttttcttttgctcgtcatctgtattgacatgaacgagaatgtttttgcattttttttgtgcttgctagatgatggatggctgcgattgcgcaacatcgagctcatctcttaccacaccgctacatccttccatgtttccataatggatttttggctgaatcattttttttctagtttgattcacctgtgagtaattttatcgcttgtgtgtgattgagcccgtaactttttcattcatacgactattttgtgatacagatcaacaatcactggtggagaaaccgtttgtagtcccggttcataaccccctttagttccagttgtccaaccgggactacgaatccaggactaaagatagcgatctttagtcccgggtgaaataaccggcactaaagattgatctttagtcccggttggtaacacgaaccgggactaaagatcggtgtactattttttttatttgcatggccttgtttgctgcatggttgattatatatatatatatatatatatatatatatatatatatatatatatatatatatatatatatatatatatatatatatatatatatatatatatatatattaatatatatatgtatgtatgtatgtatattacaatacatatatattacaatacatatatatgcattgtaatatatatattatgcgcatatatagaatacatatacatacatacatacatacatacatacatacatatatacatacatacatacatacatacatacatacatacatacatatatatatatatatatatatatatatacatatatatatatatatatatatatatatatatatatgtatgtatgtgcatatgtgtatatgtataaatacatatattacacacatatttataatttaaaccacttaacattttatgtgcatatatgttaccaaaatatatattaacactaaagaaaatgtacatacatatataaatatatatatatacatgcatgtatagtataattcatttgctcgctagctatagctacgacttcgacgccggcgttatgtcagaagaggaaggaccgatgttatgaattgtcgatccgtcgtagtagaattcaccatcgggattaaggacttcttcgttgatgaaccccatctgttgttcttgaacagccgtgataaaatccttgtgtgggagattttccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatacgtagtagccgcataagttagttccctggtcctgctttgcacactacatgagaaatcatgagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatgtgcagttgcaagctatgattaattaattattacccgagatcaacataatagcaacagagtcccgcgactttggaatagatggcattatattacctgtctatcagttagaagaccttgtcaaaaaccttctcctctttattcattgagtcatacatagtgactctgcatgcgtccaagtcgaaaaataacaggacccagtggataggggtgggcagaagaagaccgaaccgaagaaccgaaccgaaaagaccgagaccgagaccgaaaagaccaagaccgagaaattcggttagtaattcggtctcagcatgttaaagaccgaaatttattcgggtaatttggtcattggtctcagttaaccgaactaaccgaaaaaaccgaattttagcccaataggctaggaggcccaataggcccactaaaccaaaccctaggatggacacccaactcccactcagccactcctcacagccgcaccgcactccctcagcacgcacagcgccgcactcccatcgtgctctccaccttcctgcctccacaaccaccgcgccggcgccgcctccagcaccgcgccggccgcctcggcccgacctccgcccgcccaccgtctgtgccgccgcccttcgccgcctccgcccaccctcagcttccaccgccgctttccgttaccaccgcggtcggaacgcgccgccggcaagcagccacgttgtccctccctcttcttcggtcgccaccgccgccgccgctcaagctacggctgctgcggggtctcctgctgctgtggggcgtggctgctgctgcggcagccggtcatcgccgtcgaggccggcgggttcctccggggccttctgctgctcgtctacccgctgctgtgcctctcctcgtcggctacggcgacgacgacgacgacgacatgctggggaggcccatggcgacggtggcgctcgtggggctgaagaaaaggaaggtgacgaggggtggcctgggctgaaataatttggtcagactgagaccgagaccgaaaccgaaaagaccgagaccgaatttgccggtcctgagttttttggaatgaaattcggtcctgagttttcaaagactgaaatgaccgaaagaccgaagaccgagaccgaatttttcggtctgaccgaacgcccacccctaccagtggaatttggaatatgcgtgagatgagataaatatcagaatgtacatgttatatggatgggaatgaaatttgttcgaacgacaataaaaactcactctgtgttgtacgatagtagtatgaacgtcttgaaatgctgctgcgttaggagatagacgagattgtcctctgtgtctttctcgtacttgtcgatcatttcagtgttgattttccgagggtcgatgaacctagtatcgtaaactccccgccgtcgggccctttgaatctccattctacaacgatgaaaggaaattattattgctttcatatatgccaggagctaattattgaacgaaacaaatcgaactcaaagatacttacaaaatctatgcgctcagaagagagacgtcgagggcgtccagatggtacagatcgaagacatccttgaaatggatccatagaacatcttctccttgcagaaagtcggggtttctaatcctcgctccgaacatctctctacccttggcgctcatttccatgtaccgttcatggaatttgtacatttgtgtcagtggggactgcagctgctcaggcctgacaagcggtttaccgagttcaaacttatatgccacttccgccttcgggattggtgcgcttccaaccaactgatccacagttagactggtgtccgaaatgaaatccgttatgccaaagtcttcgccagtcaccaacggctcgacctcttggtttggctgttctccaagctgaggaactggtttggacttcttgtaataggctttcctaagtgttcggtcatagtccgatagctttaagacctccttgtttgtggtggacattcccttgaagaacttcttcacgctcgggtcaataggtatcttctttttaggactccaaggcttgagttgcctcttcacttctcctgccacataagcatcaagctcctcttgactgcaatcgtacggcggctccttgtttttggtggcgtcaactttcgccttcttcgttgcccttgtgcgggcaagaggtggagcttggcgagaccttgtcttgggaggtgcaggcggacacggtggaggtggaggtggaggaggcggaggagtcggaggagccggaggagatggtgtaggaggacatggcggaggaaccggaggagatggtgcaggaggagacggtggagccgaggagatggtgcacgagacgccgcttgtcgcccagggaggatgatgtaccgcttgcgccatagtataatggcgtggcttgtgtctcgtagatacgtctcaccgtctcctcctgggtagtccaactcagggtcctcgtatgcggcttccaccagctcaacttcgaccctcgagtatcctgctggaatcggcctgcagtggtaagtccctgaaatgtccattgggatggccattccagacgccaccttcacgtgatgagaggttatctattagtaatcaacctaagcagcaacttgcggaatgtacaagtcaaaaatcacaaaactacgagcataccttgattaataagttcttgaagggaatatgcagctcacatggtgtccgctgcgtgatcccatcaacggggcaggtggtttcgtcctgggtttgcatggcgtccatgctctgtgatcctacctgccccgttgaggcgcagctactacgattgcctgatgggctgaccattggaggaggtatgtacggctagggatcctaggaccgatatgctgccatgcgttcatccaccttccttgccacctcctcttgcatgttgagctcgtagctcgataccctgtactcaagatctgcaatcttcgcctcggtatctctcttgctcctcatccgactcctgtacgtgtggatgtcctccttgaatccaatcttccagggaatcacgcctttccctcgtgttcgtcctggatgctcgggagtctgtagggcaagtgacagctcgtccttctctctgtcgggtcggaacgtgccctgagaagaggcttccactgcatccgttagtcgactggcagcctcgcgtatctgattgctgaagacaagggagccatcaactgggttaagcgttccaccgtgagcatagtaccagaacttcgatcgatccggccatttagcggtggccggttcgatacccctctcaatcaatcttgcctccatctcctcccacttcagcattgcgacgctatagccgcctgaccccaagtggtgatggtacttcttcttggcggcgttttccttgtttttgaccatcatcgcttgcccttgttggcctgccttgtaagcaacgaactcgtcccaatgatcccttagctttgggaatacgttgaagttcggtgttagtcccttcaagatgtatttcttgtagagatctccttgaagctctggaactgttctgccattttctttagagtccactgtttcactatgttctccgtacccgcagggagcgtgacttctcgagcattgtggtccacagcatctctttctctgattccgggacaaagctgtcattatccccgcgtgcccttgttctgcgccagtacaccctgctgacaggcacgttatcccttacaacccaaccgctgtggcgtacataattcttggctgcttccgccggggcactaggtcggccgtcttcgtccacctcagtaatgatgtgccgaccctctatctttttcgcgacacctcgttgtccgcgtgccctcttctgtccagcggagggatgacttccactagcctcctcctcattcccctccacatgcctctccacgttcccctcctcgttcccctccgcatccctctccacgttcccctcctcgttcaagtattggtttggatcctcgttcccctcttcttcgttccagtactggctgcttccctctgcgattgtatcgtacaatatctgttcctcatcgcgatcagccatctgttcatagaagaaatatttgctaagttcataggtcatatttgctaaccgtaatattaaaactcaaataatcatatatgctaagtctaagtgtcgtatattagaaccctagataatcatatatgctaagtctaattaagtttcgtatattaaacctctaataatcttatattaaatctctaacaatctctaacactcacatatgctaagtctaattaaatttcgtatattaaacctctaataatcttatattaaatctctaacaatctctaacactcacatatgctaagtctaattaattaagtttcatatattaaaccatattaaacctctaataatcttatactatatctctaacaatctctaacactcaaatatgctaagtctaataatctaataatctctaacactcacatatgctaactctaataatcttatattagaaatctaataatcttatattaaatctctaacaatcacatctttacatcacttgcctgcgcgaattctttcgagggctagctaccacttcggcttgagggacgacgacgacgacgtcttctctacaacatgcaaaaaaatgtattagtctaaacgcaaaggaacatatattgtatttcacgttttcaagtatatataatcatatatatatatatatattctaagttcaagaatcttttaattatctcgttcatacacgtttcgctcgtgttcgttctcacacttttaattcaagtgcattcacggtcgtcggcgtttcgttcacgttcgttcgcgtttcatttacgttcgttcgcgttcgttcacgtttcaatcacgttcgttcgcgttcgttctcgttcgttcgcgttcgttcacgttcgttcacgttcgttcgcgttcgttcgcattcgttcacgttcgttcacgtttcaatcacgttcgttcgcgttcgttcccgttcgttcacgttttgttcatgttcgttcgcgttcgttcacgtttcgct

SEQ ID NO: 30989 - DNA, 4098 bp, Oryza sativa
taattaacatatgtaaatatgacaggcatgatttaaaacttttaaaaattctaataatcatatatacctagcatatgcatgatttaaatttgttaataatcatatataactatcatattcaatacatacaaaatagtttacatcgtgtacacaacaattacggcaatacatcggcggtgacggttgtccgcacgtactttctcctcactactgttccttccttgtgatcgctacgtgagtaaggggtgtcttcatttgataggaggatgctagggtcaatcgtcaccgtgaaagtgggttgcccatcaaactgatcgtaatcctcgtcagtcttgtcctctactccgacgatttttcttttgcctgggagaaccacgtggcgcttcggctcgttaggccctttgcccttctttcctttgctagacatgtccttcacgtaaaaaacttgcgttacatcattggcaaggataaaagattcgtccgagtatccaaccttgttaaggtcaaccgttgtcatcccactgtcatcaatcgttacgcctctaccagtcaacctaacccattggcaccggaatagagggaccttgagaggtccatagtcaagttcccatatctcctcgatggcaccgtaatacgtgccagttgtaccatcgtgtcccatggcatcgatacaaataacactgttctggttcgtgctcttcatgtcttgggctctcgtgtagaatgtgtacccattgatctcatatccctggaatgtcacaatcaagccagatggacccctcgccaggaaggccagttgctggttaatcgcctcgttacccatgagatgttgtcgcagccacgcgggaaaagtatcaatgtgatgccatgtaatccatgcatcggacttatcgatgtttgtggcgcggactagagccaagtgctcctcgatgtaagaagccaccaatgaagattgttgcagaaccgtgaaatgggctttaggaataaattgttgtccaccgtcattattgctttccttccgagagtcccctttccccgtagtctttccccgtagtctcccttcatggcgtgattcaggtacaccgattgggcgaaggtcttcaataaattctatgtagaattcaatgacctcctctgttccataccccttggcgatgcttgcctctgaacgagcacggttacaaacatacttcttcagaacgcccatgtacctctcgaaaggaaacatgttgtgtaggtacacaggcccgagaataccgatctcttagacaaggtgacaaagcagattcgtcattatattgaaaaatgaaggtggaaatatcaactcaaagctgacaagacattgcaccacattattctgaagggcttctaatctatccggatcgatgaccttctgcggaattgcgttcatgaaagaacatagctttgttattgttgcccggacattgtctgggaggataccccttattataactggtagcagttgtgtcatcaacacgtgacagtcatgagactttaggtttgtgaacttcttctccttcgtgcttattattcgctttatattcgtggagtatccagacggtaccttgatgctctccaagcattcaaacatactttccttctctgccttgctaagagtgtagctggctggactcaagtaatggttgcctttctcctttggttccgggtgaaggtcgccgcgttgttccatatgcctcagatcattacgtgcttccagtgtatctttcgactttccatatacacctaggaaaccaagaaggtttatgcaaagtttcttagtgaggtgcatcacgtcgattgcgtggcgaacgtccaagaattcccaatagggtaactcccaaaatatggagtttttttccacatcgccgcgtgaccatcttcgctctctataggctggctgccaggcccctttccaaacactactttaagatctttcaccatagcaaacaccgttttcccgctgcaatgtttaggcttcgtacggtggtctgccttatattcaaagtgcttgcctttcttccgtactaggtggtttgcagcaagaaatcgacgatgacccatggacacaaccttcctacagtgcttaagatacatactttctatttcatccatacagtgagtgcaagccttgtaacccttgttggactgcccggataggttgctaagtgcaggccaatcgttgatggttacgaacagcagcgctcataggttaaacttctcctgtttgtcctcgtcccacacggggacaccttcctttttccacaacagtttaagatctttgaccagtggtcttaggaacacatcgatgtcgttaccaggttgcttggggccttgaataataatcggcatcattatgtacttcctcttcatgcatagccaaggggggaggttgtagatacacatcgtaacgggccaagtgctatagccgctgctcatctctccaaaaggattcatgccatccgtacttaaaccaaaccgtatgtttcgtgcgtcctttccaaagtctttaaattttctgtcgatgtttcaccactgcgaaccatcggcggggtgtctcagcatcccgtcctgttgacgctcttcagcgtgccatcgcatcattctagcatttcccttgttcctgaacaaacaccttagtcgtggtattatagggaaataccacatcaccttagcaggaattctcttctttgttagctgcccgtcaacttctcctggatcgtctcgtctaatcttgtatcgtagtgctttgcaaatagggcatgcttctaggttctcgtactcctcaccgcgatataggatacaatcattcggacatgcgtgaatcttctgaacttctagtcatagagggcagactatcttcttagcctcgtacgttgtctcgggcaatttgtttccctccggaagaatgttcttgacgagtttcaataaatcgccaaatgccttgtcactaacaccattttttgccttctattgcaagaactccagaatggtatccaactttttgtgcccctgctcgcaacctgggtacaacgacgttctgtggtcctctaacatcttgtccaatttatgggcccccttttaactttcgcagtcctccttggcgtcctgcaacatctgaccatggtcacccgcaacgtcgttaccatcagcatccctttcctcctcgcccgtttaattttcttcaaatccagcgtactgagcaaagtccggaatattgtcgtcttccagttcatcttcttccatttcaaccccttgctctccatgggatgtccaacagttatagcttggcatgaaccccgactcaaacaagtggaaatgaatagtcatggatgcagaatactccttctgattcttacacttattgcatggacaacaaataaaactcttatgcctgttagcttcggccactctcaaaaaataatgcacgccgtcaataaactctttggaccaccggtcagcgtacatccattgccgatccatctacatgatatgaaaaaaaatcgtacacaaataattattcgtacaataatgacagtcatacaataattataaaataattacaaactctttcaacagtcatacaataatgacatatcattattcatacaaaaattataaaatattacaccaaataattcttatttactatttctaaagttttaactaatattaatgtgttgtacttcttttaattttcattttagtttgttttctattatttaagattaactttcactatattttccttctcaactattttataaaaccttctttagcaaataaacaaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctccgatttgtatataatcaccaaaataaattcactagaaattttggcatgacctcccctcttttttgaagaaattttgaagctgctcgggcagctggaggaggaagaagacatatatataggggtgggactttagtcc

SEQ ID NO: 30990 - DNA, 31299 bp, Oryza sativa
gggactaaagttaccatctttagtcccggttggtgttaccaaccgggactaaagatcccggggggcctgacaagccctgacagcatttgaatcgggactaaagatgatattaagtcccggttggtgttaccaaccgggactaaaaatcaaatatgcccgttaccctttttaaccgggactaaagatcatctttagccctggtttttattgcaaccgggactattgtggaattcggccgaccgacgaacgatggtttctccactagtgaatactcttagtaccagtttttactcttataatgtatattgaacacatcagtaaacatattactacacggtggcgacaagatcatggctatatcaagaggaaggtggtaattgttttactcgcagaccacaaaatatcagtttttactcttataatgtgtattgaacacatcagtaaacatattactacacggcggctatgacatcatggactatatcgagaggaagatagtaattgttttactcacagaccatgaaatctaaataatattggtaaaagaattactagcgttgtaagctggtagtaattcttttatgaccatctaaatatagcatcatacgatgtggaggcattcatgcgagtaaatttgttactttagaatgagcagatgtgggaggctaggagtaaatgaaaactccacggagtaaattcgttacttttgagacgtgcggagatactaacaaatattttactaaaacgcgaaaagagaaaaactatagagaaggaatgaataagagaaaaatctggatggttaatattttaccaggcccattgataaagcatatataagatggaaaagagaaaaaagaaacacggaaggtggggtggtaaaaaacgaaaaaaaccgaaccgagaaaaggtgggatgcggaggaaaggtggggtgataaaaaatggaaaaacagcaaggagaaggcgttgtacggcgctcgaattattattcgtggaatagcgctaccgtatattatatacaaattttaaaccctccaaatacttactccctcctagggagaatcaaaccagtttgattctttttgcgacaaaaggagtatatgtgtgaatagtggaagtactcccttcatacctaggggtggacatcaggctcgctcgttgggataacaagctagctcgactcggctcattatcataatgaaccaaaaggctggctcgactagttcgttagctcgtttagctcatgagccagaggaagaccaaacgtggcatgccgtgaggagggagaaggtgagctcccagggacaaatgacagagggcagtgtcaaaataacttggttttcaaagttcatactttgtcttaaaataaattgatttctaccatgttacctaatcttgatcgaatcgagaagttttatcacttcaatactccttaccttccccaccaatactattttgaattaatgtgggacattttgatctttcgtactcttcactaaagttttctcgagatgtgagtgttacacttattttgggactgaggagcagtataagcatttatatattattttttggaacaaaagcaatgatgtatgtgtggtgaaacctatggagaaaaccggcggactatttcttaaatcatatttctcataaataaaaaacactattaaaatttgagaggtatccaaatcacccctcaatccctagtcctaggggctctactctacagtccccatcgacgattacgaaacatgagaaaaatcgaaaacacttagcatcacgtgtctaatgcacgcgaaatatcaaatgcttcacctagtgggtcccacctagccatttattcccacctaccgcaatgaatatcatggaaattgaatctagacaacttataactttattcgagataagacataaaacatataaactagaatgaaatgagagacaagtctcttaccccatgcatatagccaatgcaccgaaggcaaagaaggagggggactcgagcaggccaatggagagacctcacgaggggaatttcatgcaaagatgccgagacttttaaggttgtgttcgggagagcctcttctcaactttcctctctcgtttttcgcgtgcataattttcaaactactaaacggtgtgttttttaaaaaaaagtttctatacgaaagttgtttaaaaaatcatgtttatctatttttgaaaaaaatagctaatacttaattaatcacacgctaatggaccgctccgtattccgtgcgcacagttcccggttgggaaagctggcttcgaacacagcctaagtcaagaagcattatgtcattgacatttttttttcaattatatgttgaacacaaaacaacatgcacaccatgctcatacacctctaagtggcatctcttattacacaaaccaggtacaaatccctggcctcattaataaattctcatcgaaaatgaactttgtttaaccttttgggatttatataccttcctaacaatcgaaaaaaggcttaaaacctaattaaacatattggtatacacacagaaaaaagattacatccaaatgctgaacatcatgcatcctgtgaatataccaacaaaaacactaaattactttacggtgtcactcttcaagttctgttcccaaaataaaaaaaataggaacactaagggttgttttcatctttggtgtcggctgatggagttagcttaggagacagccgtggtctcttgttttgattttcggtgacggttgacggagctagcatcagagacggccgtggtctcttaaacctgttccttatctcggacagcacactcgggtagctctgtatcagattatagtactccttagtcgttgccacctcggcgaaattttgtgtattcgataggaatacaagacaggacgttcttagcttcggatatgatctcgtctccgccagctccagtgttgatgtcaccgtgtccgtggtgatgtcagcgcagagcgtgtcctcgcacaaatccttcaacgtatccactccgtatcgatcggcggtgacgagcaggtgctgcaattcgaagatccaggaggactgatcgtctgtgtcttttacacaggtgggcaggtcgttgcagtagatgtagtggagcatgtgcttgaaggtggaggcgctcatgtcggagatggtgatgcactccatcttgctctcggccatggagccaagtagctctgccctaaacacctccgactgacgcgccattatgaggcggtgcgcgtggaaactcttgccgtcgacgtcgaagcagacgtcggtgaggtctcgaccgtttgacatggtggcaaggcagtgggctaacaacgagtacggcgaccgcggcgacgagggaacaaagacaacccagcacaacgccgccaggatgccgccttttacacagttggccaagaggtgatccctcgaggctaccagtttgcagctagcagctaggttgctcccggcgacgggcggcggcagcttaggactgctacctgcagcggcggacggcgacatcaccgatctggcgaacggcggaagaacaggcgacttggtatcgtccaagagtgccatgtcaatgaacaccttgtgcgctctcgccaacgactgagctcggtcgctgtttaccgtcacggccagaatcatcatcacctttctctcacccagtaatgacggcacgaaaagagatgcttcgcatgtgtagccattgccgatttcgcaggtctccttgactatgcgcccgacgggccggcgtatcgccgccccgtcaacccggaacatgaagtggcggttgtcgccgcaagagacgagcttacacggcgagctgctgctcgccattggtggagaaagagcggcggcggcggtggcggtggcggaggaggaggggtggtcggcaaaggtggaggcggcgattcggtggcacggcgtgtatgcagaagcagtagcgtgcaaactgggaaatcccgatggattatattgcgatccatctgttcagagttcaactggacttagatttggtcaaatgtatcggggttccagacgatatacagaagaaggttcacgtaaggaagcacacaaagaactacgagatttattttggtaaagaaggagcaatattggcatgtgctattggcaattgcaacgtctacaaaatctttcttaagagcgtgaatagtatctttgacaaccattactacgtaccatataaactatctccgcgctgcatacatctctatctctactctactattataaaaattaaaaatacttccgctccgctagaattttggtacgtcatccgtgtttgaatcggttttaattttattgttcggtcgaatccttcctttctttacttacgccaaagtgtccatcttatccgagacacatgcgaattaatttgggcccgtaccttttcacgtgccccttgccacacgtagcaattgggctcgtgcctgagtgagttttccacacgcgcctttatgtgccactgtgattgggcccataacgacctcgcgtgcgtgattttccgcatgcacgattgggcccacgatgccgtcgtgtacttgatttgcccttgctgcatgttcgattgggaccgcgtcgtcctcgctcgcgatttaaaaattggagatgcttttttgtcaaagctatgatacgtcatccgtatccgattctgttcacacgtaacattcattgaaaagtcacgactcgcgagcaaactgcagaaaaaagttcatgtgatgtggataccaagcgaatgaaactcgcagagtccgcgtggatatcacatacgtcattgctcagatcatccgattttattcgtattacacaacacgattccttggacatgttagcatgatttcaagtcagtctctgtacatgctcatacgcactaccagggataccgttacagtaatctataaggatcaattttacttttgaaaaggacatgccaaccggaataaagatgatcgaagttgctgattctatccgccattaattcctgcccaaattgagataaaattggacgcaaatcgagcttgtatttgaatgcctcactgtttggcttatgcttcttcctataattcaaattttaaattggaatggattcacaataattctgaattttatcctatttagaatttaattttgaatttgacttttaggttttttatcgtactattttacgacatttgcttttgagttactaaaaaacatgtatataaaagatttgctcacacataatcttttatttagtaataagtgattcggattttcatacgaaataatgggctgtgattatttatccacccacacatatgtacaaattaaatgagctctatccattgcaatgcacgggcatcttttctagtatatctagataactatcattgcatatgctcacatgggcttgttaattgttatattctacaaaagacagcttaatttttgaccaacgtagaaagtaaggcaccacatcttgaaagacattaaaagataagcaaacgattgagcgcaaccactacattgactaactccgacacgtacaaaagctagtttttgaacgagtgtcagccaccatctttgctcttctgatagatcaacgaaacaaaactaacaccaccaaacaaatcagcaacccgaccctaatgctgacactatcaattggattgtagcaactcgaaaaatcaatctcctaggtcacattgggttaatttctggcaaacaacatagacataaaaaaagagatagaaaaagatcctgaacaatctacgtccagaaatattgtggaagataaaccctatacaagtttatagaccttacctctaaagattttattcaaaataaaccttaaatcttacaagaaccagatgagagatggattattttccccaatgcatccaacacaatgtggggaaaggaggagaggggggggggacccgagtggccggtggagaaaatcctcacaaggtgaatcaccgcgtgcgacgacaactctttagtcactaagcattacgacctagacaatcttttcagttacatgattacacaccacttttcatgcaccatactcacaaatccactgcttcccctccaactctgttgaccccatctcctctagattaggtgacctcgacaaataacaatggagttagggtcaaggttttgggagtggggttggggagagggaaaaagagggcaagttctccaggcttagacgaatagccatgggagttagcatcccgactgtgggcggtggagcagacatgcgacaaggtggtagcaacatcacggaagacggggttcggcagccggcagtgtacctatgttggcggtggcgaaggagctatcaaaggtgagaaagatgattgggtgggggacctgccatctgcacggggatagggagggctcgccagcgccattgccaccttctggtcagccggcaaggccaggaggtggcgcatggggtggtggaggtgttggcaacttttttgacaagttgacaagcacgatcgcagcaccttaagccttgcggtgatcctagagtcgccaaccacctcgatctagtgaagagctaaacctagatgggttttgataactaaaccgactagcggagccgatttctagataactacccgtctcgtgggcaaaacggaaggttttcaagacaaacctacaaagagatgtcgcactctcgcagcggcggcggacggtttacggcgcaaaccgacaaagatggacaaactaagagaaaactaaaagcaatatgaaaaacgattcgattgattgattgtagattttttttttacaatgaaccggccatgtcccttatataggagttggtcttgccctctacagtcccttctccatgtccaagttggggtagaaaccaaaggaaatccaaaacatgccttcctgagcaaggaaacttcgagacccgacgaaacacagtcggacttggacctgctggttagaccggccacacaccgccggtctgaccggccctcaaccggcggtctaaccgcccaacacacggcggtcagaccggcccactcggaggaaaccggtagacttccaaattttggcaatctttcctatcttaatcctaagtgccaaatttgggtgtaaacacatgcccccctgcctttttgatgaacaacgtgaatctaaaagcatagaacatgtttttgatcttaggacgataacccaattaccggccatagtacctcctaagcgtcttgccaaacgctcgggaagtatttcttcaagtatttgccgttgattgctcactgaaaacgctccccttgaagtgtctccaaaaagtatgcgtttcctcgaacaaatccgcacactcgataaggaccctcccaactaggagaccacttaccgaactccttggatcgagtacccaaaggcaaaattgtcttccaaaccaagtctccaacttgaaacaactttgctttcaccctcttgttgtacgccttggccaccctcttcttctctttctctatctcttccaatgccttcaagcgcttgtcgatgacttcatcaaggttgtctcccatcaatgtcttgtaatcttcacttgacaaatcatcttgcttgatataacgaagagaaccaagatttacctccaccggtaaaacggcttcttgaccataaaccaactcaaaaggagtgactttagtagcaccatgtttagatatcctatgcgcccacaattcttcggaaagcacctcatgccacctctttgggtgttcctcaatcttcttcttcactaacttcaacaatgtcttattactcgactcggcttgtccattagcctgagcgtagtaaggagaagaactcaacaatttaataccataagattcggtaaaactcttcacttccttagacataaaagaagcaccttggttcgtagttaatgtttgtggaataccgaatctatggataatatgcttcaaaataaaatcaattacctccgtatgagtcatattcttcaaaggcatggcttcggcccacttggtgaagtaattcgtagcaactagcacgaacctatgcccctatgatgacgaaggataaatttgaccaatgaaatccaaagcccatcatcggaacggccatggtttgattatgggattcaacacggcggcgggcgccaattgaacattgccgaaccgttgacaagcctcgcatcctctataatatttgaagcaatcatcaatcatcttcggccaatagaaccccgctctcctaagtaaccaattcatcttgtgggccgattgatgagttccacaaattccttcatgtacctctcccatagccactttagattgatcttcatctaagtacttcaacaagacaccatctatatttcggcgatacaaatctccatcaagcaatgtatatttgaatgcttgccaccgaattttctgatcaaccttaagtgtaggatctttcaaatattgaatcaaaggaattctccaatcttcttctgtttcctgggcacaaacgtccgaattcacaattaattcggcctctaaattgattgaaacgtgccccccagcgctctgcccagaaccggtcagaccggccacacagggccggtcagaccgctcggggttgccggttagaccaacggcatgaggccggtcagaccgcccctggtcactggtcagaccggccatgcaatgccggtcagactgcccctggtctccagttttgccaatttcgcacaaagatttaaaatcaagcaccggttcttctaataccagaaataatccctttttcacattatagccagatgcttgttgtgccaagtcatttgctctagaattatcatgcctagaaatatatctaatagcaaaattttcaaaattggcaataatatctaaacatgaatcgaggtacctatttagtgatccgtccaagcatttgtagactccggcgacttgttgtaccaccaattccgaatcaccaaaagcctccacgtatttagctccaaccatctccataacttgtaagccgaataataaagcattgtattcggcttgattatttgtacaataatactccaaacgaaccgatgcttcataacacatgccattaggtgaaaacaaaactacccctatgccttgaccttccttgcaagaagaaccatcaaaataaatcttccaagatataacttcaactaagcagaccttttcctcataagcaatatctacatgatggtccactataaaatcacatacaatttggcctttcatagatttcaatggttcataagccaaatcatattctatcaaagcatatgcccacttgccaattctcccacttagaattggcctttgaaacatgtgtttaataacatcggcttgacaagcaactatgcatgtactagataacaagtaatgcctcaatttggtacaagcatagtataagcataaacaaagtctctctataaagacatacctcgtttcggcatccaaaagacggcagctcaaatatgtaatgatatattccttgccatcttcctcttgcgtcaaaacggcaccaatgactttgtcctcggaggcaatatataaccgaaaaggctttccggctttaggcgctcacacaacgggtggggtagacaaatacctcttcaactcttcaaacgcctcttgttgttttgccctccaagtaaaatcggctttttttttcaagcgaagtacaggaacaaaagcatcgattttacccgctaggttagaaataaaccttctcaaataattcaccttacctagcaacttttgtacttccttcttgcatgtcggcgctttgaaatcacgaatcttctctatcttcttaggatcaatctcaactcctctctcatgcaccatgaatcctaagaacttcctcgccgacacaccaaaagcacatttaagtgggttcatcttcaaaccataccggcgcatcctctcaaaagctaacctcaaatcggctatgtgtccttccataccatccgatttgacaacaatatcatcaatgtagatctctaggataatacctaacaaatcatgaaagatcaaattcattgccctttgatatgttgcaccggtattcttcaacccaaaagtcatgacaacccactcaaacaaaccaacaaatcctgggcacctaaaagccgtcttgtacatatcctcttccgccataaagatttgattgtagccggcattaccatctagaaagctaatcaccttatgacccgaggtatcattaatcatcacgtcggctataggcataggatactcatttttgggagtggctttatttaaatctctaaaatctatgcaaactctattcttaccactccccttcttctccaccgggactatgctagaaacacactccgcataacgacatggcctaataaaccccgtcttcaacaaccgatcaatctcctatttgactcggtcatatagcaaaggattaaaacgacgaggtgtttgtttataaggccaaaaacccggtttaattggaagctgatgctcaacaagctcacggctaagacccggcatctcatgatattcccatgcaaagcaatcaacatattctttaagtagctcgattatctcaaccttataatcggctctcatatttttgtttacaaaagtcggccttggtttggttccatcacctatgtctacttcctccaatggatcggccgatgtaaacccttgtccaagcttctccacttcatcaaaattttcaacggcttcaccaatatcgttctttgtagaccaatattcttgcaccctcttttgtaaccactctaaattagcctctttactcattatacaaacttatatggcttagccgtgctacactagccggctttacagagataggtacaaatttgccatcggagatactaataaaatcatagctagaaagatccctccccgataagcattggatattcccatgacgccactcaaaagtagcatcggccattgcaacctcggccgatgtatccgcttgaacaatttcaacatcatcgccgtcccattgaattaaacattgatgcaaggtagaaggcacacaacaattggcatgaatccaacaacgacccaaaataacattgtagttaccttgcacatcgacgatgaagaaaacggttggtagcgtcttgtttcccacggtgagctccgccgaaaagatacccttcgcctcctttggttcaccattgaagccattgagaatcatgttggtcttcttcaactcatcatcctcacgccccaacttcttgaataatgagtacggcatcaagttcatggcggcacctccatccactagcatcctagagaccagtttcccatcaacatggcctttgagatagagaggcttcatgtgatggtttgactcatcgggcttctcaaaaaccgcgtctttaggacctaatgagaattgagcaacctcggcttcatccatagcacaaaactccatagacaacatacataccatgttgatatccatgtcttcttttggagatgattcacctttatcaaccaattgctcctccttctcttctacatcaaccggcttttccttctctatggatttacgcctccataccggtggtggtcgaaactcattgaatcttttatctctttgttcttcggcctttttctctcttatttcatgagctccaagacgttgcaaccttctctttcgagtagccatcaaatccttaggcatccatctaggattcggctctgttccaggaggtaaataatgccccctattaattttgtttgaagacgatgaagccctcacatcgccctttgcaattctcctgtcaaaccggcactggagcccggtcagaccggccgtagaccatcgatcagaccggccagatgcgccggtcagaccgacacttggcgcacggtcagaccagcctgaggcgtcggtcggaccgctgtcgggccggcggttggaccagccacatggctgcggtcagaccggccagagggcccggtcagactagccgactgcgatgagctggtatcggcttcagattttctatttgaggacactccaactccatctccagaaggtattggcacatcatgagaccccactttgatggtaattacttccgaagtccttgcctccaccttgatgtgctttcctttccttctttcttcatcagcccgatttttaccataaaaccggccgttgtttggtgaagacaaacgctcatgaattggcctccttagtccttcccacccttggttgaattgcattggaggcatatgattgaacattggcggcgttgccccccatggcatgtaataaggataaggataacccggcggcggcattggataagaaccccatgacatatcttgtggatgatgatatggaggtgaatgcgactgtcttggtgaatgaccaaatcgctccctaggaggtaatcttggtctttttcctttattgcgagctctcaaaccaccttccttctcatacttttttcaaaagcatgtcaaaagtcactttggtcttcctaggggctttagaagttgaagctccactcttattctccttccaaatgccaacctccggcttctttggcactatcatcttaggccttggtttgccaatgaccactccttttcccttagtagattcggcttgctccgaccgaatcaacacttttttattattgaaattaattgtattcaccggaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttgaactcttcttgagatggtatgacatggcctttaggtaatctaatttgtttttcttgtaaaagataatcaaaaattttatcacacttggccacataaaaactatatttaacctcactttgtcgatctttgcgaggagtcggcattaggttagagcaaacaaaaggcttgtttttattagtacatgaccactcggcaacatatatatcatgataaccctcttcctcactatcactagcctcagggtaatcaatcgcattaacattgggctttttgtcatatgatctaacaagttttttattatccttaacccggctttcctgagccagagccctttgcataagttgactaacatcaagaaattgttggccatctagtctttctctaagaggagcaattaaaccattaaaagcaagaccagccaaatctctatcagttatattcaaggtataacatcggtttctaacatccctaaatctcttaatataatcaatgactggctcattatacttttccttaaccgatgttaaatcacataacctaagctcagtttctccagtatagaaataatcatgaaatttctcttctaattgagcgcaagtatgaatagaatttgccggtaaagaagtaaaccatgtaaaagcattaccagacaaagataaagaaaacaagcgcaatttaaaagtatcactattagcctcaccacattgtgccaaaaattgacctacatgctcccatgtggtttcactatcctcaccactaaacttggtaaattcgggaactctataattacggggaaatggcacattatcataatagtcaggatacggctttttgtaaaccctagcacgattcctagtttcaatcccgaatctattcctaataatctcactaattatatcctccatattattaggcccatgttgatttggcggtggattaggtggtctaataggttgtgtttgtggcgcaatatgattatattggccttgtctagtatcgggaggataccccctagcaacatcattataagcattaggaacatgtgggggaacttggggactacttgtagcactagatacaggaggatcaaatgttctaagatgatacaaataaccaacattagtcattggatctattccctgtatcggaacaattgcgccggtctgaccggcccagggcccggtctgactggcatccagaggtgcggtcggactggcctgagtgccggtctgaccgccggggtaatacccggtctgaccggccgtttggccggtcggaccgacggctaagtcctggtctgaccggtcgtcaggcccggtcagaccggccgtgtgcgccgttccatcggttttactacccgtttgatctataggaggttggttagcagtggtagaggctttatcctttgacatgtaatcagccataagagggccgaatttaacccttaaaaacttatcaaatttaccctcaaaagttgcatctaacttatctttaaaagcaatcatagatgaatctattgtagatgctacttgttgttggatagattgtgttacctcatcattacttaccaagtcgggggcaagcttaggacgtggcccgggcttgatgatcacgccttgaggagtcctagtgcttgccctcatcaacgcctcccgtgtgagttcgttgatgtactcctccatagctttgcggtcctctccttcgatatcctccaatgtgaccggtatcacattggatggctccacctccgtcttggatggcggcttcgtcatggcgaaatcgaagttgagttgacgatgaacggatctcgtccccagtggagtcgccaaaaatcgtgttggcaacttttttgacaagttgacaagcacgatcgtagcaccttaagccttgcggtgatcctagagtcgccaaccacctcgatctagcaaagagctaaacctagatgggttttgataactaaaccgactagcggagccgatttatagataactacctgtctcgtgggcaaaacggaaagttttcaggacaaatctacaaagagatgtcgcactctcgtagcggcagcggacggtttacggtgcaaaccgacaaagatggacaaactaagagaaaactaaaagcaatatgaaaaacgatttgattgattgattgtagatttttttattacaatgaaccggccatgtcccttatataggggttggtcttgccctctacaggccctactccacgtccaagtcggggtagaaaccaaaggaaacccgaaacatgccttcccgagcaagaaaacttcgagacccaacgaaacacagtcggactcggacctgccggtcagatcagccacacaccgccggtctgaccggccctcaaccggtggtctgaccgcccaacacacggcagtcagaccggcccactcggaggaaaccggtagacttccaaattttggcaatctttcctatcttaatcctaagtgccaaatttgggtgtaaacaggaggagcatgagggcgaggtgaccatgtggaagggaagaagggattagggttgggaattgttgcacaaatctcaaagcgtataaccgtctaaaattcgtaaggtttcgtaaggtttttaggtgtgttttctatcaaatccatataggcagtccctttctttaatctaccatctaaacttacatccaaaatatagagtacttttaatttatcatgtaaatgttgtagccatttaagttaattattacttttattttgctatagtattaagctagattaattaacattgtggtttagcaaaacattagaaccatattacatgtggactatgtgccaaaactcttatattttttaaaactttaaccataatatgtgggttttttaaatttattttacctctaaagcagttgggatttatacaccttcctaaggatgggaaaaaacaaaaaaaaactaaaaatcttgatagaaataaacactactaaaaaaatgacatcagtgctgaaaatagacccgacataaaacttttggcactaatgataccctcccccctgccaaaaaatcagtgttgggtctctgcccggcacatatgggcctagacgcacataggcaaaatctggatagaatcatgtgacaggtaatttctaaacccaacactgatatggacaaaatttaggctatggaaaaagtacaaaaatatttttaatactcttactatccttactcatgtatctacaaagccacaaccactattacctattttcgcaagtcgtatataattcgtgtcatggcaaggattcaaacttgagacttctacctcgtattcagtttccttaccaactcacttacacatcaatcctgttagcaaatggtattttcccttttaagcctttctaaacccagatttgaatcatgaatttgagtataaaaacacaaataaaaatgttgtcaactaccaaattatagatcttgttgagagctacaattttcatataaactgtcgtaatccgaatttgtctgaaaaagttatgttcatatggtcaagcttatcactgcctggtcataataatacccagcatgaccagtattctaaaagcccggcactgatgtccttttccgctaaaagtagagtcaactcgttccaaacgggaaaacccgacactgatgtgttactcatcgatatcggttagtgacaagacccgacactgatatgtcaccgaacaatcacagccagatggttgtaagacccggtatcgatgtcttcttatcagtgttgtgtgaagtaggtgcataatgcgaactcgttctttgggctgaaaagcatggtcagtgctggattttgtcgatccggcactgatgagaggggcattgattgtaacaccctaggtatccttttacctacaatgctatacactatggaataaaaaccaccaaatcctaaatccattaagaattttgacagagtctcccctctaaatccattaagaattttgacagagtctcccctgtaaatatggatttccacggctggtagttaatatattaaactattaataatattattcccacagtgcgatccatccatataatccatggaaataaactaatagatatctaaacgattattacaagaccaaaccatgatatagtttaagtgtcattatgtacctaagtaatatagtttgatagtgtgtagataaatgtgtatataagagtgctacttcccgcccttgcatgccgatctcaatgtgtacctaaaaccaaacaaacacaatagtgagtacaaaaatactcagcaggtataatatggaagtagaaaacacatatacacatgattggaaatagagaatgagcaaaaagttttccttctttgaaaagaaatagcaaggttaaaggaattagtagttcccatcccgagcatacatgaaataaagtagtattttccatcccgtacagttgcgaatacatcctaacaattgccggcaagaccgaataagcgtgatcagcgcttacccacatgaacatgaataaaaccagatagcatatacatgactcgcatggaacatgattaattgaaaccggaaataaggaaacaaattgaaaccatattgcacatccatgacaactatggaacttgaattatttactgagaactagcatacggaatattaaaacaaggataacgtcgtaaacataaaatacacttgaaatctaaatggcatgaacaacagtctgaatataagcagccacttatcacatagaaatataacggaaataaatagatagagccatcaatccataaatcacacaattagtttgtcatgtacttgcatttaaccttgacggtaacccgacgaaccaccttccacaccagatctctccacacatatggagcaaaactacgaataaaccactgtattcaactaatgatagttacaaaggatatttactaaaaatcaaaatctagaacatataaactttttacctatttgtattaaacaacctatagtagttccattactgctttatgcataactcgcaaaccgtctaacggaatctggcaaccaatacaactttggtcatctagttaaaaactgtctacaacttttatgttgggtgaaaaatcaggttacgcttctgtaggtctcagattaaggaaacacgaattctccctatttccagacccgacagtagtactttttttgttgtttctgctaaaccgtttatcggaatcaagggaaactagcgccgttagaaagatatcaacgatgactacaaactttatttaggacaactaacctgaatcctgatgatttaataccagatttgaaaatacggtttccggcccgtaaacaaaaacctcaaaaattgcacgagcggctatcgaatcactttctatttgaatcttatagttctagggagtaaacaaaaataccgttacagcgaggatactaaacaaaagtaccgttacagcgaggatactagaacggcctttaccttcccttcttcctcctgttctcctgatcctctgcactctgaaccttctcctctctgtccgatgcagcagcagccagcagcagaccatgcagcagcaaccgcatggaaccattagtagcagcaacaaacaaccaaagctgtagccatagatcagatcgacaacagcaggagctcactgggaagaagcaaaacggaaaggaaccatcggttgcgatggatgacgacggttttgcggtctctggcaatggccgtggtggcggcgcaaagacggcggctgcaaccagatgacagcagcagtggcaagagcgcaggtgcggtggcggctagggctggctgtagcgatctctcctttattccttttttctttttttttatataaagaaaaaatgcctgtgcgttgcaatgggtaaagttggttttttttacaagccgagtaataaaataaaatattgggatcacaatacattataattaaaaagtagcccattccgtgcctgtaaaatggtggagttatcctcctatcaaattcggctgaatctttctcgatctcccaaaattgatcgagtgcttttaatctactcgatctcctctttctgtttgtctactcgatcttctctttcagtttttttcaaaatcagagctaaccaaactcacccatcgaccattatcaactacggttaaatatagattaaattcaacaaattaaatccaaaattgaaataggaaatcatggggaacatgatgataaaggtgtgggaaatcgatttttataatcaattgaaggaggaaatatatgggatatgggaggtagcctagctgcagcttaggcttgcggattggataggaggagatcggaaaaaaaacggaactgacccactaaaaaattggaaaaaaatacatgtggagaagggaaaaaccgggccaaaaaaagctaaaaaagcaaaaacatcttaaatttttataataggtaaagatgagactaaaaaggagatctaacgcccacatcatttcaatccacaagacatcattcggactccgattactataaatttatagtccatgttgcattactcgacgagctctacgcatccacggttcctgatcgcctattcgaaacagtttaaaagttgaacttttacgtgtatattctaatatttttcaaaatacattaatttgaaactcgggtattacattgatgtgctgctccatggtagtgaaatgattacattcaaatgctgtgcatcacgttttatgtagatatatgccaacaagacctctaagtactaacatgatggcactctctaagttttctatgtactaatctatgctttctataaagttacaagcccactaagtcaggcaactatatatgccactttatcaccctctagcaataattacatatttaatcatgcaagaatacaacataatttacaatttaattaattatacaaatcaaaatgcaagcatatccaatcaccacccctcatatcatttgcataatattttaacaaaactatctatcacatttacaatatttaacatatattgatcaatatgtttcacactaaagcacgtgtatcatttgactgataaaccctaatgtttcaactttttttctttttactcctagcttgattgtaaaaaaaaagttaatattggaaatttcttagtaattcccgctgcaaaacgtgggaaatcacctagtactaatatataaaataggccacatcaccatccaacactagtggagaaacctttttttactcccggttggtaacccctttagtcccgggtttccaactgggagtaggaatccgggactaaagatctggttgaaataatggggaccaaagatctatctttagtaccggttggtagcaaaaaccgggactaaatatagggatctttagtcctagttggtaaagagagggtagcggcagtctagatggcccccttttcttttttgtttcttttttgttttctcccaaatcgagtggcatgcacatcccaaaccaaacgctaaatctccaaatcaaagtaacatctcaaatccacatcacaaatcttaaagttacttatacgcacaaatcaaatacatcacaaatcctaaaaaaattacacacaaatcaaaaacatcacatattatacatctcaaatccatacaatgaatcataaaattatacatctcagtgattcacaaaataaaaaaaagaaagagaaaacaagctccaagcacagcgccactactactgctactactcagtgcaccgtgtttgcagctgcgcgcgcatgtgctccccctgcaaccgcacgtttgcaccacacgccgcgcgtccgcgtggcctcctccgtctccaggggagggaggagaaaggggagaagggggaggagaggggaggaggaaggggaggcgaggatcggctgtgacctgtgaggaagtggttgtgattgtggaggagaggataagggttagggattatatactacgtgttgaattttagtcccggtaataccaaccgagagcaaagatctaaattatctttaggatgactaaagtggtgatctttagtcccgattggtgtcaccaactaggactaaagatcctcgccccctgacatgcctctaacagagaatgaatcgggactaaaaaccatctttagactaaagatcatataatggctgtggggttttcaaccggggctaaagatcatttttagtcccggttctttttggaactagactattgtggttttgggtcgacctagtaaagatcaattctccagtagtgcaagtatcctacatgacctataccacaatgagataagactctctatttgctagtcctatataggacacagaccacaacaacaaaactagcacagacctctaactcagtaacaacgacgaaagtagcataacgataatatattagacaactggaataacatttttatggggtttataatatacacacaacaaagctataagttttctttaaaagaaaacccgtggcaacgtatgggcattatggtagttcattctgaaattaattaacatgataacaactgtaattaagggttgttttgatctttggtatcggtcgatgggaatttcggagttagccgtggtttcttaaacctgtcccgtatctccgtcagcacgtccgggtagctctgcaccacctcgtagcactcgtcgttggtcgccaccgagtaaatctgcgtgttggacaggaactcgaggcacgaccccctcagcttcgggtacgaccccttctccgtcagcgccagcgtcgaggcgaccgtgtccatgttgatcccggcgcacagcgtgtcctcgcacgcctgcctcagcgcctccaccccgtacgcgtcggccgcgacgagcagccgctgcagctcggcgatcctcgtgacatggtctgcctcgccgtcatcgtcgtcaccgtcgccggtggccggtggcggtagctggttgcagtagatgtagtggagcatgtgcttgaaggtggtggcgctgatgccgtcgatggtgacgactgcggtctccgtcttggtctcggcgtcatcggagccgaacagcaagctcctgaacacctccgactgcgccgccatcaccaggcggtgcgcgttgaacctctcgccatcgacgtcgaagcatacgtcggtgagagtactgtccttcttgttcgacatggcggcgagacggtggcctagcgagtccagccataggcaaggtggcaactccgggagaaagagcacggagcacaccgccaccaggacgccatcctgcacgcagttctcctcgaggtaatccttggagacgagcaacccgcaccctccttggttgctcccggcggcggcctggatagccatggatctcgtaggcggctgcagggccaccgacctggcattgtcgacgaggacgagatcgaccaccaccttgtgcacgtctcggtagcgtgggccggacacacccacggagaaggcgaccagctttctccgcccgatcagcagcctgaagaacgcctcacacctgtacgcgccgctgtcgccgatggcgcacgtcgtgcacagcgtacggccggcgacggcgggtcgcctcgcgcccgcgtagtcgacccggaacgtgacgtgccgaccgtcgccggaagagaggagcttgcacagtgggctgtcgttgataacggctacaccttgatcggtggtgctggcagctgccattggtgacgtcgagaaaggagagtaggtggaacagtagggggtggtcgggggtgggagtgaaggcgtcgatgtggttcgggttggttggcacagcatctatactatgcagaggcggcaaacgagaaatccgattggttatatttcggtccttatatttagagttcggtttggaattatatctgtttatctattcggtttcaagaagagacacagaaacgtattgcaaaactatgtatgtagggcaacccagtgtgtatatagtagtagtcgtcgtccagggggccggtttgattttggttaggaggcaaatgttgacaaccgcagtatacattccttctagatatcagagcaggaacaataattttgacaactattaccatattaactcttcactgtatctcttctctatctctatctctatctctatctctactattataaaattaaatatgtttttaccggtactttggtacgtcatccgtgtatgggtcggttttatgtccgtttgcttttagaaatacaaattcgtatttgagtcggtttttaagttcgttcgcttttgaaaatacagagaaatcgtataagaaatctctttaaaaaactcgcatgctaacttgagacgatcggactctaattgcagctcatgattttgtaacaaaatatatatccaaacgaatttaacacaatgcatttcatattaactaaaccatatatctctatctcttctctactattataaaaattgaaggtgtttttgccgatattttggtagatcacccgtgtttgaataggttttaatttaatgtttctatccaagcaaattaattgggctgccttgaaaaaaaaacgtgtccgattccccgtaaagagggtgaaaaaaccgtccgtaataaaagtaaaaacagagcgaaaaagtcccccaaaagaaaagtctgattccccgagaacggcgaaaaaaagtcgttccttaataaaacaaaagattcatttttttatgcagcaataaaaaaggcagttaagcagtccgtgaaaaaaatccatccaaataaaaaggcaaaaataaacaaaaaaaaagccttcaaaagagaacagaacgtttccgtcgtaatctttacctattataaaaattaaataattttatactcatcgaatttttgtccgttatcccttcgttccaacaagccgtcttgttcgttactcggttcccgaccacgcgcaggtatgtgatcggccgcatccggctctgtttatgacgcgtacaatgcgttagacagctcaaccaagtaccatgtaactaaggtttatcctcttatttaacatataagtgtgttcacgggtgttaggacaaaactcaacgagtactgtatgtgtattgtctctgtattcaaatgtgatcaactgtgagcaatgtttacatatttatacaaaggtatataagagaaaattactttattgtgagcaatgtttacatatttatacaaaggtatataagagaaaattactttattgcccctagttctatagtgaatctagagtggctggccggtgggctagcccttgggcagagaaaatactatgacaaatttatactgtagcatcgatggtgcaacaggatggcagagggaatccaagccgttggctccatcgttccaacggttataatgtgctccaactgataaagttgtagtcgttactacaacaacaccggatctcacttcttcaagacggctttcagatgctgcacctggccactgactatccacttaattaatgcaaggggtcttgctatcggtgaccagctcttcttcacaaacacggaacgtcggcagatgcttctaggtgagccccatggacctgctcgacagttgagatggtttttttaatttaggcaagattcgatttgtacaacggtgtctctgttaatctatctttatctttaccatactataatggagcaatttaggtagacatgctagaccctcaccgtttgattgtgaaatccaatggcccagatcagttcaacgatcctcctagagtctcagtgaaatcattcgtgccaccaactaatcccacacatacgcccctccctctggtgctaaccacgcctccaaccctccacaacctacacatagatggccaaataggctgctcggcccgaccatgcccagccgtgagatcagtcatgccgacatggtccgacctacacgccgaatcgggctgtgtccgttcgtgggatgcacgacctaacaggggtggatttaatgtagaaatgatgagggccttggacccttgtcaaaattacactccttaggtatatcggtatatccctagtagtatgacctatgggcccccactttaattgggaggaaggacctcagtccccaagtttttgttcctttcatcgcaatcgcgcacgcgtggaggggtcgaacggccgctccctttctctaattctcccagattccatcaactggcaaatccgcaaattatggatcagggaagggaatagaaagcgaacccaccattcgtcgcgcttccccgcatgccacacagttcgtcttcacctgaatcgccgctttctgccttcgtcgaccgctcatcatcgtcagcgcctcagcctcagcagcgctgctcgttctctcctctctgcctccctggtacgtactcatccccttgaccctctcctccctttcgtgctatcaatagttataggggatggatccataagtctccctcctcatgtgctctatctaattagcattcccatgatttggttggtgagataatgaacaatttttttattaaaaatccagcagctatgaacaccaccggaggaagttctagtgcaaatgcatctagcccaatactgagaaaaatctggactctggagtgcctcaaccaattcatatggacaagtttcctcggatacagtaaaaggaatagaatggcagttatcatcccaacatgaagacataagaaaatattagatacaatctctaatgacgtgattgtcgattgtttccataaaatgaaacaccgtcgtgaaaagggtaaaaaggatgccatgtactatatttataaatcttatttcttatctatatatactagtttcagtaatatttatatggcttgtgttaacttatgttgtttctatatacaattgacattatttgaaaggcctatctatatattactattaaaaataatgtaatatctcagagtttttagaagctgcaataaggtgagtttcacttggctttctaactattctatgagttatatagatgcatgcccccagtcattttttatcctgcgtccgccccgcgacctaataagatgggttgtgccgtgccggaggcacgaaagcccatcgtactcgtctttagaataagtctattttgccttccaaatctctttgggtcgtgccatataggctagaataagtctattttgccctcaactatttgcacatgccttatatggctgacaataagtctatagttcctccctcatccattttcctccgatcattggaccgtgccatgctgggccagcccaccatgctgaggcagaggccgaggcatgacccaacggtcaggccgggttggcacgggcccaacatgtgccgtgcctggaccggggcaaaaccccataccatgggccgggccatcgggcattcgggcctaggcgttttggccatctataccctgcagcccgttccccccaactcccgtcgtcgctgccctccagctcccatggcctatgctttccatcgctgcaggctaccccagtcgctgttgcgccctccaccttcactgcaccgttctcggaagccctaatgggcgattagtcacgccccccgcacggcccgcagtcagttgactcctctagtctctcctatctactacatatatatacgtatataaagtatatatgtatgtatacatattgtatatatttattatttttttaatatgtatatatttttatatacaaagtttgtatagttatatataaactttgtatatgtatatatacaaaatataccaattttgtatacgtatatatacaaagtttgtaaatgcaatataaactttgtatactcatttgtatacgtgtgtattaaaaaaccgaaaaaactgaaaaagatatggaaagaaaaaacagaaaaaagaaacgtgcgccaaaaaagaaaaggaaaccggactaaaaatatacgaaaagaaaaaaaaaacagaaaagaagaaaaccgttcgttaaaaaaaaaaaagggagaaaccgcgtgctggccgcgtccccctctccgcgcgggggaggacgcgcgcggctgagcgctcgttagtcttttcagcgggtttgccccaggatatggtactggtggcgctggacaaagcagacagcgattcgcgacggcaagcagtacatgtggttggtcgttgcatgcgtggctactgttagaataaatgggctggcccgatttttctattaaattgcaaaggcccataataaatattaaggataataatactaccctgggaattaaacgaggagtatctcaatttaaatagggagttattggaggctccctgttgaccggttgaggtgtggatcggaaagccacacgcgcgcgcgcctagcctgtgctgcttctgtctgcttccccggttttgatcgcttgcacgcacgagagatcggaacgagcagggcattcagaaccacaccattgcctgagatctgcaccgggtaggcgggtgatcaagtttttggggagtgcttccgcacgactgctctcgtcttctgttcgtcgacgttcgtcatcgaccgtacgtctgcatcaccatgtctgcctcacttgcacctagaaatggcgcatcgagagctggtgcacagaacaacaacaccaacggaggcagttatgcctcacaatccagcggagggactttcacagggtataatcctctactgctatttcagtttttgatatttctgttagtcgcaatgcaattgcgttctatgtatgaagatgatgtttactctaccttaagcatgctcctgtttatatttgattttatcactagatcacctcatattgttcatgtcatgattattgtcttaatattttggattaaaatatgctgatatatgactatatttccaacaatccaaaaacctgataggtcattttcggtagttgggtttgctgctgcactgaaaccacatgcttttgatggttctaattataagaggtggaaagcacgtacactactgtggttgacagcgatgcaatgtttctatgtttcacggggcaaacgaagtgaaccacctgtctctcctgaggaagaggttaagttcgaggcttcggattgcctgttccgtggagcattgatcagtgtactcgctgacaatatagtggacgtgtatatgcacatgccttcagggaaggacatgtgggatgcacttgaggccaagttcggagtttctgacgccggcagtgagctgtatgtcatggagcaattctatgactacaagatggtcgatgaccgttctgtagtagaacaagctcatgagattcagatgctggctaaggaacttgagaacaacaactgtgagttgccggacaagtttgtggtgggtggtattattgccaaattgccaccttggtcggactttgccacttttctaaagcacaagagacaagagttcagtgtttctgatctcattggctttttgggtgttgaagagaaggctagggcaaaggacaaccggggcaaaaaggttgagggaggttctagtgccattatggtacagaagaaccctcatgcatcccacaacaacaaaaaagtcatgcctgatgtcaaacccaaggctacaaccaattttaagaagaaaggcaagggaaaggcaaagggagactgcttcgtgtgtggcaagtctaggcattgggccaagtactgtcctgagcgcaaagacataaagtctgccaacatggtcattagcgagggcggaggaacatcggggtacggtaaattattacctatagttctctctgttttttcattcacctgattggtaggttgatactggtgctaatattcatgtatgtgctgatattttcctgttttcttcttatcaggtcgggagaggttcctccttgttcatggtgttggtacggtcgatctgaagtttacttcgggaaagaccgtgcagctgaagaacgtgcagcatgtcccttcaataaagaagaatctagttagcggctctctactgtgtagagaaggttttagacttgtgtttgaatccaataaatgtgtcgtatctaaatatggaacttttattggaaaaagttatgacagcggaggcttgttccgcttttctttggatgacatgtgtaataataataatgttgtgaaccatattagcgagaatgatgagtccaatgtgtggcattcgcgactctgtcatgtgaatttcggttgtatgacgcgcttggctgacatgagtttaatttcaaaattcactttggtcaaaggtttcaagtgccatacttgtgtttaatcgaaacaacatcacaagcctcacaaggcatctgaggcgagggatttggcacctctagaacttgttcattctgatttgtgcgaaatgaatggcgtgtggactaaagggggaaagaaatatttcattacactgatagatgattgcactagattttgttatgtgtatctattgaaaacaaatgatgaagcattgcattacttttaagacttataaagttgaggtagaaaaccaacttgaaaggaaaatcaaacggttgaggtccgatagaggtggggagtattttttcaatgagtttacatccttttgcgaagagtttggaattattcatgagagtacgcctccctattcaccccaatcaaatggggtagccgaaagaaagaaccgtactctaactaagatggtgaatgccatgttagacactgcggggctttccaaggaatggtggggtgaggcagttttgactgcacgtcatgtcctgaataaaattccaatgaagcataaggaagtaacaccattcgaggagtgggaaaggaagaaactaaatctctcatacctacgaacatggagctgtttggccaaggtaaatgtacctatagccaaaaatgtaatcttggaccgaatactgttgattgtgtgttccttggttatgctattcacagcatgggttatagattcttaatagtaaattctagagtacccgacatgcgtgttggtacaattattgagtccagagatgctacattctttgagaatgaatttcccatgaaaaatacacctagcacttctagtcaaaaaactgtcataccccatgagcactttgcaccgatagaacacaatgatcaaacgcttgagggaaatcctgaggaggataacattgtagatactcgtaagagtaagagacaaagggttgcaaaatcctttggagatgactacattgtatacctcgtggatgacactccaagaaccatagaagaggcatattcatctcctgacgctgactactggaaggaagcagtacgcagtaagatggactcgattatgtctaatggtacttgggaagtcgttgagcgttcatatgggtgcaaccctgtaggatgcaaatgggttttcaagaaaaagtttaggcttgatggtacaattgaaaagtacaaggcaaggcttgtggccaagagttatacccaaaaagaaggcgatgatttttttcgacacctactcaccagttgcccgtttgaccacgattcgagtactacttgctctggcagcctctcatggtcttctcgttcatcagatggacgttaagacagctgtcctaaacggagagctggaggaggagatctatatggatcaaccagacgggtatgtactagaaggttaggagggaatggtgtgtaaactgttgatattcttgtatggccttaagcaagcacctaagcaatgacatgagaagtttgacaccacacttacatctgctggctttgttgtgaacgaaggtgacaaatgtgtgtactatcgctatggtgggggagaaggagtgatcttgtgcttatatgtcgatgacatattgatctttgggaccagcctcaatgtgattgaggaggtcaggactttctgtctaagacttttgaaatgaaggatttgggagagactaatgttattcttaacattaagctactgagaggagatgagggtgggattacacttgtgcaatcccacaatgtggacaaggttttgagtcgctttggatacagtgactgcaagccagctattactccttatgatcccagcgtgctattaaggaaaaaccgaagaatagcaagggattaactgagatactcccagatcattggtttattgatgtacttggcttgtgcaacgaggcctgacatctcatttgctgtaagcaagctgagccggtttgtctcaaacccaggagatgatcattggcaggctctggaaagagtaatgcgctatctaaagggcactataagctatggaattaactataacgggtacccaaaagtactggaatggtatagtggctcaaactggatatctgatgatgatgagataaaagccacaagtggatatgtgttcacacttggaggtggcgctatttcctggaagtcttgtaagcagaccat

SEQ ID NO: 30991 - DNA, 7635 bp, Oryza sativa
atgaagtcatctaggcatatcaaaagaccgctgaaatatgttagaaagcagaaaaactccggagtgatagcattggactatgtccacatggctaaaaatctagcaaatcagtttaccaaggggctatcacataatgtgatagacagtgcatcgaaggaaatgagcttgatacccacctaaggttgtacaatagtggaaacatgtccattgtgattggagatcccgtgaatttggatggcgaatcaaactattgtgtggctgagagaagagacccttgaaaagggctcattttcatgatgtacttctcttctactctgcatggtaggatgacttatgccttaatgtgatccgagtggtttttctaagcagagatgttgacctgtagaacatctcaaaaggaacacacctatatgagttcgactgctagtcacagtctatgagatttgggcgatctctagatactcatgaaagggcctagagtttgacttatatgctccaaagaaagcggatgcaaacggcagcccaataacactcaagggtttgagtgaaacctgatcacacaagactaacaattcaaggcatagtccattgttcagttgtggtctgatgtagctcatttcctaggtggaagttcaacttaacagtctccaccaaaacactggtatatcaaacaggcacaactttgagaacatttcttatgagccatgaaatttggtggggattgttagaataaatgggctaggcccgatttttctattaaatctcaaaggcccataataaatgttaaggataataataccaccctgggaattaaacgaggagtatctcaacttaaatagggagttattggaggctccttgttgaccggttgaggtgaggatcggaaagccacacgcgcacgcgcgcgccgagccgagggcgtgggcgaggcggtgcgtgcgtgcgtgcgatgcgatgcgatgtacctgtctctatccttttgcaacggatcagaatccaaccccgagattgcctccgtaacgggcaggcgattcaatacccattgatcgcgttgttactgcggcaacgggcagatctctctcctgcgccataaggaaagggggaacccgattagatccgcccggttactttccaaacactggtgttctttctcctccgttgttaacagtgaaatttggtaagcccggagtagtcatcggcttagagtcagcatcggttttgaagtcctgagattagccgatgagagttgtcaagccgtcagttatcagattcttgctatattcggttaaggaaattgatctactaaaggaagcttatccagaagagaccgagttcaaagagaatgcggcatggcaagttatctattaattaggaataatttgttagtttcctttttatctttaggaaagtttctttcttgtccggcaaggacttgtatcaacacatgggtataaatatgtacacccggggtctatgtaatgtatcttcacgatcaatacaattcggcccatcgccacccttttttacttctacttttgtttttacgttccggcggaacatggcacccgacgcggggctgcatcgtctttgatctccggcgaatggataagtccaatgttccgtcggtccaggcaattgtatcatctacatcggcgtcgttcaaggttgtatcaatacatttgacctcttggattgctctagtttagatgatatatttgcctacctatttatcatatgtctctattaatctagtcttagcatatcaatttagctctatcggctgcttctcgttttagggtttctgccggtatcggttaaatcgtgttgctagattagattagcctaggcatctaccaccctaaaaatcagtcaacggcttgattgtctagatattgtgtttcttttcatacttagtgctgcatcagttaagtttgatctactaagtcgtgcttagaatcataatctctagtttgcttcttgattgccaataagggtttcatcggggtttcagccggtgagttatctggacgttgcatcggctcaataaggattgcatatacatataagttggatttagccgatgacaacaaaggtttcactgtttagtctaatcttgtggatttcataacatcggacctccagccgatgtgtgctttaaccttcggatcgatgcttatttatcatatcattatttgccgattggtttctactcggttatattgttattttattacatcattaacagccgattgtctttatatcatcatctacattggacatatagctggttgcttataccctattgctatcggctggtatcggcatcggctattatcggctatcggctggaactactccatcggcttgtcagccgatcggctgttttgatctactatttgcatatcttgtcagttgcaggatcaaactgactagcatgtctgcatctcatcaagatttggacctgcacaggagctaagcagatctcccaggctggtgtgttcgattttttcgtcaacatccgtgcgccgccgctgcttgtgttgcttctgtctgcttccccggttctaattgcttgcgcgcacgagagatcggaacgagcagggcctccagaaccacaccttcgcctgagatctgcaccgggtaggcgggtgatcaggtttttggagagtgcttccgcacgactgctcccgtcttctgttcgtcgtcgaccgtacgtctgcatcaccatgtctgcctcacctacacttggagatggcgcgccgggagccggagctggcgcaccgggagctggtgcacagaacgacaacaccaacggaggcagttctgcccacaatccagcggagggactttcacagggtataatcctctactgctatttcagtttttgatatttctgttagtcgaaatgcaattgcgttctatgtatgaagattatgcttattctaccttaagcattctcctgtttatgtttgattttatcactagatcacctcacattgttcatgccatgattattatcttaatattttagattaaaaaatgccgatatatgactatatttccaacagctactgcatcacatcccctccctcaaccagctctggcctctggcccgatggccccgcagcccgaggaactcgcgttccttcaatcgctcgccttcatgcccctcctatcacattcacatccccttctgtcgatgacacgctctctttcccgtatttatctcactgcgcagcaggtgagcagagagagcaatcagaggtggaggaggtaactgcacttttgtttattttccaatcaccggctaaattgatgtttttgtttatttctcatagttcagttataattcttgtttggggttgcttagaggaagaaaggtgctgtttgctttccctgattttgttcatgaaggtcctttttggagctttggtatctgtatatgtgataatgtgaagcaaaagttgcgggaattaatgatcttttccaatgcaaagtagatactcaatgcattcatctttatcctcataccgtaatagtatatatcagttagcactggatacaaaaataccttatattgtcgctcagttagcagtggataggaagataccttgtttctttcgatgtgtcaggattgagttttctagcccttaaaaactgaacagggctacatgctgaattttcaaacaaagataatggtcaatccctggttttagagggaggagtaaatctatcaccactgttgcattagagtttgttaattttcaatatctgaaagtttcacgtgccacggaatgttctcttctttcactccagcaagtaacttttgtgtctgtgtttatcaggtctaggaattagataagaatgaaaaaacaacaataagatcgttaggaaagagttttagcttgcatggagcaaaacccctgttagtccatctgatctcaccatttttttgagctcacagtgtgtgcttttgctctctgagccgtatgaagataaaattgatttcctttataatatccttggcctgcttcaatcctttacattgataagaggctgctactttaatcctttttccatgacagatcccctcctctctcaaacccagaaatactgtgttgttcctattttctgaatatatgcagtacactgtattattaacaaagtagactgatatttcatatttgattatctggaagaggatttgtttgtgctcacactgtgccagtgctttatgagaaatatgaagatcaagttgatttcctctagaataatccttggcctgctgggagaacatcttactatctgacaaaatcaatgaactacttcatatgcatgctaataaaataacatcataagtttcggctaataatttaatttaccacgtaataagtaggccttagaaatttgaaaaaaaaccaaaaattaaatagttcttagacttttggaggaagagagcataagtatagatagaggtacataatattagaattagatactcctacatatctatacgtgcacgataatgttctatttttaactaaaaatgcacaaacccgtctaaccaacacttactaaatcaatgaaaattaaaccagggaatgaaccagagctgttatacactcttttactaattaacatcagtggacgtccgtggtggcatgcaagggcaaggccggcggccatggaggcttgacggggaacacccacttctggaccagttcgtcgccccagtcatacacgtgctcgagctccatggtctcgaggtcgacggagaagggccacatccccgacccctccggcggagtcagcacgacggatcgtcccatcacctccaggatcttgacgccagttaacctctcgacgaggcggctgtagtcttccagctcgggcaagccacgcgtgatcaactccggcagccggagcgtcttctccaccgtccactccctgccgccgccagcgtggagcggcgtcagcacctctaggtcgctgtgctgcaccactcggacgaggcgccctcctccggcatcatcgccgacggcacgcaggttccactggcggtagtagaaccggggttgttcgctggcgcagcacttgggcaatgtcagcggcgagagctcgccggtgctctcgtcgagagcgaacacaacgccgtatattgtcccccagtagagggagccgccggcgcgtccggcgaagtgcatggcgtcggcatcgaaatgtctctgtctccttgggacgcccttgggccggataaggtcaccgaggtccatgcttcttgtgaggcgcagccgcagctcctcgtcggcgccggtgaaggtggagaagatgcaggccgtctttgctccactcccgaaggtatagagaatcagtagcacggtaaagttggacacgccggcgacatggttgttgttgttgttcttcttctcgctgccggtgccggcgccgaggagggaggcgtcgaggcaggcgacgtgtttgttctccaatggaggaatcactgtccggtagcgccgcgtccatggctcgcaaacgactatggaaaccgaagatgcgttgccccaatagtatctctcaggcaccaggaggacgaggccgccatggctgtcggcgagcacccaagaagtgttgccgggctcgggcacgaagtcgagagagaagcgtttgctgctcgtcacggcagcggccgccggcacgaaagcaaggctactcaccctgcaggaaggagaaggacgggaccagttggcgaagatgcccgtgtcagtggcgatgtagttgccgatggtgagcgcgttccgggagcggtagaggcggaggaagccggcgtcggcgacgacgcggcaccaccgcctgcacgtcgacgcggcacgcacgaggcagatgggcgatgcgaggcgtaggaagacgctctcgaggagttcgtcgggaagttcgttcaccgccattgccggctgcgagctcgtccaatacgaccggagcttgcctcgttggtccgcggcgccgtgctgcaattaatacaaaccttgtttaccttagtcgtagccgtaatagcgtgtatgtgcatgcgtgatctcttaccttagtctatggatggccttatggccggaggcccgactgcccggcccaagcacggcacccgttacaaccacgggtagggatgtaagcgagccgacccacgagtttacttataggtcaaatagatgataactcatggattcctttttatgggcctgctagccgcatctagagatacaagtggatcgatttatagacttctttataggttaaattaatcggtaacccgtgagttacctactaattttgcttataaacggcttcgcagtcaaacctgcctgcacccctacacacgggtattttttctatttatatctataacaaagcaaaaaatacgtaaaggttctggtattttttgtccatctttcttctagtttttctcgaacaaagcttccggttttttttccatccgttttctttcactggattatggcccgatcttttttgtttggttttttccgacgctgtttttcttagatctcgtccaatacattacatgtgcgcaacgcacctcccaccgcccccgggccaaattaaacctagcgccgccgccacgatgatcaatctctacatgctttttcttctccaattgactgtaaaaatcgattctctactgtttttcttcacgatttcgctattgaatttgtttttatttcgctagatttaatctcagtcatcgatgatgatggcagatcggcgagcttcctcagcttgtttttatccgagttttgcacattcgctctgattattggaaaaagtggaaagagaagatcgagtagattaaaagacctcgaccaattatgggagattgagaaaaattcggctgaactgatggggaggatcgactccggcatgcgaacatgagactctcttccggagggtgaagacagtgagagctggacctgtgtctccacatatgggcttggccgaagataggcagactagtggactggattgaggctgaagacgaataaaagaatgggatttcggcccaaaaccatgaaagaatttttaaaaactttttcaattatggaaagcaattctaatgtttcaatttattgctcagctcttaacagatgttgtttccatgagaaaacatttttatccgtttcaacgcatgggcaaattttgtagtctaataaaaaaatacataaggctttcggttttttcctgggccacctggtttattttattttgtcgacgatcaattttctttgcacgcggaatggttttctttttttgcgtccatggggcttcccctttttcttggtctttttttctttcagttagttcatttggcacgcgcggaaaggttctttttgcaagcatctgccttttttttataaccgtcgccgggccgaatcctagcgctgccgccaagctgagctctatagccgccatcgtggcgtgtgcactgccatgttcaccttttcaccaccaccggtggcagcggcagcacgcagttctcgtgggaggataaggccatcggccacatcgtcaggccattgtcaagcaagcacctcggcggctcgtggtacctgtacgccctgggtgggaagc

SEQ ID NO: 30992 - DNA, 15584 bp, Oryza sativa
gtgaacaaggcggcgcgcatgccatgaagtttgacatgccgacgcggccaccggcctcctctgtctccgcgccatcggcaaggtaggctctcaagaacttgcagctgccgctaccgaagccttgtcccaccgatggagggatgacctacttgtactgctgcctcagggcctcgcagacgagcaggctccagaagccatcgtcggcatgtgaccttgcgaagcccaagaggaggaggcactcttggctgtccatgatcctccatgacgactacggctgcaagccgtcgacgatgtcttggactaggaggaagttgagggagaagtggctgtcgtcaatggccggtgctgacaccggtgattgtgcaaacgaagtgatgttttcggggttatagtagtaaccagcgatggtgggggcgtggagggaatggaagcggtggaggaatccagcatcagcggcaacgatgcggtgccattgcttgcacgtggaggcgatacgatgagggagacggtggaagcgatgctcaggagagctcgacgaggtcgtcggggatgtccatagttggctagctagttttttgcaaaaaattagcgatcaaatctggtttttccctgatcaaattattaggtgtgttattgtctacgactctgtgcattagaaatttagagtccgttttgcattggaaaattgacactgtagttatattgtttttctggttactacgagaaagtagtatttatcatacgatcatctaataaactagcaaatacctgtgcgttgcaacaggtaaaagaaagattataataaacattagatgattgagttttaattcgtgatctaagctaacatttttgtatttaattctttaatgaaacattgcatttgatttcatattgcgcgcaagagtgtaccttggtggaagaaactttttcaagaaaagtgacatataaaataactttgtttaaaaaaccaaccggttcatcaagggcctgttcgtaagtgcttattgatcatattctagatgcaaattgtttacttattaacatgatgaattgcctatccatagcaacgggtgaatgcaattagggtttgggggtggtagcggctgagaacgatcgtgcctgtgagcaagagcgagagggtggagctgacatacttcttaagggcaccaacgaaacaaggatccaggatgcagagggcgacaacatctacaacagccagagtaggggacaacttctatcacgatgatgttgagcaggtcagtagcccttctcccccactcccacctttcccgcagccacacgcgcacatgaatgccttctctcctctagcgtcgccgccggccgcagctgagccttgcacggctggcgagaaggtgcgaataccgaacagcaccggtgagctccccctccccctttactcctcctcaagccagcggttgcaagatgaccctaccctgctgtcttccccatctatggtggcttcctgctgctggatccaccaccttcgactgccgatgccggcccaccaccctccgtcatccctgcagcgacgatggtaccgctacttgcgtcgccgccctcccgagtccacagcctaccatgggtcctcccgcgctcatggcaatccctctaagccctagggaaaatccccttttctacctctctgccccttccccaccaccaccattgtctcgccagagctagagaaggaggtcatcataaatatttgtgccgataagatagttcaatggatgaaccaatgattaatgacgttgttttaattaagagtgtcctatatggagaagtaaaatttactagcaatcagataattatccaatgctcagatttaatcgaacagttcatacaacacatattctctcatctaatggctgttgtaatactgatgatatggctgcactaaatcacagctaatgaggatagtgaagttgcatttatcccctagtgggttttggtgattaatgatgaataaggttaagggactaatgtgtttattgagatattcaggtaattagtcccaaggtgaacttaggtgatcaatagatgcttggagaccccctacaacattccttcaaagcggatttgaagctcaaaggtcaataggatagtttattttttgaaatcgagttttaggaaaaaccgtactattaagagaggttccaggtgtggttctgagatataaaaagtgctcttagtgggtttgtagtgatagaatatttttgggagccatttttgcaaatgggtccagaccggacagagaaggttggccggaagttccggtccctggacctggaacttctggaccctgcatcgggtgaaattttcctaagtgttggccgaaagttctgagggtcaggaacttctggacctcttccagttcaaaaatgtgagtaacggctagatgaagtcacctagccgttatatatatccagatcgcacccagctcaccttttggccatttcacttcagttctttcatgccttaagttgttctaacctctcccaagatccctttgcttcctccactcaaatctagagccgttcttgtgagattgagagaatatatgagagtgtaggagtgatttggagaaggtttgaagactagttgtgtttgagcactttggatatcttgtgggctatcacttgggcttattacttttggagatcttcttctagacggttaggtgtcgcccgtgagcttccaaagatcttgtggattttccgggaaagtttgtgaaggttttccttacctccggaaggaaacgaggtgagtaaagattcttatgctgagatttcagaggttctccttggtagagcaacttgcacttgtggtcttttctagaatgatttgtgagttggatcttggtggtcactcaaattctagaaaatgacctacattaccagggattaggctttcagtgatgaactctagtgatgaaaccctcacttctcactagtaagtggttgtatagtgacaaattattttgttgtcaccattggacggatatctagtgacaaactgttttgccatcacaattcctcctattactagtgagaaaatgtgtttttatcacaaaagatgtaaacaatgatgacccagttgtgagaatttcgggtctggtcactattctattaaaaaacagtgataaactaccctgtaatcactaatcatatcaatcgtgaggagtgaatggtgatgaattagagtgctctcactatcttgaagataccttgtggcaacaaagttgaatcgttgagacaagtacctgtgatgaataaaagtattcactgtttggttctagtagttattaagttaagtacaccatcactaacctccttttcatccctctctaccgctttgactgttcaacagtcaggctcacgcagagcaggcagcaccgcagcagcacccggcggccgaaggcatgagccttggcacgatggaaggattgcaggccaagacgctgaggctgctattgaaggtagagctgctgcaacatcaggccccgtagtggtggctacaggagctctgcgacctcgatccgacggcaggtgcacggcgaactcgatacggtgcggcggggtcgtggcgagatccatcctgcattcgagttgcgtcgagctcaatccaaagcttcagagggaggttgagcagtggtagtgggacgcggcacgatcggagcacgagtggtggacgcaggcgcaccccgagcttactgacggcagaaccagcagtggtaagttccatttcatctgcttggtgctgccggctactatatcttgatgctttgttgattagtaccatggattggctggatctatgtgagccaagccaaaacaatagattcgagtgggagttgcagtactgcagtggtatggaaaaggggaagtcagttcagtcaaaaaaacaaaaggggaaaaccgagagggaaacatagggtaaggtgaggaacgtgggagaaatactcctgagcagatggatacacagatgtgtccagatccctatcctctttatctgaaaaaagctattatccaacatggtcagctgttcaaggagtatggattatatatctgaccgtgacttacagagttgcaacagggcccaatacttagtagtacatgctagtttctactaatcagtcaaataggcctcaatatggattagttacatttcataatctgcaagaaattaatttacttagtatattgtattaaacataggcaattaatgtcctcaatatcaaagaattgtatttcaggccaacatatttttgctgtgtttgtgtaaatttgcagtaacatgaatatagtttataaattaactgtcatctacatcttcttcagtttggatgtcactttcatcatctgtatctgtatactcagcgccatcactttcagaatcttcctcttcttcttcttcctcttcaaacagatcatcttcagaatgtgttactggttctgcttcaatgggttcacattcgactccatctttactgagaaccgtagggaagtcaccatcatcaattgtagtgtaattcaatgcagccgtgatatgctcattctcttggcatgcttcagaactagacttatttgataaagttggatcattttcttcttcttcttctgtaggaggaaagtcatacaaatcacgtggcttcgtcttgactacaacaaaccatttagggtctctagtatctttgacataatatacttgctcagcttgtgttgccaaaatatatggctcatcaattggcactgtacgggaagtattaattaaggtaaatctatgcttgtcctcttttactccccttttagtgtgtacatcccaccattcacatttaaacaatatgacactaaaagtaccatatgttagcttgataatatctgtcaagacaccaaaatagtctttgcttccactggcttcatcacctttaacaaagactacactgttttgtgattgaaccaacttgtctcggtccctggtgttaaatctccatccattaatcatataacttgtgtaatgggttactcgagcatcaggacctcttgctagagcaaacaactcttctgatatatctggagatcctttggaatgtttctcaaatatctggaagaatgtttatacaggttacaaatagttgtaaaatgtaaaaaaaatacttttattatggcgtgtacatacatgattcttgaaccatacaaaaaattctttgtcatggcgcttttccacacctttactgttctggatgctaagttggtctttgtaaatgctgcaagacatgtacatgtacgttaaattttgacagcatttacatattagaaaatgagagtaagtagtagttgtttactttgcgtattctgatatttcttcataattctttagaacatatatccgagctttctccaactcattcatatccatctggcagtatttgttaccaaggagtggcctgccaacagtaccaaatatctgaaattttgtactgctgttgtcactctgcacgtcctcgattcgacttggtcgattgattcttgtttcaactccttgaaggtacatagaacaaaaatttacacattcttgcaaaatattcttgtttcaactccttgcaggattcttgtttgatccttcagggcgagctttgttttttacaaaagacttcaaccttcgcaaaaacctttcaatgggatacatccaccgatactggacaggtccaccagcaatagcttcctgggctaaatggattggtagatgcaacattacatcaaagaatgaaggggggaaaatcatctctaacttacagagggtaacagcaattgatgatgcaagcttcttgagaatttcagtatctaatttcttggaacaaatttctctaaaaaagctacatagctcaattatagcctcacaaacatcagcaggcagaactccacgaatagaaaatggaaggtatctgtgtaaaaatacatgacaatcatgacacttcatccctgatattttagcttttgttgcatccacatagtgtgaaatttttgaagagtatccatctggcacttttatttctctaaggaactcacaaaatgctttcttctcagctagtgtcattgtatagcatgcaggacgaaataagatcttcccatcaccagttggaggtgcatgaagttcaggtcgtattttcatgagttccaaatcaaaccgggatttaatattgtcctttttcttcccatccagatttaacaaggtacccacaatactatcgcaaacattcttttcaatgtgcatgacatctagattatgtcttatcgataacgtacaccaatatggcagctggaaaaatatactttttttcttccaaactccatataatgtgcttgagcgttttctcttattgttatgtttcccaaatttcacctgaatgcataaagtgatgtcaacaataatatactactcatattcttatactcaaagtaataccaaataaggcatagaatagcaaatagtataataatttactttcagattgaccagataggatacaagcataaatatatcataattagtagagtacctgattgaaattttgatattgacgcataatgtcatctcctgacaacgcttttggggcgctacgtctttccttttggccatcaaaagattttgcattgctcctccacgaatgtcttgttggcaagaagcgacgatgtcccatatagcagtatttgtgtccattaacgagcctatgggaccaagtgtccatgtgacaagaaggacatgcatattttcctttcgtgctcatgcctgataaattaccatatgcagggaaatcattgattgtccaaagcagcattccccgtagcttaaaagaggactttgcatgagcatcataggctggcacgccttcccatagctgtatcaattcatcaatcaatggctgcaagtatacatctatgtcatttccaggtgctttaggcccagggataagcattgacattatcatataagaatctttcatgcacatccaagttggtaagttatatatagcaataacaactggccatatgctatatgatgagctcatatttccaaaaggattgaatccatcactagcaaggcctagcctaacattccgtgcgtccaatgcgaatgattcaaaattcttgtcaaagttcttccattcattagaatctactggatgtctcatatatccatcatcaactagcttctctttgtgccatcgcatatgaacagctatttttgaacacatgtacatacgctttaatcttgggatcaaaggaaagtaccataaaaccttctgcggaactttcctagcttttctcctccttgacttgcgagcactattttctccatcctctttccatcttgaaattccacaaacagggcatgtttcagctttagcatattcacctctgaaaagaatgcagtcattcaaacatgtatcaatctttatataatctaacaccaaattattatcacaagaccacgataccctatggcagagacatgattttgctagatgtctagcatctaatatagcatatgcttattaattttttttagataatgagcatatgcttattaatgaaccagctcacgagctgagccaagctaagcttttagtattagctttgttaatgttaatgagctggcttattagttttccatgcagggaggtgccaacccacatcaacaattaatgtgcatgtgtgtatcattttttttcactccacaggttattgattcattaaacaattgccatatttgtttacgagagcttgttaacaaatgctggtgaacaaatattttggatcagcacaaacaaactaatttgttatgcacgcacgcataaatcggccagcaaaacatactttccctccaaaagtaattgccagcaaaattttactcccgccaaattgacagagttacctcactatataaggctgcccatctagtacaatccattcgcatctagagttctcgatccctgcgcacacttgcagtcaaaggtaaagaaacaaatctactatggctctttgctattctcgcaatcctataggatccattcggcattccccattttttattcactgcatagccctagagtacatccatctttgagagattacacccaccactgccgggacacaatcacacaaccaccatctccaaatcactgcagtcctatggatcttctggcggcgctggtgccgcaacatctacatattgatgatagcgtggtgtcgcagggatatgacctgccccttctggcgtccactctctccgtcttgtttttctgcatttatgatttgtgttaatttcctaattagatgcaacttaatatccatttttaattgggattctctttcttagttaatttggttctcaatcttatagtatatcggtgttttgtggggatttctatcttagtcaatttggtttgtaatcctgtagtagatctgtttgtactcatttcttattttgtaggtcaaaatggtttcccaagttcgtccatccgtgaaccagatggagacttcggatgatgctgctcgacaagtcataaccaatactaggaatgagggacggatgggaccaaccggaaacacaggtatttaacatatttaccttcacttcattaatctattccttcacaagcaaataaattaaaatacttcttccttcaattaggtctcaaacgtaggaaaggtaggggtctcaccattaatggaacacttgcaaaactgagagcaaggggtgtgccactagacattcaatttgctgcacagtttggaaaagtctatggtaggcacgcaagtgtctttaaaagtgaggtcactgtctgtgtgcgacaagaggtcccccttaaggtgaagaagtggaaagtcattgaaaaagcttttcctggaaccatgtcatcaatttggaatttattgaaggtatgtcatctggttggagttcttgaattttcggacacattagcatatttcatttgtacatttttgttttctttttgctgtcatgattttgtacattgtttgttcatatgatctactatcattctgtaggcaaaattccctgagatctcaatggcagactaccaatgtgtaatgacacaagttgagcgaaagtacaatgtaagacgccacaaactgtacaagacctattgcacaacaaaaacagtgtcctagtcatgttgcgccagaggactggcagtggttgattgataacttatggagtgatgagcaattccaggtacttgtttaattttctttacaattaatacaatatgattcataattcattattcttatgagattattatgtttttttagaaacggagcaaacataattccattaacagatcaaagcaagagatgaaatcacatgttggaacaaagtctatagtgcaaatagcacatgaactggtaaggaatattgtcattcacttatatctttaaactatatgtttgacatgtcttgtatatataaattataaggcttcttttgtatgtgatataattgcagagaaacctagtgacaggtgaatggcctagtgctatagatgtttggaaggcaacttatttgaagaatggaacatggtccgttcctaatggcgaagaaattctggtaaacaaaaatgtctgttacctacattttactgcatgagtttttttaatatggacttacatattttctttgatttgtttagaacaatctgcagacagtagctgaaacaaaccaggaaaggattgcagctgctcaaatcccaatggttgaacactttgcattagtccttggcagaaagccaaaccactcgcatggagttggtattagtgcaatcaatgagggagctcaagagaggtacagagttaatgcacaagcagaagctgcacaacagcaagccaatgaagcacatcaacaagctgctgctttgctagaagaagttcaaaaattgacagtagaaaacttgcaattaaagggcgagttgcagtctcagcgtgaagagttgaattctcagaaaagaaccgtagaggaacaaagtggtcacatggagtgtttgttggcccagaaacttgaggaaagaatgaaagcaatgtgggcacgcatgggtggcactggtggtgcttcatcttcaagtgtcccaaacaattaagtaagatttcttacgtcatacatgattactaattcaatctagtggtcattcgattaatgttatttttaaattatatgtaggaagttccaagttgacaaagactggcgtcgtggagttgctacaaagttctgtccatctaggcgagcatcctagagtccgtgtcccaagtttcatttgttgcttaggtgttcagttatcaatttagttatggtcttagttaaaatgctctttgtatgagcactttgttatcattcattaataaaggatagtttcctctagtgtgaggaacccttctgtcacaccccaatccggcaccgccgtacaatggcacctgacaggagcgtgtcgtaggaaaaacggcgtgaaccgcttcctacgaaaccgcgatctcagtaccagtcccaggacatagtgctggtacccacggtgacaaatatgaatcattgcaatccttaaaataaatagaggacttaattaccttaacttagttgcagctcagaacagcccgagaatgcaatcgacgatgcggacgaggaaacaccaacaacaacagcagcagcggaaccaacgaactaacacccaacaccacaggcgacggctgggaactaggacgaaaccctaatcttcactttacttcatcttcaactttagggcggaggaactatatatatttatatagagcaagggtgagtactttcgtactcagcaagtcacgggaatttaggtgtctgatgcaagcttggaagagaggcaaggttgttttgcaaatcctttgtttgaaaccacttttgaaatcactaagtgatttatttctttctaagtgtgggccgaaaagagacttgcgtctcgattcgactttaagagatgcttttcaacaactcaaatggtaatgtaccgaccacccgggtcagatcattacttctcggctcccagagccatttcacttgattaagcgtctcccagagcctttttcctttttctcggactcccaaagtcctgctgcccagcagcacaacaatccgcttctactcgggaagcctagtctatgatgcccgcagacatcccgaatcacacagattcgtttctgaccactcaggtcatccatcggccacattggctgattctggttatgattcccacaccataataacttttcacaaagcacaggcaaacaaatctaagcaacgggaaccacctcacatccgcccatgaccgtgggcacggctattcgaacagttagttaacctcttcagaggggtacccccaagatacgaacttattccgaacacccgtcggtgtcggaggttcgcaacaaagcctttcccaagccgacctagggatacctcatgccacatagaaggatcaaatcctcacataaatttaggccattttagttttcacaaatcaaactccaaccacctcgatcggtaattcagcaagcttctcttccttgcttaccaggaacccggtttggctccaaccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaactcccgcatcgcgagttttcacaatttattttattttcaaacacaccgacaccacatgtcgggttttcaaggcttctcaaacccatttcccaaattatcgacaatcaacggtgtatgtggagtagttggtatacgcgctcagagagccggataccgaagtaccacaagggtggagcgacaaggaatcagggtagtacggcctgcaggaatttgtgtgactactgggtaggtccgtcggtttgacatgcaaaccgaggccaagcatgttataggtgtgattctaatagttcaagttgcaaacaaaataataatgatttttcaattataggagatattgatcaaagggtgacttgccttgctaaaggtcttcgcgaagcttcatgaatcttcgagaaaaccacaatcgacgaaaatccggtaaccgcaactatacgcaaacaatcgaaaacctaaacaaaagaccaaaataaagatcctatttagactaaataatagtgccattatatagatctcaattttatggaattactggaagttgaacggagtcaaacggagttacggattgggagatatggatttcggaggtttaattggaatatttggaataggagaaatggtttatggaatttatagaaataatattctcaagaatattattgacagtcactgacgtgcgggaccaaagaaaatgattcatggaattttgggaataaggaattgatttgtgaaaaagggaaaaggatttattaatccctttggataagaaaaggaaggagggataggaaccagactttcccgagtagcttggcgcggcccgagaggatttgcgcggctcagccgagcttattgggccggtgcgggctacggggaggcagcccaagagaggggcgcggggagagagagggggaaggggagccgggtggaccgggctcacctcgcggggtcccgagtgggcccgcttgtcagtgaggcggtgcacggtggaagcggcgcacgcgggagcgggcgctaggttttcggagggagactgatctcaactggcctcggtttttccgtggttcgggcgcggcgcgccgggtggacgaatggcggtgggcctacgtgcagccgcatggcttgccatggacagcgcgcacgggagggaagacggagggagggggcaactgactggcttggcccggtcaaagccgaggtggcgccgacgtggcgcctacgtggcagccacgcgggccggcgggaggaggaagaaggggagtccgagatggacggcggacggcggccaagttcaccggagctcgtcgcgacgattcgagagagagggagtacacccggaacgatgggacggacgagaggaagtgaaccaccggatcggattcgctggaggaaggcgcacaccggtggcgagaaaagggggaaacttcatcggagcaacgggggttcgattaaaaggggtggaagcatatccttggttcaaggaatccagttccggcgacggatgggacaaaggagtaccaaggagggccggcgacgagcggtggcctccgggagtggacggcaatggccgcgaggccatgccaggcggcggcggggctcggggcgatgtccacgcgcgttcgggagtgccaccgagctatcacgcagactagagggggcgagggagagcgaggaaggggaacgggaggaggcactgccgagccgggacgggcgctgtgacgagcggccgacggcgcgggagcaacctctccgacctcgggccggggaaggggaagatgacggcgcccggagtcctcttctcgcgtccttcacacgcaccggtctccctggtgcttcggcgacggatggtaagggcgactgcagggcaggggcgacaaggcgcgattgtggcgacgagagaaacgagtgagggagatgggaggggctcgggtttttataggtggcgatgttggtttgggagaaccgaccttgggtcgttcaaggagaggagctgtcggtcgggcgtggtcaaggtggtggcaggcggtgacgctgatggtggtcgggcaaaacgaaaaaggaggaggagaaagggagctctgctccttgctgtttcgggaaaagttgaaggaggagagggagtaagtgaggggggctgcctctctcggctttggaagatagcggcgtggagcgccagagcggcagcgcacgacgcaggcgacgccagggcttgacgcgccggcaaccgagcagtcggccacgcgcgagcgcgcgggaacgagcgaagccggtgcaggttttgggcggcgacggcgggaagcggcgtcgacgcgagagagagaaaacgagagagagggagatccttctctcggcgatggctcgtgcagcgcacgtgagggagatggcaaaggggagagatgggctggagagtggatccggcccattcaaaacagggagaaggcaaaaatagacttttacagagaagactgaattggagcttggatttgaatcgagatttgaattcaaattgcatatttgaactcagcgaaatacggaggagccaaggaatggattcaaggtggactcggacattttggaatcgggacaggtatttggcgaggattcaaaggaggcgattgaatttcggagacttgagtcggaattggaattttgaggtgggcgattttgatggcgacgagggggaacaaagatggagattgaattgagatcttggcacaacttagactcgcacacaaataacggaatttttgaaattaggattttgctgaattagtttttaacgtctcacaaaaagcggagcgttacacctttttagtttaggtgatatttcaattgagttctgaagtgctctattccgagcatactgtaatcattcatgaataaaggggtgctcagttatgaatgtttgaacttgccattgctctatcgagatttcatcattagattttgtcattgttcacatgctgaatattgtcataaaagacgtgttgtttgtggcaagactttagtcacatatataaaacttgcatctggatatttaattttttagtgataaaagttttccttacagcaatacccttttttctccactgatgcattacttcatatgtgataaaggtattgtcacatatacatattagcttggtcactactacatttgtaaagaatgaccagttttcgcaacaaataacacgtcatttcaccacaatatatcttacttcttgtggtttttacttctcaatataaactaatatcttatcacaaaaaccctatcatatgtgagaaaagttattagcaaaggtatatttgtgatgatgagttatcggtaattagtaatatgtagtgacgagcaaaccagcactaaccgtcgacaatattgtgagaaaaaaattccatcactacacgttcacatatgtgagggcactattgtcactagtgtctcctgtaattgtgaccacgataccatctctaatgtactgcttattagttgcgataggattatcacaaacagagccattatctgtgatgaaaaaaaaaatcatcactatgctacttgtgacgccagtagtggtgacaacatagtgacgaccccaaaattcgtcacaagggggtaattgtgatgagaaacagccttttagtgatgaagtttttcatcacaaaagacatgatcccttgtggtgctagaagtgttgggttgaaggccatgcacatcttctgggttctttgcataggtgaggcaagtggttaatcgagacc

SEQ ID NO: 30993 - DNA, 3285 bp, Oryza sativa
  unsure (1)..(3285): unsure at all n locations
atttgtttgtgaatttcagtaaacctattcacccccctctaggctacatctctgtgcgttcagatagttatataggatttatagatataataatggctcgaattgtcataatttgaactgatgtgaaaaatacaatagttttcccagaatggtacacaatacagtatgttgtcaccatagaaacaaaatcacaatagcaaaagggatactataagaaatacaatctatggtgatcaccggtacaaatacgacatatttggtggtcatatatatgagtctaactactgttggtgcctccatttcagataagctgcccaaccaaagataatcaggaagggccaaaatgagtgcagaaagtttcgaagtatcttcctgcccaaaatccaccacaccttaaacccaatccttccctgtaagagcacggccatgcggatctgtgtcttcattgacgtatgcccgtgcaataacccaacggaacacatgaggcagataagcaaggcagtcttgtgagcaactggtgccaggacaacgtataaacctaatgcaaatgcagctagcaagcacctgattgatagccagaccaagctattggccgagttaaggtgctccaagcggatgctgtagtcaactttggtcattcctgaatacacgaggctaaatgtagccaacaaggagtagacgaatgcaaatgtgatggccaagacgaatgcatcgaaaccgtagcttccgacgaatgtcggcgtgccgccattggtgtgatcatctgctctataacctccaggcaatgtaaaagctgctgcgaatgccacagttgcaatgagtgtggagcagacggccataacttgtgtagactccgtaattgtctttgaatcttcttgttcatcgtcatctttttcaactattttagaatctctttcctcacggaccgttcggcaaatgcacttctcttgacgatggtcaagggaagggttagcatgatgtgcattcgcaagatgtagtgacctctttatccaaattcgttgatgctgtaataagcacaagcatgcatgagcatcaagaagtacataccaaatttgtgcaaaaagaacatgcattttccgcgcgggggtggggggggggggggtgggnanaggggattgttattaccgatccatgaagaagcccttctggtatcagcttccttgatatatctagaggtgttagaccctccttgttcagacaatcaacttttactactgggttcatcaatagacataaaacagcatgcagatccccatcttgtatagccaagtgtagggcggtgtttccatcgttgtcctgcaaattcataattttagctgccagccttcttctcctgcgaacaaacattatgattgtgtgtcttccgttctcaacagcaatatgcagaaatgttcttccctgggcattgcgcaaggtggcacaattggggctcttattgagcagtatgttgatcgtgccatcattaccctctgctgcagcgacatggatggggaaagaacccttgtcgtcaggctgatacgctgaggattcatcagcatccatcaacataccagtcagagtcaagctatctcccctggttttcctaggatagaggaaccggtccaaacaaagagtgtatatgtctatgtggcgcatgatggagaacaatatcttgtggtaatatggaatcttcgtgggtggttctatcgatacagcaaaatggagaggtgtccggccgtgtgagtcaccttttccagtaaggtccctgttccaattcaaaagcattccggtcgcatctgcatgcatttggaactttctttaatatctttttttaagagtgggcaaaagttgtgcctcctatattgatataataggagaaaattatacaaagatatgtatagggcttgtcaaaaccacatgcccagaaaaaaaaaaaagaccctaagtgatatcttcgaaaattccaaacacctgacactagtaaaataccatcataggtgccgcttgggaaccggctataggtgccagttttccaaccggcacctattggtcggcaccaataaaaacaaccgacccctataccaaaatagaaccggcacctataagtttgcacgagccaaaaaaaaaaagagccgactcgaatcgagccggaactcacaatcatcgtcactactccatccccaaacccccacaaatcacgaatcacaaatcacatatcacagatcacagatgaaacatattcagaaataaaatcatccacaaatcacaaaaaaatctaaaagaactataaaatcatccaacaaatccatcgggcgccgctggcgccaccgccttcgctggaccgccgcccgaccgtccccgacgtccaccacctcccctccgtccagatctagcggaggggagggcacggccgccgccagccgcctccgccgaggtccgccgccagccgctgtgccgcctccgccgaggtccgctgcctcctctccggccggatttggcggaggggagggcgcggccgccgcaaccgccttcaccggaccaccgcccggccgtccccaaggtccaccacctcccctccagctagatccggcggaggggagggcgcgccgttgccagccaccgccacgcctacctcgacgggccaccgccgggccgccgagagagagagagagagagggatagagggaggcgagagagagaggcgagagagcaagagcgagagagagacgtgagcgactcggtcggatggatggataaggcggatggataaggacgggcggatggatatggccggctcggctccatataggtgctatttttttatacaaaaccgacacctataatttatttaaggtgccagtttttaaaaaccggcacttataatttaggtgtcggttttgtataaaaaccggcacctatactataataccggtttttctttaaaaccgatacctataattgcttaaaggtgtcgattttatgtgtttttagcctacgggggagaggaaagcattataggtgctggttttaactattccggcacctacagtgccgatctctatgagcttatttctagtaatgtgaacttccttaatctcatacgagtaaatctcataaaattacatatgctttgatcaaatgatcataaatctataatttaaggaatgtataataaaactagaaatttacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30994 - DNA, 48584 bp, Oryza sativa
  unsure (1)..(48584): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttcaaaattaattgattgatcatgtttaaatggacctcatacaggcataatgtccattgaaaaaagagtgcaacgaggggggaagtaaatataataaataaaaaaagaacagccataaagctgtaaaacagtgattgtgatctactaccgatataaatatttacaaacgaaaagaagaaaattgtaaagttaatctgcaaatccctcccaagtgcacgatttcagcttttctgtggcttgagcacagatgcagaagcagaacaacaagcaatgctgtcaaggtaatcctgtgtcaaatagcagtgagccttatgattcaattccaggcttccagcatgggtttgctttcccattcaatcatatctgaaaggatttttattatcttctttagttccacgaggcaaatccacacccagctgcctcccgaagcccctgtcaaatctccgagggcttccccttctttggggttctggggatctgggagccgaaatacatggacgaagtttatctcctgtatgatttctgaactgctttgtggcaccattcctgtcatatggcttggcagaatgagtttcatatctatcagcatactccctttgatcatcaccattcccatcatgcctatttcccctccccctttcgaagccataaggaagtcttccctgtgttgggcgatacaactctccagaccttggccgtccatgggagtccacatcaaacctgtcatttcttgaggtaactctcaggggtgggctcctccttgaatatcgctttttatgatcaggaagatcaacagttgagcagttcctcccatcagcccatgtagaagcatgttgagagtaagcacgatctcttgatgaagggctataacgcataactcgatcaccaaatccaggttgtctagaaggcgaagtcattcttcccattctaacttcagtcatgtaattaggcggagatctacttctactatgcctccataaacttgaactaccattcaccataacttcccttctgttcctaggtgatgtccaagcatgcggagatcgagaccttgaaccagaaggggatcggctgtgagcacgtgataggttaagtgaggctctatgttgcgggaacctcctttgtctactggccagtgagcaacgagctgagctcatatttacattagcatgatctttatccatatcaggcccatatctaacagatcgattaccactagtactgaagcgtctttctggggatgcttccctagcatgtgcaggacctctagacaccccacaacctccatctctgtcaattggagaaccacgtccagataaagggcggtatgagctactcaaagtgttgtttctcaccctcctagccattttactagcatttgcagtatcaaccgcctttaccaaggtgccatcaggtgcaacaacaaagccattgctctgcatctttgcaacagcagcttctgcagcattccttggaccaggcagtccgtaattataataatcaggtgatttgcgccaggtagtgcgagaattgtttgaattttccacccactgttccacccggctgctaccttgaatatgtcgtgatgctccacctctttcatgtgatttacgaatatcaatggttctttcagcctttgaacctgagccataaccatcatcagatctggatgaaaaaagaaaaggggtcataagattagtaattggggacatgataatggatcatcagtgtcgaattaccagcaagatgacagctaaaaaagttcaccagtaacttacctgcataactcatttatgtgggctctgtcaaatgatcttggccgatcagctcgtggttgcatatctccacttgataactccatatggcgcaatgattcaccacctccagctgtatctgatgtgctcaaaacacaccggttagatgaatcaactgtgtcccttgaatcatgttgagaatgccgctgatcttcaggtaacatatcccatcctgtgggctttgttctcagacttgaaagatcgtcccctaaaccatcattgaccctttcagactggttgactgttgcggaagatccagctattacatggcctggattcatctcatacattcgagtctccccattaactctcaagtgaacactaagagccttttcaccagtgcttccagcacacatcgttccagatccatcatctatgcaggtagttgaccatgaacacttcaatgcggctggtgaaacatcaccacctccattcctggaatgttttccattgaaattagcaactcgatcacctgtattctttgacatggagccaagagggaagggagaaatgcctggggcatcactcttgcaatctaacacctggtaattggcaggtttaacttcttcataacaatcatctccccaatactcgccagattcccttagttccccatcctcatattgagaatcatcctcttcagcaacaatatttccagtcccagcaagatctttaataatatgaggtgcctccgtttcattacagtgctccataaaattattcgatagaaccttcccgaggtagctttgttctgcagattgtgaatcggcaatgctgtccatgtcagtagttgatggttttatgcattctgaattgatagggggagctacacaggcaccatctatacgacatattaatgcattgctactgtcagtacaggtgagattattactaatagttgcatcagcaccctcttcttcatgggcatgggacataccacgatcagaagaacctgggttgtcattcatatgagaatcggagaggtccaaatcatcatctacatctgcagctttcttggagatgctcaattcattggtgacatgttcaactttgtcgtgacctgactgtccaattttactagttccagaatcaacatccaaaagatcctggttcttcaattcagatatgctttgttgagatgtttgcccaagtttatcattgctccagccaagatcagtagaacttttattgaaaacagttactgttgcaaggtttgtgctttcctcagaaactaacctacttgtgaaaggcttcactctggatcccagttcactcatttgaactgaattgatcccatcacagccatctgtagaaaccatctgggacaaacctacacaatcaagggctgaggcatgtgaaacatcaagtttctcctcaattacggtcaaagcaaaacgttcagtcataggaggcaaagagctgcaatcaggatcagaccctagctgtgattttactttggagatatcattgttatcaggcaactcctttgttcctgcagataaaccatcgcattctagcggtctcgattctaatactggtacattttgcggagacaggctgcacaaaggttgagatgaaccgtcaccagcaaaatcactttcgctctttgtagaagcatcttttggtgcatcaatcacaggagttttgtcctctgaaagatcaggaatgttaccagcaattgttgagtcaaaaggagcttgacacacctgcagcttgttcaacacattttcagcatcactacaactgcttatagcaaaagcaacaggatcaggatcagccgcatcaggaacatcatcaccaccacagtcagtgtcccatgcctccattgcaacattaagatcccagtgcaatcttgagtcacgggtgccattggaatgcttagtttccacaactgcatcctgcaagccgcctacagatttgtctggattacttgcgttgattgacatggtaacacctgaagacttcgtgtcagaagcagttgaagaatcatctgctttgtttgcactgctcaatgcagaaaaagacgcggaacagtccttctgagtgtgtgtagattcaacaagattttcacagttcaatctagtggcaaccacaggcttcgtatcaggaacagattcagacgactccagcagcgggtctgatttgcaatttgaagcatccagactatttagcatgtcctccttgatgttatttaggaaattcaattcagaactaccagtgatattttctggtttcctttcaacacagtgggctgacttcgaacattcgacattcaacgtgtcatcatccaactcgctcgtgcaggcagcagccgcaagtattgatatgccagaaaaatcatctacgccaaaatgctcttttgtttcctccatgtaatcaagtctaggtgttttaaccttatgatgctttccatgtgacgagatacctccacaggatctgctcaacagtttttcatatggatccactagcaatggagtgggtggaggtgatggagaacaatccataagaaatcttctcttttttattggaacatttcccacaggatcactaaagcgccgaccaagaatagataccccaaactgcaaagatgtcattaaatagttcataaaattggcattcaagaattgaattgactcttacttcattgtactctaaaggagaaaaataagaaccttctcagactcagaaacaggagcatcatcttgtgccaattcttgattagtagcattgccacatgcatagaaagatctaatttcatcccttattctgtcttctccagagaaagaggtccttgctctccttgcagctctttgccttctgtttacggtcttccatctcacctcaggatctataggccttggaagctccaagcccatggtgttgagcttgctgctacacgacggcccagctctgtctgttgttgattcaccaccacagcctttgcaggtcattgaaacacctgagttattaagattacgaagtgatgatggccttccagtacaggtgcacaatcgaatctgccaagagaaccaaactagtcaaaagatccatatccagtacagtatcagtaaaaaaaagtttaggcggaacatcaacccatagcaaactgaacacaatgataggctttcaacttggttgggaatacaagcagagcatgaacaacataagcataccatgaaaccaggccttcttcctgttgctcccaaagaaacaagagactgtttcacatcaactgcaccctcaggtccaatagatcccttaaaatcctctggaaaacaaaaacaacataaggttccggttgagcaccacaccaccaaagcgtacgatactgcttgaagaataatagcatcacaatccacatagcatgttcgaaagcaataggaaaaaactaaacgacgcttctgcagccatgccgccaccgcgcgccaattatatcagaaaataacttgaacccctcctgtagcaaaatttttaggaaaaactttgaactcccccgctccaaggctacttgagcacatatgggagtggagcaccagaaataatggaaaaccagaaggcttttacttccaggactgaatcccctatggcatcaacacggaacaacagctcagtcaactgccctcttccatcagcatccgcaccaacgagaacatctccttcctagaaaatcgatccccatgaaaaagaagaaaagcaggcagatctggggagctggacgaattcctggcgagcaccgcacgaccacctccatcccagattccacaacacgcagagagagaaccagattggttgattgaccccgagaagtccaaatccttcagacaaggcagatctgacaaccgaacctgttcctccgtaccccaggcgccaacacggcgaaacacacggcgatctccccagcggcgactggcggcggaggccaagcagagactactaagtcagatttcttaagatctagggttgcgtataccttttgctcctccggccttcctcatcaaaccccaagggcaaaatctctccctcctctcttaccacctgcgcgcgcgccgccgccggggctcagctttttcagtagaaatcgcgccgccccatccgctcttccgcttgcccttctcctcctccccttcctcgacggggattccttgcgtgcgctgctctcctgcgcgaagaaggaattcttcccccccccccccccccccaacacggctgtggctgatgctgctcctgctgctgccttttcccttccccctcgccttttgactcccgccctcgccggggcgggacccgatcggtgggcggcgccgcctccccctgccttccgtccgtccggtcgccgcgagccgcgtcgccgctgccgccgccgccgatttttttttttttttttggttttggaccctttccttgtgctacttcgccgcctgcggaggctgggagggggagaagaccaagaccatatttttccgtgatttttagggtgcgctcgatttacttatatataataatactcctatatatatataagtattttttttctcttctctccatggtggtggtggtgggtgtggagctatatagggacgggaatcaaagcctttggtcgatttacgggattgcccctggtgtgcggtgtgttggggatgagagaggtggaggctggttttgcttttactcctagattgttttagctggggtggatctcggccgtcggatcgcatcgggattgaccataatcagcttcagcggtagtctctcctttccaaattaatcatcatatatgttttttttcgaggaatcattatatatgtttattatgcaccaacaccaagataatttaaataacatcaatcaagatatcatacacatattctcccacaatgaatatatcattctattacatgatgattaatttgggaaagagggagtagttttttaaaagaattaaaacaagggtacctttaatggaattgtaaagttttaggccacttctaaaaataagttgtgaatcggtacttatagtatgagaacatgtatgatgatattagacaatagtgtactctttttgttccataaaaacccggatatgacgcattctagtattacgaatttatagaatggagagagcaacagtgcatgattttctcgatatgggctttgtacttagaccatgataggccaatgaatgaagtttgtggcaaataattgggttggactcaggcttttgaatttatgaacccataaaactttgcctaacctaagagataacatatatgcctcattaataggtcaacatcgaagacccaatgatcttaacataggtggtgtttgaatcttctgaagatgaagataaaaattaagtgtttcatgtaaaacgaggtggtaataatgaattaatatgatattttagagcaactttcatatagaattgtttcgcacaaaacacaccgtttagcagtttgaatagtgtgccatgagtatccaaaatttaatccaacttttgttggagaaaagaagagggcctagtttcttcttaataaatctacttgttgcacggtgctacttgttgtgttctttcccattagttcccaactcatatccatcgttttccgcgtgcacgcttttcaaactgctaaacggtacgcattttacaaaaaggttatggatgtgtttagttccacgccataattggaagtttaaataaattagaacgatatgatggaaaagttggaagtttatgtgtgtaggaaagttcggtgtgacggaaaagttggaagtttgaagaaaaaaattagaatctaaacagggcctatataggaaagttgctttaaaaaatcatattaatttatttttcaagttttttatagctaatacttaattaatcatgtgttaatctatcgcaccgatttgcgtgcataggggaggggttcccaacccctccaaaagcactagcccatggcccactgctctcccaccacatcggccatgccccacgactctcccctgtgtggttctacccatcaactaataacccaacataagcctccgttggctgtagctttgtagcttcttgtacccctactattgggaggatgctacgcgtcggacgtccaatttttcgtaaatatcggacgcccaacccctgactgccgcacgcctacgcatgcatgcacaatctctaccgtttctactctagttgattagcacatgtaaaaagtctatatgcttgcgcatgcatgactgcatggttcagcacttatctcaaccccactttttatttctttaaattaaatttccttctaaattaattatccgatttatgattcgatttcaccattaaactccttgcaattaaatcttcacaacaagatctcgcacggttatattttgatgagaaaaatcgaactttgtttcaccacttataaaaaaaatgtttcaccactaggtcaaaatgttccaactcactctaaaaaatgtttcagagaaatgcaacattcaagtaatactaaatgcaacaccgataatatcggtatgaaacattgactctcaatgagtgagacataaaaatcttgctcaaatgtttcaactcagtctataaaaatatttcagagaaatgtaacattcaagaaatactaactgcaacaccgataatcacaattaaatctttacgacaagatctcacatgattatttttataatttaatcataaggtattaacaattgaaacatcatataatatttgctgaaacatgataccgtgtgcaatatttttaattaattaatgaatacttattgaaacactcaatcaacacatatgcaacatttataaataaactagtgaaacataataaactacttactgaaacatacaaatagcaccatgtgatgcattaaagaaagatatatacattgcgacaataattaaatatgtgcaacataatagaatttcagttgaaacatcttattctcacatgtgaaacattaaatttaattggttgagacatatgtgtgttttttattataatatagtcatgtgagatcttgctgtaaaaatttaattgtaacgaatacaatggtgtaaacatatcgtagattggatgagtaatctggaagaaaaatcattttcaagtttgctaaaagggtgttatgtacatgcaaataatcttgtatcctctctcctccatgcatgccaatgctaagtaagggagcatatgtaacaggtgtgaaaagaaagtatctgacaaaaagaatacgaggctgcatgcagcaaaaccacaatgagacgcgtccgatttttttcaggagattagacaaccgggtggaagcattttccctactattggccacatttgcccatggcttcaccattcaccaactttgcatgtggttgtgtcctaattttttatacttgcaatttgatctctgggatttataaaactaagttatgccaagtttttagtgtagacttcaagcttttggtccattgtgcaagccaggttcacatatagaaaatgcaaccaaaaaaaagcatggctaaagccggtctcaatttggttcaaagatcccattttcttatagaacttgcttggaatttgaacatgtcaacctagcacctaacaataagataggtgaatgtatgatttaaggaggtttgaggatttgagggtgtgaaagtctcatgtattactaacagctatatgttttaaccaagaaactatgacaagtatctatcttgaaaacaagaagagctggatatgttttgatcatctagcttttccttgtatcatagcaaccatgaagagaatgtgtagaagtagaagtgatctatactttttgatttcaaaccatgtcatgtcagtgtattggtaaataacataatttaacaatgagcatggttatttaatcctgtagtagcttgttgccaatttcactagttcaaatttgttgtctcgtaaaatctttgacgatatcaaattagttccacaacttcgttcaaaaatctgttccaaaaccaacgctgactttattggctagccatggatgacaggccaactgtttcgcttatttatatactccctccatttcaaaatatttgacaccgttgactttttagcacatatttgaccgttcgtcttattcaaaaatatttgtgaaatatgtaaaactatatgtgtacatgaaagtatatttaacaatgaatcaaatgatataaaaagaataaataattacttaaattttttgaataagacaaatggtcaaacacgtactaaaaagtcaacggtgtcaaacattttgaaacggagggagtacttatttgaatcgctaattagtaaataaaaatatttataagtaaaacttttatatgcgtattcttagtgactcaagaacaagaacaaatgttataaaataaactatgataaaaaatcaaattataaaatttaaaatttcactatataagcctaatcaccatgagcgaaacaagtttgcggaccaagtggaccgtcgaatgaattttaccgaccaaaatgtacccttaagtacggatgtaactgggtcgatctacgaacccacttgtaaacaaaacttagtgggtaacctattaatttggtatatattacctccttttttaatatatgatgccattgactttttgtcacatgtttgaccatctatcttatttaaaaaaattacataattataatttattttgttgtgagttgtttatcactcaaagtattttaagcatgatttatatcttatacatttgcataaaatttttgaataaaacgaatggtcaaatgtttgtttaaaagtcaactacgtcatctattaaaaaacgaaacgaagggagcaagtggattcacgggttgacccacttatatccttaagtacgacaaaccgggccataacgcgggaaccaacgagttacctacttatttaacctgtaagaacaagttttgtaatagaggtgattgtcacataaaatattatccatatcatcgactaatttatagtgggcatctcatacaccacattacctctaatgtactaaccctaatgcaacataactatttattttatccactctcatgcaatcaacctcattcttttctctttcttccttaaagtttgtgatgagattacccttgcatgatggtggctcatcctgttagtgatatgccctaaaggcaatcatagagatgattgtatcacatactatgtttacatattgatccgactttgttccttgaaatggacaactcattattggttaatgaatatgtgattctttcatgagactctttatgttgtttgttactatttctaaaggatccctgatcaaatatcatatatggaacaaatatgtttaaatgatcaacacatgtattaattgatgatcatgtctcatggatcatggtatatgtcagggttatggatattacatacccaatagtaatcgactaagctcggcagggcccaccacataccatgtcttatacggaaacaaacctcgtatatagagggagttccggataaggaaggacaagaagagttatatatggaaatgataaggactactcggattgtatccatatttatctccctagtcttacttggacaagggggcaactatgagtataaatacaagctcccctaggaggagaggggacacacccaccacaatatacaaagccataagccaatacaagccaatacgccgccgtatattgacatcagagattagcctaggcatacaccatccggcacctataggggccggcaagagggatctagcaccatctctgatctcgccgagtacggattcaaggaggaagactaccttgtcgtcgactatgagttaattatttagtcgtcaagtcgacgacggatagatagattatcccagatattatatttgtgtgatccagatgaataaagagcaacaccggcttcggccaacaggatgtagggctattacctgtaagataaggggcccaaacctgtataaaaatccatgtctccatcttttttatctcaatctcgcatataccctggtaccaatgatccccataccatccaaatatcgtagtcgtgatatcaaacgtcgacagtatagagataccaaattaataatgtggacacatgttggggaacatgttattggatagacccaacatgagacacttcaaaagctatatgtgttgtgtcatcagtgatctcatttagtgctggtgttgaatccttagacctaagattatcatgattcccaacatgtgtagtagcttacctagggactgctaaatgctactccgtaattgggtagttataaaagtagttttcgggtatgttgtgaaacatgtagtgggatatgaataatcaagatgggatgtggtgggccccttgatgttgtagattatggaagtgcatggccatgccaaaggtgattgaggagtcaatcacaagttatataatctatacaggttcgagtgaacgattgagctattagaggatggcacatatctaaccttgagcttaatcgatatcgtgaggcaaaggggttcatacaagtatacactagaggttcagccgatatgatctttatgtatgctcggtgggtcaatacgttctgctaggggccgttgttgacacgtggaccgaaaatgagttttcgggttacagccgagtgtacatgaacctccaggatcgtacgcttaatgggccggaataaggggattggatggagatccaatatgagcttaattcggatagggatccgaataggagtcctatgggccttggaggctcgagtcatagatcctatatattcgtgagaggtgtgattggcggaggtattgcatcacgagcaaaaccctagccgtcactcccctccccgagcaaaaccctagtcacgcacgggtgctagcacatctacgcgtggcgttccgtccctgtacgtgtggataccggtagaggcgccactactttgcggtgctgatcggcgtgggaatacggcgaggggaacgcacgaggaggagaaggtcgagccggtgcgatcgactacttcctctacatcgacgtgcgctacttcgcgggagtttcttcgacttcttagcgcattcttccgctgcgcagcgcgtcgagtggtaacgatctatgatctaatacttgcatggttcctggtttacatgatagaaaattttgatttatgctatcgtagcctacgcgtattccatcacatcccctatcctctattctttcctccaccttatcatttaagcttaagggcccctttgaatcgtaggaatgaaaaaaatgaaggaataggaaaaacacaggatcctaacatgaatgaaagtataaaatagaggattgcaaaacacaggaaaaacatagaaattaccgtttgctcggaccgtaggaaaaaacacaagaatcatatgagggagatatgccccgtttggcacagctctagctcccaactcaacttacctggagccggagttgtgccaaacggtccagatcctctgtttttttggagtggagctagtagaggtactcctaaaaactgaactacgggggtggagctgggtttttctgctccacagctccactccacccccacaaaccactaccctttaattttgtagtctatttacacaaaaataccactcaactacccttcagtcatcctctcatcctgttctctctcctccccatctcctcccgatcccaaccgagctgcgggggcggcggcaggggcagcggcgtcggtggcgtgaggcggcgaaagcggcgggcggtgacgacgggcaggcggcgcgcggccgacgaagcacctagggacggcgaacgttcggtgggctggcggcgcgcggccggcagccgacgacgcgcctgggccgatggctattttttttcttttttttccagatctggagctgaaacgtatccaaacacttttcaacgagtcttcaactccaataggagctagctctcactggagttggagtttggagcccttcaaaaaggaaattttctaagagctttgagctctggctaagttttctccaagatctctataggattccattccataggaatttcaaaggattttatatgatccaatcatttgattcaaagacattcataagaatttttcatatatagtattgtaattcaaaattctctaaaaaaattgtttttcctcgaaatcaagatcctaccaagatgcttgtgcttagatactctctccgtcctagaatataaacatttttagagttggacacggttattaagaaaataggtagaagcgaatggtagagggttgtgattgattaagtagtggaggtaggtgagaaaagtgaatgatagagagttgtgattggttgaaaagagaatgttagtgaataaattgttatattttaggataaatcttatgtgataaaaagttgttatattttgggacgaatggagtatttatcgaccaacttgcattcttgcccaaagccctctctccctgtgtttccttcacatccactctcccatccaaattcccaagcccatctctctctctctctctctctctctctctctctccactccagtcgaggcacggccggctccccccgcgtcgccggcgagcagggcacgggcgtgtcgcgctcgcggacggcctcccctcccctcccctcgtcctagccttctcctccgtgcggcgcacggccggcgaggccacccagggttggtgacccaaggggggcgagagcgcggagacgcggcccccccatccatctccgtctcccccgtccggatcgaatccgaggtatccgctcttctttctctcttgtagcgctcgctcgtcgtcctccgcgcatgccatccccatgagtgagccggcgtgcgcgtgggttggagatccatcagtaattagaatatctagattggtttgtatcatccccaattaacctgtccacgcagcgaaccgtcttccggagaattggtgagcggagtggtgctgctgatatcaaatcatatagttgcgtgtaatttttgtatgtgttgctgcaggattgatgtagaggtgtggaatcaccgtaccatgttggcacatagtatttgtcgatatggccgtatggggtttatttagcgtgaaaccgattggcattacttggatcatgtcaacatagtgtttttttgttcagatatagccttttactgatcggtctgtgattgtgtgcctacctttgaagttacttccttcatttttttttctgctttcatatgctgatgcagcttctcactaaagcaacttctgcaaatattttctgttggatgtaaatgcacacttttttcgtcgaaataaatcttccataaaagaggagcacggtattaggtgtacccctgacactcactacaacttaagtgtgcttctgagattcttccttttctcgcaatttcataatatacataccaactactattgtgctacaaagatctattgtaactctagcattacacggtgggacttgctacctttttctttaacataaacggtatacatcgttggacaattccactaataagggattttctcttcaccttgcataatgtttttggttgtattgacaagcactgttttaatcctaaaactctctctctctctctctctctctctctctctctctggggtcttatatgtcctgctgttttgttgcctgctatagcattaggcatcaagttccttccagttactatgtgctggtccttttgttaggtttgtaaaatcatagttagttaactagccagatggacatattgcacattatctctctttttccccactttctgatatattacagctggtatatgctcatccatgccacacgttattgtataagtaaaacacactgtggtgaacaaaaatgccattctataacgcgcagctgtgaacattttttattggtgattttttttttggaaaatttatacagaaccagagcaagcagaaatatgccatgtttttccttctttattctactgaagaacaggacaaaattgtgtatatatgttctggtcacacaaaattatattgaaatcctttgaacacattggttgcttttcatttgtcaagtctaaggatgatcaagctggtcttttgtttcacaaagtcacttgtatgcttcttccatgagaagtcctttttattagttttatcagttatcacatcacgataaactcataggcagtgaagtcatgtttgtgtggttttgactggccccagatgacacaccctttttgtcatcttggatcgcacgtttgttattgtggacttgtggtattgtctgtgcgtgctacccattattccctttggctctttattttctaaaccaccccaagtttgtgctagcaggctagcattgacttacatatcttttctagcattattattaatataaccatggtgaacaaggtttctgaaaagtttaaatgcaaacatgatgataaaatgccttgttaataaattcagtctaatctaatggctaaagaaattaccttcactgaagatattaagcatgtgaatgtgtgtacatgttctgcagagtgaacacatgaacctatggaaaccaatgacattgccaacaaacaaactttatgaagttccctattgtagtactacctccgtcccaaaatataagcatttttagctatgaatctggacaactgtgtgtccagattcatagccaaaagttgctatatgttgggacggaggtagtatatattatgagaaagtgactatggtacatatgatgtaaaatactacctctgttttttaatatatgacgccgttgacattttgagatacgttttttgtaattatcatttattttttatgacttaatttattattaaaggttatttaagcatgacttatatttttatatgttggcacaaaagttttgaataagacgaatgatcaaacatatgtttaaaagtgaacggcatcatacattaaaaagcggagggtgtatgtgctacatgacctttttcctccatacggtaattatttcttagaagtggaagtggttaggagtggaaaatatcaagtgagagaactttcttttagctgaaaaatgtgtgtaagagccttgtttgcttttctgtgagattttccttaattcacactacgttcctttttttttttgtcaccgtgtatgaatttcaaaagaggggtcctattcatgttctaatgtgtgacattcttgagtaggtctataaatggcaggaagacaccgcatacctcgtgaatactatgatgaacgtcgaggatttcgtgatggccccccacctccacttgctcgagcaaggcccatctctccacgtcgcttggaggaggagctgtctagccgccgtgctgagatgcgcagaatccatgatgacaatcagcgcctagctgatgaaattgttggtctcaggcaggcaatgcctcgtctgaaggaagatctccatgccgcaagtcaagctatacccaagcttcgtgcagaaaaagaacttgagtcaagggagctgactcagaggaatctgaagttggaagctgaactacgttccttagaacccctcaggcaagatgccttacagctacggtccgaggccgggaaactacagtcaataaggcaagagatgactgcaaaggtgcaggggttgttaaaagagcttgagcatcagaattctgagaaccagaaaatacctgtcatgatagctgaacgtgatgctcttcggcaggaactagtccgaatgaggtactgaactattctgcatcatatttcgtgtaaaatgattgcttcttattgcttttcttgatggatcaagtgttagttctaagttgctgcttgaaggagcgcatttaggatcctttcctacagtttcaattctaaagaaaaaaagtggggtacttgagtatcatcttcctcttttcaccaggtggaagatcaaactgattaatatcactgtaggggaacccttgagtacgagaagaaggcaaggcctgatctgacagcacaggtgcaggcaatggagaaggatcttgtttctatggctcaggaatctgagaagctgagggctgagattaagaagagaaatgcacccagtaggtttcttttcttttgctagcttgaaagttatggaaatcaatggcgctgacccacaacaacatactatgtttgattttaggtttcagcggccatggagcttatggaccaccaatggcgactccagggatgggcctgcaaggcgtctatgatgatggctatccttccataggcagccgctatggcactggatcttgggcaccacatgatccccatggttatccacaactgtgactgggcttctgatcgttcttccctgggcagtgctttatcttcgtaatatcgcttgatggttgatactgatcgtgacaaagcttttctcttagtagaacttgtggtgcacagtagatggtcttttgggggtgcacttcaagtgttgttagtttagcatatgtagcaatataccagctatggttgccttggtacctctccaaaaaatgtaatcaatgatgactgtaagagggaattcagtgcaacgaagaagaaaaataggaacttaagctttacaagatgcaagtttgcgtatgaatataacaaggtggaatcagtcagggctggatgttgctcagaagtttgtccctaccaaattgcaatagcaaaaattacttattcatgagcgatatctgcaatgcgcagcatcatgagctgtgtttcctgagcagatgcatattatttgctccaggataattaatttaattttgtaaatgagtatctattcgcaacaagcagtgcaaatttaaatgattctgctattacttgtgtgaagtttatacagtagtcgtacctgaagtttctgtgatgttggtgtgggtgcctaacccgacgaggcgcaaatggcttctctatgcaacgattagtaattctgagcgatatgattctttttcccccaatctccattttttggagtcgaatccaaggtgtgaccttgagagagacatttgtccgtgaaaagcacgagacaagtggcttgaagaagattgaaggcatcctaaaagcaccagacaaaatggaagatcgaagagagacggcagtcaagatcacttgcttgcagttgcagacaacattccatcaattatctttcttttttatcagtttattagatattgcaaacaagtctatcaagcacaggtcagcaaattatcgaatcccttcaactttggagtaaccgagcaaatactgataccaagacaaggatccagctatttggtgggggtgggggtggggggttgtttttttttttgtttgaactatccggctagggttagattcgaaaatgaattcggactttttcccttcggtcacagaaacttatacaaaagtgctaatatacagtgtttacaaattcgggcctaactcctaacctattaggatagttttggaaacaaagacctaaaagcatctccaacaacctcttcaaatttgaccttagatatccattttgtcagcttgttaaaaatttagatagccatttaatctttcactcatcggcctttctatttaccctatccaatatgatagtaggcctcacatgtcgatctatatatacctcttcctccctctattgtttcctcttcccatcgttttcgtccattcccctacccctacctctcgttgcctcagcccaagtcgccagtgcaacccatccttgctgcctccacccaagctgatttagcaagtgatttggcttggctaatggcaaatctgttggatactggtttttctccaagtttactaaaatttgacttggcaagctagataagtagtttgttggagatgctctaactcattactttaatttttaggcccatctctagctctacttgttcatagtattttttttatacaaagcatggcatctagctataaatgtatgccttatgcacttgttttttttttctcattcctttttacaatctaattataaaatattaaattgaggtttaagatggacaccatcagggttcacgattccaaagaaaaccggttgaattccgtggaaaaccgaggtttcgacatggctcggaagtagaggaaatctggaatttcgatgggttttatcaaaattcaaatttgaattgataaaaaagaaaaaaaacaaataaaatcctataaacagtatgatattcatatagtctatttgagtataaattttccagaaatttggtgtattccatgtatttcttgaactttatagtaggaaagaaaagaataacgatttaaagaaaaggaaaacactttcctcagccgaattccaaggagtaggcccacttagtacttagcccagttaatagaatagaaaggtgatgtggtcccgcacctgatttcgctcagaatttcgccaaagtcaaccggttttcgcgagcatattggtaaactcagtgaatttgtagttaaattttggtttatgaaatttgttcaaaatctacctgttttccaccggatttcatgaaaattgtcataccgccagagcctggaacggaaagtcatctcagaattgtaaaccttggacaccattagtttgtacgtgtttatacgatatcgttatacacatatacagttgctatttttttttaaaaaaaagtagtctactcttttatatagaataacaattgatattttcaggcaatttttcataagtccgtcagacaagtattttaaccgtattcgtttcatgtctatattcgataatatttatcttcgtattgaggatattcatcatttatatgtttccaaatccaaatccaaaacgaaaacgagaaacaaatacggtacgcgtagtcgagttttgtttgtgatgagtttgagttgtgactgggcttctctcccgttaacagtgagagagacctttttggtacacaaaaaatcctcatcatcagagggaccctgcccgaaaaaggtctctccctctttttacacacatatattacgcgacactacccctctcctctttcgtttctttccccttctccgctcttcctccccctagagagctcgncgccggccgtcgacgccggccctataaaggtctccatcaaaacgctcaagggctccagcttcgagatcgacgtcgagcccaccagcaaggtacgccgcggcggcctcccccctcccctcttttgatctgtgatgtgatgccctgtgtgtgtgaatctacccggtcgccgcggcgccgcggggtttcaagatggtgggggtgtttgaatggatcgggttggttaagcgccacgggggttagcaccagcgtggatccagtggggggcggggatggggctctagggttgcgggatttgggggtgagggggattggggagtggtaatgaagggcggattcatcgtctaggggcgtggcttttgtgctggttaggtaggtggggctctgttcgtcgccgctgcgagttgggggagctgctattgagtattgagtgttctggtgtagtatatgatggttggaagcaatattaggttttgttatggctttgtatgtatgcgtgtatctgcttgatgatgtattgattagcgtagtccgcgattcagtaccgtgtctttatcttccatcgcttttattgatattattgcatactggagcttggttgctatgtgttcagcttgttgtgagcggatcgcgggattacggatatatctttatataggtgtgtgtgcacgagtaagctgtatttaatgaccgttggaacaggcaggccatgaatttgtacttatacgcgctggtatcgttgtgttattatggctcgtgtgatgaggactgtttcttccagtaatgttatatatatgactagaccatggaacgataactgtagcgtcattatgcaatatttgtttgaatctaagatttggactagggatagccactctagcaaagctcttaaacctttgatcatagcgcttaggctcttcagcacataacttaatacggtatgttttctcattcgttttctatattgttttgatgatcaaagggaggacaatttctgtttatgcatatagttccaactagtttggaatatatattaacgtgtgataaatgctgcttagttattccacatgagtatgtacacatagtaactattgtaaaaattgcccatcagttaccattaactatggtcaggtggttttactggagtgatgttaacggttagtcggttacgttacaatccatgattggaatcttaatatgtagtactcattactgcactttttcatgactcgcctccccagatacatcaaagcaatgttttcttgccacgtgaacaccatattaaattgattaatacaaatacattctgtttgactatgattgttttatgcaggtcagtgatgttaaaaagctcatcgaggttacgcaaggagataatgtctaccccgctgatcagcaaatgctgatccatcaagggaatgtccttaaaaacgacacaacacttgaagagaacaaagttgttgagaacaacttcattgtgataatgttatctaaggtgcgttaaatttttatcattattatagtagagagcttaatgctatctaaggtgcctcagtatgcaacatatttgtgaaatagcacaaatatgggtcatgcctcgttatgaacgtatgatgcaaatattttcctttcaggattttgtgatttatctatgctataatttttattaaatagaacttggacaattctatttgcagaagggatcatcaagtgctgcttcaagtacagctaaggagcccacaaaacaggtgcggtagaatagccatgtttcattatatcattgaatctgtttctcagtattatttttcccatttttttaattagtgttctatgtggtttcttagaatatcactgatcaataaagtaaatgtgctaagtcttattcaactgatctggaaattttattgactcactcaagaggaaatctgctctgtcctatatatttaaggagaactaccattgacaattcaagatttctacttaatgtatacctgatatgagattgtactatttcttttatacgcttttcctgtaaggtttttggtttaataatatcatctcctggatacatgatgcccatccaagtatatgatttaaggagaactaccattgacaattcaagatttctacatgttgtatacctgatatgagattgtactatttcttttatatgcttatggttgttggcttgtagaattgttattctctttttgtaatttgacactgaactcaaaatttcgcttgttgtacaatcaaattaatatgtatgtcttgcagccctcagttgaccgggcgatacccactgcgcctgcaacccaaccacctgctccaccagcacctgtgtaagtatccacccatattggcctgactgaaatcattgagcacttatgtgctcaaggatccatttttctcagtccttaaattgtctttctttaacaataactgtagttagtaactaatgttctcttggccattatatccatcatggtgatatttaggtccacatcttaatttgcaaattgagttcttttgttgccacctaattgcaacgttttgcttttcccagtagcgagccctgtgactgcaccagttccaactgcaacaactgcttcagctccagcagctgctgtcaccgctgcatcgtgagttgttacatgtttcctttgaatttaagaatctgatcaatcaccctcttttgcttttgttcctttgtttggcattgttttatttggcaagatatgaaaggccactttgacaatactatctgataatttgattttaccagcaccgaagcagataattatggtcaagctgcgtcgaaccttgttgctggaagcaatttagaagggactgttcagtcaattcttgaaatgggtggaggagcttgggaccgtgacactgttatgcgtgctctgcgagctgcatacaacaatccagaacgggctgtggagtatttgtacaccgtaagaatcatttctgcttacctcccatgttttccgtgtcttgttgcttggacttcctgacgtgctattatgtcgtcaaaacttttaaaacaaatagggagtctcaaaatattaaactaatagaaagatgttgttaatctgtgttatttaagtttttgcaatgccttgttgaaaataataaataaacagatcaaaaaacaattttaacgacataggcactttcttgtcatgcatgctttggtatgtgcccttgggcaacaggaaaccacttatttcaaacaatggttgcacccttttctctcctttgaacttatttctgccacttctgctgcttttcgggcacaattttatcatgtgactaatctattgcactttgtgtatttgatatagggggttcctgagcaagctgaggcccctgctgcagttcaagcacttcctgtccctgctgcagttcaagcacttcctgtccctgctgcagttcaaccagttgacccaagccaggctccccaatcagctcaactttcaattccatcatctggacccaatgccaatccattggacctgtttcctcaggttctgcctccacaactcacacaaccacatacacacgcacacaaaaagtactagttctgaattctttcaatttttttttcaggtccttccaaatgcttctgcaaatgctggtggtggaaatcttgatgttctgcgaaacaattcacagttccgtggcttgctttctttggtgcaggctaaccctcaaattctgcaggttactttttcatctttttcttctagttgttgtactctatacgacatatgcactgatgtacaaattctggcatgcagcctttgcttcaagagttggggaaacaaaatccacagattttgcaactgattcaggaaaaccaggctgagttcctgcgcttaatcaacgaacctgcagagggagctgaagggtatgcattgcaagtttgccactagtgatgtcagtatttgtatatttcaacattcgtttttgtgcttgacgcttgataccgtaaaccaggaacttgctagaccagtttgctgcgggaatgcctcaaacagtggctgtcacacctgaggagaacgaagccatacaacgtgtaagcactatatgtgttcttctgcagtaccacaaaaccgagccacttgtttcatgccatcttgttgcttttatccacgttttttgcacctgcaagttgtaacatcacgtcactttgttcttttgtgcagctggaacaaatggggtttgatcgcgatctggtcctggaggtattcttcgcgtgcaacaaggatgagctgttggccgcaaactatctcttggaccacatgaacgagttcgacgacgacgcccctgaaccaccgcaataagatgactgacccgtttttaatgatacatgccagtcacacaagagacattgggttgcaaacagtggtcaccaagactggtgattatccccgttttagaacatccaaatccacccatccatccaggcgtgagaaaaatgtttttgagcttctctcatcatcattcttttttctgctttgggatttttatgatgattagtacatactctagatgacatttacagactacatataaccaaatgtttcaagtcttcagtgtcggttaactgcattgagggagaatgagttgaagttagagaaatccatgtgttcaacttcttatgctcttgtttttttggaggtcgttgtgcacgctcaaaacgtgcttttgacggtatgatgcataccttgacagcacgtgatatgggccgagccctttaccgacccacataatatggcccgcacggatgccacaatccatatagtatgggccgatcttctgttgcatctaatgggccgggtcgcaggttcccaaggggtcggacgcaggggggtttgcttcatctgatgttctgacgcagccacgcagggtggttcgcttttcggatttggagatttcaaattcatacaaattttgctgttacatggagacacgccgttctaacttccaacctgtttaaccgccaccaagctcatgcaatccggcaaaactgtatacaacgatttcacgttcatacacaactgatctcaaaattgtctgatcagacacaaggaaattcgaattttagcaattaattttgaggctgttcaaattgatgtcattttcaaccatactgtttttttttgagaaagttgtcaaaaaaaatgtctacatttagtttattgtcaaatttagtaaatacataataaatcctgccaaaattttggcaatattaccaacttgccaaaatttggtaaggtttattttggttataatctgaacatgcccttttaagtcaaatttaggggtttcttcattgtagactatttttttcaccatggatttttaatggactgctaatagcacatgtatagaagttttacacattatttttggttgcttcattcattttctacatctgtcattcaaacgatcagccgtagaataaaaaaaaggcatgaatttttatatcaaatcaataagttagcagtactattatcatttaaatgcactagcaaacatgactaattaattgagcgtaaactgtttccaatctatgcacaccacgatgaattgattgaattcacatgatactatatcacatggtaacgccggcttcatcgccactcccatcgtcgaacaaggtcctcttccctgcaagatggccaaatcatcatcatcatctactaaccaaagccagaaatgttataacattaaccaagattgactgcacagcaagtcatcacatcagctacaaattaaggcaagagcagcacctatgatgatggttaaacaattaaagatcagcaacctctgcatattacctgtgctaggcgtgtgccacttaggagtgtcgtcctgatctggcactgccaatcctgcgtcgtccttgtcacaaccagctctccctattcttcgtttcttgcaccatgaaaaatcaggccattttgtgacgcgcagaatgcggcctccaatctcggacacgccgtcacagtggagcgcaccattgtagctgctcgcaacatcgtatcttatgtatgctttcctgtgaaatttggaagagcagaggtaaaatggtaatggaagtcaaaaggatagttgaaacaggtagaaaagatatgcatgcaggaacaggtttttctgacttaccctgtgcttgtgccatctagattcacgggagttacaagttttttcatatgatcgttcgcgaaaatttcttcaagtgcgtgcctaatctgaaatgggcaaattgtcgaggggaattccctagggcccatcactccaaaaggcaagccaacgcaagaaggttaaaaggaaagtattcatccgtttcatattataagattttctagcattgttcacattcatatatatgtctagattcattaatatctatataaatgtgggcaatgttagaaagttttataatatgaaacggagggagtagttagcaacagtatagttaccgttccaatctcgagggatgaatcaaagccggtcacacatacagtctgcattaaataattaggcattctctccccacgagtaggtatatctctgaacaattcggaagaatttgtgcaatgttaatgaggcaaaaacaatagcatagcgataaagctgatgaagtcacagttaacagacatatacctgagaacagcaaagtccttgggatcgaaccatgcaagttttaaagggcgtcccatcagatgatatcccataaaatggtagagtgcctgaaaatcaatataaacagtgttgtcatcctcaaacattgcaacatgaatcatgagaaaataaaaactgtgcagtgctacaccaggtatacaacacaaacaacagagataaggctttacactctcagcagcttgttctgtagaaaaatcaacaactgcgagatgcctcgtgctactgaaataaataccaacaatctcaccaatctcctgaaaaatgttcttcctataaaccaacagttggaaatttacaatcaatggtttaattttcagaaagaaaagcagttataatttcaaaagccttacacttgattatattcaacataattggccatgccccagctagcaatcatggtctgctgtggtactttctcttggactttgtcttttgcgggtgctttcggctgtacagaacatcagaccaggattacatgaagtaacaaggattgatttctagaaagaacatttagatttcgtggaggagtctggagtttaagaacatgaattaaaaacatgataatgtccatcaaggaaaaaaacattgagtacttaacttgtattggtttttccccaaaaattttgcaattccatgaaagaacaacttttatggtagttctgactgaacacaagcacattggcagatagcgccaatagcaacatagaaggattagtccttaggaaattttaactggcatcgtaagaccaggtcaataataggaactcaattacatactagtatctactatataaatgggcaccaaaagaaaaaaaaaatccatatatgcggtattaataaaccattagttagtgaaagataaacaattggccatcagcccaacatataccatgatccatgtcattatggccattttctttgaaagattaatcagattgaattggaggtaacagtgattaggtctgattagaactataatgggtgtatatccatcagttgcagatcagctcctctgttgagaaagtagacatggatatgaacaagcctgcctgcctgcctcaatcatcacaaagatacaagtccctagtaaaacgagagccgttcacctatcctcttctccaacgtatgcaacgcaggcgaaaaattaatcacgggaaatcgttgcagagcagacatgggatgagatgaggggaatagatggcattccgatattatatttggataaaatttcaccttcttggggtggcgataagggcaaccgaagatgatgtagcggcggaagtctctcgggggagggcgatgccggagcgggaggcgggggctgctggcctctcctgcgctgcagctgtaacccgcccaatggtggcctgaggactcgctccccgctcgagtcgtcttctcccccgtcgccattgttgacgatcccgattcttgtttatgcgctgagcccttgggaggattagacattagggcttgttcgtttaatcctcgcaaggaaaaaattggaggggattgataagaaaaaaataattttcatatcataatagatataaaataaattctctataaatctccctcaatcatcttgtgagagggattaactgaaaccgtatggtgagacgcctgttagcatatttcaacatgtacgaatactagtcaatagtttcaatctatattttttttttcttttctcattcgcagtgtacgctgcacatgtcatgtctattcatacatgtccacatgtaatttttttttactcatctgcacccttttctccgcctttaaatatttttttctcctaaaataattatctaatctacaatatgattacatcattgtattccttacaattaaatctttacaataagatatcacacgattatattttgataaaaaatcaaacgatgtttcactcattacaaaaatttgtttcaattcactctataaaatgtttcagagaaatacaacatttaaaaatatgggctgcaacactagcaaccacttatatgaaacactgagtcctaaatgagtgaaaaaaaatcatataagagatacaatatatttataaaaacctgatattgttgaaatatttttatatcgcatatgaacactaaactataattattgaaacattataaaatacttgctaaaacattccaagaacaccacgtgcaatatttgcaaattaaatagtaaaacatcatatgaatactagccgaaacatttaaatataataggtgcaacatttgcaaattaaaatagtaaaacatcatatgaatactagctgaaacatttaaatgtaataggtgcaacatttaaaaaattcatgaataaagctaaatatttttttcatcggattatagccatgtttggtcatgttttaaagatttaattgtaacgaatttagtggtgcaatcgaatcatgaattggagaagtaatttaagagaaaaaatagtttaaagtttgctcaaagaaacttaaaccaacctaacttttgttttctagtatggatgcatggcttctgatgtttgcagtgggcttcacctggtcctggtgtgtcttcatgcgttggcggaggctgaggtgggcatccgatttttaactaaaaaatcgaacgtccgatccgtagtcatcccctaattgtcatgcattagaccttgcaaggctcatttggattgaacgatttccccagggagaattgaaggaattcaattcggaatattttctatctggctcatttggtttgaaggaagcttcaaaggatattcgtaggataagaaaaattcatccacattttagagaaattctagcgtagcatgagagggttataagttataacctcacgttttccagtttctttgatctctctctttctctctctaaccaacatataatctcaaatttcatctctctctattaaaccaatatataatctcgaatttcctatgatgcattccaacgtatgatgcacattagaccatgtcttttttatccatattgtactttggactagggttaaactactttattgtgggaataagatgatggggttgtttatattgtagcaaaaaatataccttaccaaattttagcaatgccaaaattttgttaagttggcaatattaccataattttgacgagatttcatatgtattcaccaaagtttcgttaaaaactaaatgtagacatatctttggcaattttcaaaaaaaatgaaaatgacatcaatctaaacaggctcgatatcatccttcccaggaccaaggctccaactcctttgctgccctgagcttgagcatcacgctcatgcttgtcccttgctgcctttggtactatgcccaagctgagctcaacctctatacctcatccatccaccttcggatccacctcttctcccaaatttagtactccctctatcccactatagtggccatcccatgaatgctgacacaaattagctttgggagaaaattacccaaacacccccaaatcattagctgcaggtagtcatttcaagatgcagggaattgtcacacaagcaccaaccacgtccacagaagggataatttaaacatatacaattactccgtaatggtggcatgcacataatttgaatgctcatgcggtaaaattacaaggggcaagtaacctagctagacccactaattcaaaatactccattgatggtgttttgctgccaaggtgtaccctttcatgtcctataaattctgaaggaaccaagcagacaacctttttccattgcattcatcaaactgtgtggtaaaccaactcaatgtccagacatcacaatcgctatagatctagacatttggaaggcctttgcctgaccttagggctgtcaacgagccaagctcgagctcgagctcgagccaagcctataaaatgttcgaacttttagacaggcttggttcgagctcgatcaagctcaagctcgactaccgagcttgatttttaagtacaataatgcatatttcaaggataatattttaaaaaataattattttctagttcatcatattaatagaagaagaaaaaagaataaaataagtatatgacaccaatacaaggcatacaagtaacatatttgatatcctaatttattacataaaaaaatcatatattactagactcgttggaagctcgagctcggcttgacaaagcccacaagctttgggagaggctcgggcttggctcgtttggagcccgagacgagctcgaatcgagcctaggatgagtcgagctctagcagcttgcgagcctcgagcttttttgacagccctacctaacctcaatgaagcaaaagacaatatagaagaaggaagggttgtttcccgggcagcttaccttgctagagttgcttggcatggaaatgaacatgttgtactcccttttgatctgaacttgcaaacttttgatctcaacatggaagctgcatggaagctgcagaagaaggaatggatctaggttatttttacgtcatctattttttctcaatgcatcacatggatctttatcagtgcattaaatgttgtttgcaatacttgatgatgattgcattattcaatctagtttagaaaaaaatatatggtattctatgacatgtgcagcacactctactccctctgcccctcatgatcagcacacacacatgatgttaacaaaacaaaagattggtactacgataatttgacagtttagctcatctacttccattttctcctaaataatgttaaatatttaagatttttgattcatcaacacaaccacatcgacaaagcaagatttgtgcataatttgattagcaattcagcctacaaattttcaagttatcataaaagagagaagtacaaggtaattcaatgatcactttgttgcacccccatccatgaagtttcccatctgcatgaactgccattgtatgccttcaccacctgattcatcacagaaaaaaggaccagataaatgacatattcctcctcaaaaggttgtgtaaaatagaattatgacagatagctacattaaaaaatcatagaaagggcaactaatctttcacaatgcataaaagaaaatcaacatatagacatgaagccacaacataacattgttgattacgctacatcaatacaagcatagggtagtactggaatcaatactaaaaaaagagtgtaaacttcagttgcatagttgtatgcctaagtcatggataatatatggaatagataatattgttctaacgtacagtatgagtcatgacattgcatatcctaaacatatacaatgtgctttgtggctaggtaaagggtactgactagcaagttgtttttttcagacaatgatcaccaactcaaggagcacacccttcatgttaatgcaaacgcaaatgagaaacaaggtattgaactaggtaaagttcatgactttttaattagttaagaatatgttcatgtccttgatttcggttgtgaataaatcagcataatctgattagccacattaacttaccaagtaaataattttgtagatgacgacgatgttttgcaacatgagctacaagccttggagtatgacattcaagagtatggtgtgtacgccgatgctatcaatgttgtgttcaatgtagacgagttgctcgactcagatgaagaagaaaatgatgcaaatgcaaatgagccaatcaagtccagaaaattgacaaacccacaaaggcaaggcatttatgaattgttgcttgcaaaaagtatggatggaaaagtagaaacgggcagcacacatgtagttgttgaagtgtccaatatgagcatacgtacagtccaacgtatttggaagagagcacaactttgcagtgcacagggagtacaagttaatgttgactgaaggaagcattataattgtgggcgcaagaaggttgaaatagacttgttagttgtagcagcaattccattatagcaaagaagcactatacggtcacctgctgaagcgctaggtgtgtcaaaaagcacatttcatagattgttcaaagaagggcatctacgacgtcactctaactcattgaagccttatttgaaggaagccaatagaaaagaaaggttgtggtggtgtgttggtatgttagaccattgtacattgccaaacaaccccaagtttactgaaatggaaaacattatccacataggccttgtttagatcccaaaaaatttaggacaaaaacgtcacatcaaatgtttggacacatgcatagggcattacatgggaaaaaaaaaccaattgcacagtttgcatgtaaaatgcgagacgaatcttttgagcctaattacgccatgatttgacaatgtgatgctacagtcaacatttgctaatgatggattaattaggcttaataaattcgtctcgcagtttacaggtagaatctgtaatttgttttgttattactctacgtttaatacttcaaatgtgcatccatatacttcaaaaattttacacccaaagaactaaacacacccatagatgaaaaatggttcaacgccaccaaaaaggacaagacttactacctacatcctcttgaggaggagctgtataggattgtccaaaacaagaatgcaattgagaaagtaatgttcttgtcggtggttgtgagacctaggtataatgatgaaggtaactgcacttttgatggaatgataggcatttggccttttgttagaaaggtaacacatccttcttacatgtattgtttgcttatatttatttttgtttttctgatgtactaatagaaacccgcccaaaggagtagccgtaacaaagaaagggggacacttgtaacaaagacttaaggttggtagagacactatgagatcatccatgatctctaaagttctcccagctattagaccatgttggccccaagaagatgcaagaataacaatatttatttatcgggataatgctagaatggatgtcccaatcgatgatgaacaatttggttttgcagtagctctaatgggtcttgatattcgcttcgtgaatcaaccaccaaattctcctgatatgaattgtctagaccttggcttctttgcctcacttcagtccttaacatctactagggtctctagcaacatggaggagctagtagagaatgttcacaaggaatataatgactacaatccaaccactcttaatagagtgttcgtggcactacaaagctgctacatcgtggtaatgaaagctagtagagggaataagtacaagatccctcacatgaacaaagagagtctagaggcacttggcattcttcctaaagcgcttttttgtgatcatccgctctatgagagagccatacagcttatagtttactaattgtgtacttgtgtcatctatgtacatgtgcatctatgtaattgtggaaactaaatatataagttgtttgcttgtattaatgctttatcccatgttatattaacaagttgattgttcatatgcgcaatcacaaaaaaaaagaatgagtactgatatcgaataaagatacatatggcatttcattaagatgttttcataaccatagttccaaaagatgccaccaaaaaagaaacacaccacatatagcatcataggatgaactatgcaccccaatcattatgacttcatattttagactagtaacaagcatagtagaaaaaaacggaccagtgggtgacctggtcgacctctcggtttgacggtccgctggtccaaccgtgaaccgaacggtcgaaccgcagtttaatacatatatgtacaacgtatgtaattgctcaatcataagtgcttggatggctcggtggttaccgccacttgcttctatcatggagacctgagattgaaccctcataggagtatgtttcctctgatttttaccaaccaaaacgctgttggcaggctaattgggccacattaaggcccatctcaatattggtgtggtcttgttcggtcggaccgatggcggtttaatggccggttcatagaaaaactacccggttcaaccggttcaaagcgagtcacgtgcatgcccggtccggtttaatgttttgaatcgaacgacgaagatctctggttccggttttttccggttgaaccgccggtccggttttttccaatatgataacaagttgtagatatatggcacattattcatgtcacacggtactagatgggcccacttcttttttttatgagtactttcgctgttggggacttgggcatcaacctttctgggacaacttctacaacgtaaaacgaccactaaagtgggacggaaggagtagcacacacttgacttagggaggaaaggaggaagaaaatgcttttgatgaccgacatatcaccaactagtccagtccaaaatgcaatcttcggtaacaaagcatatgatccagcttctctccatgtgggctagagcaattagcagctaagcgctggtacaaatcgtacgtatagtgattttcaaagtgaaaatacgtacaactacctattccaatatgcaacataggtaacaaacactagcccaaggtgcaattcactctttcagaaatcctgatgtccaaataagctctcaagatcttttttttcttattataataaaaattaaaaagattaggtgtcccgttccaaataaaataactccgcaacgcataaacgtatcggttcggctcattttgggtcttttgtttcaaaccactcgaagttggaacaatattttcgagcccaccgaaaggcaatcgacgacatcgcaattcaacaacgcacaagggcagacaaacaacatcgaggaggtggacgacaactttaaatattgctcaataaaacactatctggagacaacacacacgagagtcatatccagaggaaaacaatcagcccagacggaccactagcaccaaatgcaaagcaatgggaagaactaattcgaccgctaccaccctagtaaaaaccagagaagagagaggaaggggggacaggaagaaaaacattctagtagaacaggagaagaatccatccatcatggtgacagcagcatgaggcatctaaatcgatggtctccaataacatgcggagccatcgatcgatcgatcttcccattttactggccctcgcaggcgtcgcccttggaggcttctttcacctcatcaccaccgtcctcctgccacagatagtttcacaaggtaaaattagcaagttgctcattaggtcgatggattttgcagaagggagcttatgatgtgttgagaggtaccgtgaggtcagaggtccagagggtcaagttgtccctcaggagctgcatgatcaaagtgctgtccttgtaagactcctccccgagggtatccaactcggagatggcttcgtcaaacgcctgtagcaaacggttcatcagtcacatttatttagagttgatatagcgacaaacgtccagatggcaaaaaagtcagggttcatacaacaagcacagacacatcaaggaccagcgattcaacaatgcataaaacaaaatagtttgttcagatttgacaaacctatatttatcatgcttacttttttgttggctttggccccattaaaataattaccacactatgagctatcactaggcaaatactaccacgtgcacaaatacaaatttaatcaacaataagcaggggaagaatatccaagttaaagcaggaaactatagagtttaatgaccagcaagttaacttcaaagtataaattcaaattaatatcatacaacatatcctaaagcacagaaacctcatactaatgacacaatcatgattatattgaagagaagagcaaatgaccaccaacctgcttagcaaggttgcaagccttgtctggagagtttagaatctcgtagtagaacacagagaagttaagtgccagtccaagccttatgggatgggtgggagcaagatccgccagagcaatatcctacatagaaaaacgtgggacagacaatttcagaaagcattgcctgaatcgactaagcagtcaatgaaatgcatttattaccagatggagacatgtactaattagttgctagagtaataaaatgagaagtgaatcagtggtatagcatatatgttatctcagaattaaaataaatcaacctacctgagcagccttgtaagccaccattgtgctctcagcagcttcctttctctcggcaccagtcttaaattccgcaaggtacctgcaaattataaactaaccaaattagaatagtcaatataaactaaggattcagttgtttttatgataagtgctgcatcattcccaacctgtggtaatcacccttcatcttgaggtaaaacaccttagattctgcagcagtagatgagggcacaaggtgtgagtcaagcaacttcaggataccatcgcaaatcttgctcagctcagcttcaatcttgccacggtactccttgatcagagtaacatgttcctcattgccacgaccctcctccttctgttcaatggatgagacaatacgccaggaggcacggcgggcaccaatcacattcttgtaagcaacagacaagaggttgcgctcctcaacagtgagctcttccacatctacagtctttgcaaccttctccatgtactcaaccatctcctcatacctttcagcctgctcggccagcttggccatgtagacattctcctcccgagacattttgaccaattaagggattactgtagccagataaaaaggtactgataagcattcaccaacattaataatctgaaagccatggggtctctccagaaggtataattgtacaaaacagatcatgttcccattcatatcaaggatgttcatttgttgagaaatgaataattaaacaattgtgaataatactactgaatcctacaaattccatcaaatatttaatactaactctttttaaaggctgtaacaaatgaataagccaatatcatgtccaaattcaaaatatttcataatctcaactaagttgtatttgtaatcactaaaaattgttcaatacagaaagaactaacagaaactcaattacagccttataatgagggatatatctaaacattgcagatcaataaatcataaacatggctaggctagatctaaacgtcgcatcaatccacccacgagacaaacactgattttccacaaaccaagaccacctacctcccaatccagataaaaaaattatcaccccaataccgagcaggcgtgcacctttcaccgctacatatatatagatccccacactattaacagattaaacctagatctaatccgtggatcaaacgcagctaataaccgataccatcaacatacttccacaataaataaataaataaataaataaataaataaataaataaataaatctgtctaacttttccaaatccccaacagacgtttgctcaactcagagatgataatccaaaaaaagcaaaaaacaaaaatccccacttctaaacgagacgaagctcgccaaaccgagcggatctactcccctcgcgtgcacgggatcgcagatctcacgaatccaatcccatccaaatcacccatcaccaccgagcacaccagatctagcccaaaaccacatcccacagtccagaacccaccaccccaaaaaaatcgccaaaaaaaaaaacatcgccgcacgccttcccgtgagatcgagcacgcctagaaatgcaaccgcgagaggaagaggaagagaaaaaattccggcaaccctaaccttcggtggcggcggcggcaaggcgggtcgggttcgagtggtctcgtggatgcgaatgctttttgttcggcggaaaggaggggttgggaagacgggtgcttttatagcagggaggcttggcacgggagccaatggtgtggcgccacgtgtgcggcgagccaggctggacagcggatgacatgtgggggacgggtcgcgcctgggcccacgtgtcagtggggggtatagttggcgggtctggttggcctcggtgcgcgcggtcggtgggggatatacccttcctcctcctagctcgtgagatacgcgttttttcgtatgatgacatgtgggccctggagttggtggggccgacgtgtctgtgtgatgacctgataatgtgctgaaaaagaatgttttttttttagttttattttaggggctgatataagtggaagcgcaccatgggtgatgcaaattgcaaaatgacctgtgatctcaactcaaaaggggaaaaaataaacaactctggcaaaaaaacattataatgttcatggaatgggagttataaattaacaaattaacagttataaaatctattataataaataataattttataatgtttcctaagctgtattgcacggcatatagtaatggcttttgctgacttcagaattctgaccccccccccccccttcatctgttgtttcaaggtctagagaagaaaaggtcagagaaaagctgtttaccaaataccttttcttatttcctaaaaggattcttttgatgttgaactgcttagtggtctaaaagtcttcctacaaggaaaaatttgtcaccgagaacaagtggagattttgcatctatatatattttttataattctaagtcttaaatgtattgtattagctatctaaaacctgggacggacctagagcaaggaaataatgtacagttgtacttccaaaatttttgacaaacaatatgtgatttaataggtagaagtataatagtacatgtatataccattaggtgggtcaataagagcattgttaagcccaaattcatcctttccagaattttatagtttgcctcgtaccaaccaccccagctagaaaaccaaaatgaacttgtgaacctaaaaaatcataaatgtggcttggtgaattatgggcattgtctagctggcatgcgtttaaactagacaggacaaatatggacagtttgattttctgacagaaaaaaacagaggcctctcgtctttctgacgatccttaaaaaaagttacaatgaaaaatagaaacaggagacgtgcctaaacaaattatttcacccgtacatgttcttgtcaaagaaaacactaaaatccctcatatccaagttgcagccattgcccattgctgtcaatcttctctttcaaactccttacgtgtccctgtccagagacaggcacagcacagtcagctcgaaaatatcaggttagtttccatcttaatggcagaaaaggatgccatttccaccgaagcaaatctggaaagcaatgtgtatgatgcaaatccagaattgacacgtaattgacagcatccatacggcaagatctcagataagcatcgagactcatgtcatatgcagcattgaaatcaaatggaaaataattcttgcatgaggctacagggcacacacacaaagacaatggctggtggcaacagactaactaccctgaattaacatgcacagaagaatcaactctcttaaccggtcaactagcaagaggatacatatgctgttggcacaagaacagaaatcttctcggactactgaatttatttcaaataattgcttgtactacagcttaaacttatcagttctggcttaaacttagcagtagtaacatacagctgaatcattggggaaaggaagccagccaagaaacaggaccagctgacctccatatcagaagaatcacaagcattttagcgcagccataaatgtggagatctgttcagaagtcagatgatactgcaaaccccgctgagctgcagacagtacagaagatgtgggaggccataaacatcaataacgcttccagcatttacatgagaaaaaacaaaaggctctaatgacaacgttcaagcagagaaacaggatacacagctattcctcatttccagtgatccttttctttagagcatcaaagccattggccagttcttcccggttttcctgccagaaacaatacaggctgtaagggaaacaaacatttgagtacaactaaaacatgaagtagatctgggtcatactcagacaaataaaaaaggcacagccacgtatttatctacgtgcgacagtaagttgcaccaaatcatatttgacattcaaatggtaagtagtaggagtataacttttctctaggataaaaacaaacggaattgacttgggatggagctgtgatagacatggcaaagctaggtatgtcaggcatggacaattgtcaattggaccgacgtgatctgtactactgaccccatcaataccaagttgtgcatcctccacggttcaaccaacagccttttaggtttgcacagctaagttaaatggacaagactcaagaaactcgtgctgaatagctcaaaagcagcttcactgacagcccacatgattcaagattaccttgaagagcaggtagcggtacacaaaccatcccgagtagccaagcccaactagctccagtatgttcggaagctacatgaaggaagagtagttagataaacaagtgacaccatgactaggacagcattttgcagcagctacaagtaaatgggggaatagcaatataagctgggcatataccactggaactgaatcgacagctttgacaacaatcgaggatagccagacagcgatgattgctccgcctccgtaaaagagaacagaggacttgttctcaatagcatcccactgtgttgtggtcatagcaatcataagattactgactcagtgaaatacattgtgttctcccaagtgaacataccttctctttgagctcagaaaggatctcatcgtcctcatcagaactactctcttctgaagatcgcatggcttgtacctggagtagagcgatcttcggggaatctgctaaaatttgatttcttagtgtacttgtacactttctcagccacatagtttggagggtggccatcaaacagatgccgcaatattgctaaacaactttgccaaacaagtcacaatcattgtatagatcttctacccttgtatactaagtgaaacgtatgccttctttttctctccttgagaaacaggcttctcaatctttttattgaaaaggccaagttttttaaagaactaaaagaaaacacatgattctttaaattgtatttatattttgtccctacagattcagccgatgagatacttttagaacgtggtttggtagcttgagtttttgaattgtccacaacataaacaacacagatacactgactgtaaatagaaagagctaattacaatcaccacttgttcatcagtctgaaaatatgatgtggtggctctcaatgaaagtaatataagcattttgatatgcacttgatagtgcagtggcaagggatcccatatacagggtttcaactttcaaccctgaggtcccatgttcaatcctcaacacgcttacaatttcttcttaaaaaatgtttggagagacaactctccctccaaatcttttttttttttgtaatacaagcattttgtcaagcattgacaattctctcttgtcagaaatacttaaacaggtagcagtgatttcataccctgaacataggaaatcaatgataaatcacactagcccaaaactaggacgttcttggatgagagcacttctttgaaaatttatagagcagaaaagaaatatgtggtaaccaaaactattaagtaatttttcgccgggtaaaaactattaagtaattgggttgggtgcactcaggtcagtgagaggttttctcatatgttgttgcttaacttgtacattaattcttgatctctacagtgaagcgcaaaggattacatgtgcaaagtgatttttgcagtattttactgtaaagagtactggtggttagcagcaaatacacttccaacattagagctatcatcagtatatatgctttgcccttagtgttcggcaacatgtcaacataatactagacattcaggttaccctgaagtcttctgtgaacaacttgccctcccactttgtagagtaatactcagcttaacaaggatcagaagcaagaacttcaatgtgggtggttactcacttactctacaccaatcacaaccaaatgctgcattctactagccagccaaggcgattctaatatcgagtcccaaaatggagctcaaccgttgttgatccagttttatgcttgcactccagtatccaattttttctaatcccctttcctaagaacgatttgacctcgtgtgtgtcgatctgggatccaaagcatatggcgagaagtggttaccttcgcagcgaagggagggcgtcgtcttcacgcggggagtgagccggcggcggcgcataggagctcgggggacagcaatcggacggcaaagagacgccggcggcgccgcggcggcgaccatcccggccatctcggcaaccgccactacctaccctaccttcagtggatgcaggcgtcagcgtcacggatcgagcaaacgctgcgagagggttgagaagcgcgctgctggaagctgcgggaaggaagaacgcataccgcacggaggtggggtggcggcgacggcgtcgccggcgaggtcgctccggcgagaatggctctcgctggcacgcgcggtgtgaacaaagcaaactcgataagcgccgtccgatcggagtttggcggccccagatcgacccaagggcaagaggtggtaggtgtagggtagggactagggagtagggaggatttgtggctgaccgttgcgcccccaatttccaatccaaatttctcaacccctcagggtcaaaaatttaagattattttttgtttgaatttcgtcatccagatcccgtagctctaaaatctaaaccgaccagtttctgttgaatgtagttcaattgggctgtgtctagtttcacgccaaaattgaaagtttaaaaaaaaagttacaagtttatatttgtagaaaagtttagatgtgatagaaaagttagaagtttaaagaaaaagttaggaactaaacaaggccttggtcaaatttcacaaggtcacgtgaaattcatcatctcattctaacttgcatctcgaccaaaaaaaaaaaacgagattgcaagccttgctcctaaaaacattgattaaataatattaagacagtttagatgtacagtgcatacaactttcaaaccttaataattaactttgcgggaggataaaaaataatatttaaaaataagtttgggaggaaagaagaaaggaacagattacgtcacaaaagttgtcatttctcaacttttgtttttccttccctagggtaatgaattcacttggaaatcattcatagcgagaagatgagatggccatgcttatttatctcagcagaaagaaaaatcccgattcttttattcctccttgtttattcatcactcagctcatacatctcagagatcattttaacattagccttgtcttattgcacgaaaagtactcggtagtattatctgtaccagctccgggatttggctttaaaaaaccaagaggcgatcgattactcgtctgcctccgtccatgtcgcgatggccagcgtgtgcctcccgccgcaggcgacgtacctcgcctgccattgcccgccggagtcgccgccgctggttcccggcggcggcaggtcgatggggacttccatcgggtggcccgtcgtgaccttcctgccgtagcccagacggccatggtcacctctaccgtactgcgagaacagaaggggaatacaatgtaaacacattataagtgattccctggagatcaaattttgttctttttagataacaaatcagaatggattccctgtttaagcaaaacctgtggttgttcagggattacaggcttacagccaggcatggttaaagaggaatgctgtttttaaaagttttactgagattcaagtatccaaaaacacctatcagtacttctctggtgaaaaaaataatctctctaaaatatgcaagtgatctgtattaatggagaaatgtggtgtcctcgtcgccagcatttcatagactagaactttgggtatgttctcaagggtgagcagaaaaaaatgttgcatagctgctcggcaacattgactatcaaactgcaaaaggttgtttcatgatacgatactccaaagcacagaggcataattgagtgattatggacttgcgagtgcttatagcagttctaatcagccattattttggttcactcaaatttgtttgaaatttgaaatatttgtctattttcatttgcataatttacaggtggtattacactcaaatggggtcaagatgacaggaatatgcactcttggtacaaagtaactagtagctggagagaaaaacacttacagaaaacattcgtccatcacgagttagcgcaactgaatgggttcctccacatgatacctgcacgcaagaaaatgagtactggtgctcaacttggacaaaaaaaaatccattacctcaggcacagcataggagaattacctgaataatatcctctccagcaagaagctcaaccttttggggaaccatgtgactacttttatcatctccaaatccaagcctcccatgctctcctctcccccaagcatacacctatagaggtccagaaagtgaacagctattaatcccttgtgcacaaagcaatgtttatttgccatccttctggtggcttggcagaaataagctcaaacatgatgtttcagttaaagccaaaggaaggaaatacctctccctctttagttaatgcagttgaatgccaacctccagcagcaatgtcaacctgcaaacaaatgtacaaatgagcaatatgtatgaaactataaacaagaaggtaagatacaaaggcatgatccagaaaattgtgcagacgaatatttatttatcagcatacagtggtagcctataatcagcacaaagttatatgtatagctagaatcaaacatactagtgtaaatggttaggagtggaggtactgaacaccatggcttgtgagatgaaccgagcacaactgaagtgactgtaagcaaacatagtttaacgcaggatccaaaagactaggttctgttttgggctttgttagtaatgtcttgagaagacaaccaccctgttataaactttatttcacaagttatcagaattagaagaaaccaaatcagtgtggctcaccaatgaaaggtcagataatccttcaacacggattggttgcgatcttggttgagtatctccagtgcccagttgaccatactcattgttaccccatgcccacaaaattccatcttctgttagagccaaattatggaatgcacctacagcaatcacctttacattctcaaggccttgcacccgcactggtgtagatatttgcttgctgaaaaaggactaatggtcaccagcacatatagggagaaaaacaaatttcagcataaagcaataaggcactatacatatcgcctggaggccatggttgtccccatgtccaaacatggccatcttgtgtcaagacgaccgagtgtgtccctccagcagcaacctacaattaacgggaacgattagaaaacccatgctaagaaataaaaggtggaagtgcatgacaaaatattatcattatggaaaagtggagtgcacgacaaaatgttatagcattattctgttacgataaaaatccatttcgggagtgcatgacaaaacattatagcattattctgttacgataaaaatccattttgggagtgcatgacaaaacattatagcattattctgttacaataacaaaccattttgggagtgcatgacaaaacgttacagcattattatgtgacaataaccattcattttggatataatacgttatcacagttgcaaaacatatatcctggcgacccttcaagcgatttacgacctaagaaatgtgttccacaacctaacacttgttgggcaagtagcagatgccaaggtgatagtgcacaatttgttggattcccattatccggttatcccctacaaccatgctgcatcaacaaagacgtgataaaattccagcattctcatggggacaaattgtaggacaagtcaggaatcgattccactcacttgccggactttcagcttgggggcacacccctgcgggatcggaatgtccctcctgagagccctggttccatcttccttcctctcagcctcctccccacactgcccatactcgttgccccctgcaacaacccatccacacgctcacattgcatcaaatccaaccaaatcgggtcacagaattgacagaaaaccaagcaaggcgagccgagctccccgtccccgtaccccaagcgtatgctctccccttgtcgtccaccgcgaggcaatgccatccgccgatcgccgcctggtaattagcaggacacacactcgcattcgttagtgctcactactactgcaggtagctcaaatcgcgattggaagaggaatgatctgcggtgacctgcacgatgctgacgccggcgagggcatcgacggggccggggagctctccgtcttggtctccggcgggtgcccgagcgtgccgcgctggttccacccccacgtgaagagctgcagcagagcagtacacgatcgaatcagatcagaaacccagcgaaggcctc

SEQ ID NO: 30995 - DNA, 23793 bp, Oryza sativa
gcccatgccaagctgcccgtcctcccccgaacccctacaccaaaactcagagagagagagagaaggcgccatcagcgccgccgccggccgcgggagcgaaccagcaggtcggagcactccactcaccatgcgaggacggccgtgggaagggagaaagccggtgggggcgccatgggtgggagagaagaggaggccgccgagcaggggcgcgcgaaggcggagaaggtccgggttttcgtgccccgcgcacggcggaagaaacagtgtgtgcttccctcgtgtccgagcccgagcaccgagagcgagagagggaggagggggctatctttcggggcgcgtgtccgccgtggcgtgggttttctccctttctctctctgtgcgccgcggtcggcggtagggtttttggggtttgggtggcccaccaaacgtgaggtggattccatttccatccacacccccttggtgactctgactcacccccggccaaatcagtccatttgagcgaggataataatgctcctattgtttcaatcagtcgctgctaaaatttgaattttcaaactcaaatttaaagttgattttcattcaaatttattttttagcattggtatttaaatcgctaaaaacacacacacataagtcttgcatataaattattattgctttcctaatacgtattggctaaacgacgggggtctaagctaactataaacttatatgaaaaaaaagataaagaaaaataagaagtattggttataatgcaagagctagttaaaaacgagattttgagggacatatgtccctctaaatattttttttaaaaaaatatgagtgttctagggattaaacacggaaactcgaagttgaaatcacacacccctgccactgcactaccaagtatatctcaatgcaagagttagttatatacatgtttgttcaagatatttacattaaatttatagtgggagaaaaggagtggagaaaaaaatatagtcaattgttaacatattatacatgttagttgcaatataggctaaggttgtgttcttcccctaccttttccagtgtacctttctcgttttccacgcttcctaaattactaaacggtgtgtattttgaaaaaaaaatatagaaaagttgcctttaaaaaattatattaatctctttttcaagtttattttaactaatacttaataaatcaagcactagctgccgctccattttgcttgttgcgagtgaggttcccgaattcagtctaatagtcaatatttagctttactattaaacttgttgttagagagaggattagtgggggacacggatgcttgctataggtataaagcgtgtgtgtttttttagggaagcatgtgtttatattaggaagtgtattattgcggtgccgtgattaatggttggatgttttatgatgtatgggtggaaattaagtcgagaaaaaaaatggtgtttgctgcgtaatgattaaggccatgtttgtttcattctaagattattataatctagattactgagccaaatgaatgtaagctgaattataatatgccgatatataataagttgtgagctgtttgtttctctggattataagctgtttgttaaatgttagccacccaataattttaaaaaaacacctttagcgtggattactggattatagtaatctggcttatagattgtaataatctatcataatatgctatatgtttgtttcagcttattcctaataatccaaattataataatcataagctgaatcaaacagggcctaaactcatgtgccacgatggtaaaagacggtatggttgggtttagttcgcaatttttttcccaaaaatatcacatcgaatctttggacacatgcatggaacattaaatgtagataaaaacaaaaaactaattgcacagtttgcatggaaatcgcgagatgaatcttttgagtctaattagtccatgattagccataagtgctacagtaatccatatgtgctaatgacggcttaattaggctcaaaagattcgtctcgcggtttccaggcgagttatgaaattagttttttcattcgtgtccgaaaactccttgcgacatccaatcaaacgttcgatgtgatacccaaaattttttttttcgcgaactaaacggcctatgttggttttatgttggtatcgaagtgattgtatgagaatgtccccttttatatggtcatccatccttttcttaacacggtcaccaatgctgacattttatacatagaaaagggtatattgttttaaggagaaaatgagaaatgagactaaaccttggatgaggaactagggtttcgatcttccaataggtattgataaagtcgattatggatactcaacgatgatctaaaggctctgatcaggacgatcgaatccctcctaatcactaaaccactcttcgattggttatcaaccgagccgaaatattactgacctcctcgataagactatctcttacaagcaaatcgagaatacaagcaagtgagtggaagaagcaatctgaaaaatttatgaatataagacgaatctcacaagttggatttcacaaaccgaagcagcgtgaaactgcaatgccataataatataagcaaatctaaccataattcggagacaactactaaataaataagttatatagtcgaccaagaagccctggacgagtctctaatggactccaacacgatacacaacatgttaagacggtgacgtgacactcgtatagattctatatgctctcttgtttcgacgattcatgttgacttagaaggaattttgatgtgagacaaggctcattcgaaagttggtctcattatctttccatacataatggaatccgaatgagatctgggtgacgattttagtgcgggttgctcttggattctgaggtgggcttgaacttgatatgaattaggcctctatttttcaagtctcttttcaagtgcttcttgtttctcctttgtacgtaccgaaagagtgatgttctcatcaatcttaataggaaaaaactggacgaaaatcataactagaacaaactcacaactaacctaaactattgtgccacggaaatagaaatagtcaggttcactaagcaaatgatgttcatcaccaaatttgcaaaattagcgagctaggagatcaaactatagtcatcgattagtagataccaacggtgatacaagctctcctaattcatgtcgttgtgttatctatctccaatcaattttcatggaaataaaatggataagaatcataccattgcaaaattcctacgctctacgcaaatctcgtgtcatataggtactccttccattccaaaataaattatcctaatatgaaatgcgatgatttctaatataacgaatgtatccagattcatcgtaataggataccacatctcgtattcgatcatcgatggcagcagcatcatgtcatatgctacgaaatatattttggttgcattcgttgatggaagagaaatgccactaaaaggggagagagaaaaaaaaggaaagcacgaattttgcacagctaaatgggccagcccgaaaccgtttatactgggccgcaacgtctagagtgcggcccacgaaaaggatggccacactggctcgcctcaaggaagcccggccgcggagagcatcgcgtcccaccccccaccgccgcggcggcgatggccgccgccgccgccgccaccgcgcgctcctcggtggcgccgcacgcatcgcccacccttcgccgctcgggctcatcaggtaccttgccccccccccctctcccacctcatcacgacatcaccctcatcactgtttcatagttatatgatttggggatccccacagatccggctgcctgtttggcggcgagatttttctagctccaagagagaatgccagccacgaatcgtgcgtgatccgcccgccgccttctgtgccgtgcggttgcataaactagtatactgatgatgatgatgatgatgatgatgatgatgatgatgatgcggcactttcgggcttagtggggtgttgcgatgcaaaaaaaggcagttctgtcggcttggcaactttgcgtggcgagattagtaaatcaagggcatgtttttttttgtttcgatcatctagcctttttaggtagtggagaagctatgtctcggtgtttatggaatttcctaaaaccgatgctacagctttgcagcatgctggatggtgggcgttgtgatgcaaaaacgattccgttggcttggaaattggaatagtgaaattaactgagtaactgatgagcaaggcatgtctgtttctgatcataagctttttagatagagaaaaatacaggttgggatttttgagatgaagatcttcttggaccgatgttagcgcttcggaacatgctgttaagacgagctctgaagaaattagagtccattgatgagtcctatttagtgtgagttacctttcgtaacttccctcttttaaacactgaggtgatgcctgtggtcaggctcttattttgagctgttttctgggcaattagaaagcccaagcattgatgataagattgatacatgaggctatttgatattaaatgccatctgagcacttgagcagtagctgaacaagatgtgattttgtcgagggaatatgtagtgaatccaactgaccattagaccagaactctgaagtacttttgggtacttaaaatttaagaaaaataaacaaaagctggaaatcatctggtagtaatactcctgaagcatgttctgcatttttccgagctttgtcatagctgctaagagttatatcctctcgataacttatcttgcatgaggcacaaaatgtgcttgaaatgattcgcgtatccatcgttctttccctttcatagctttagtcatatcagatttggtattgcaacaattaaaccttctcaaggattggatgatgatggagagtgtggtcgatgaccaagataaggagcaaagaaaacaagccaggtctggagagaaaaaatgtagggtagagaaatgttgtaatttatatattagacctgaatttttcacctgtcgacatttttcatgttcattcaagctactgtcatagtttgtttggattctgcatcaacaaatatctctacagctttttgatgcatccataaatatcgccagtctcctcttaagtgatgctttcactttgatatggccacataggatagctctatatgagaaatattggggatttaaaacttttaatatacagaagtgattagttcatgctaatccttctatttcagttcaatcgtggactgttgtcagtagagaaaataaccaggattgccccttctgtttacgacttcacagcattctaaataggttcaggcgacagacaggtgcaatagacagcgacaactaaacagaagcctaccagtcttctcttatccttacgaccttacaagtcatggccggtaattatgatttatggaggtgattattcatgattactcataagggaatagaaaaataaaatcacatgggtcatagcatttatctggtggaaaattgactgcattcttgttagtacaagtagagacttgaccaactattcatcatgtattttggctgtttcagtggatcgctgcacttcctgagagttcttttaaagatattaccgtctctctcaacgcttaccggaattgcagattcgatctatttgcttcgactgcaaaagcaggtatgtgaaccttatccccaagatatagaagttagcaatggcataagttcctctctctttgttatcaaaaacatgtcattcttttggagtacatgcatatcaagatattgaaacctaaatcatttatcaggctagagctgcggctgggtgcatcccatccactcatttttcagtggccatgctagcctgctagggatcacattgggaagggaaacaatcaaataatccgcggtggtctcagctcagctgcatgtgtggaggacaagcaaatcgccaataacacaccacatggggcaacatcgcgcagacatggcatggaccctgcttgccatctacccctcaccgtttcaatgcaccagagttacagcggcagcaaggaggcccccccattgcaattgaaatggccacatgtggagactgccatatgtttccatcagagatgatctctcagttacagtaagacacatccaatttcgacttgttaccctgatgaaggaacaagaagaagagaaagaagtgagtgtggcagacagagacagcagcaacccgggcagacagctccacgcacatttcacacaaaagtccacactccaaacagctccgtgtgcagcagcagcaagcagcaggccagcagcttccttggtcagatttttccatctcgtccaattccatcgcgttcagtttactgaactttcgactgctacttcggttcaggctttgtttcgacgccctatcggacctttgactgacgtgcttgcttgttaggtcgttcagaacactgcaactactgtatcgtcacgtcgggttttcgcttcgcttgcacctcagctaagaatgatcatagcttcatctgtagttacctaaattaccgaactgtaaatttcatgagattgcaggttcttcgacagtaaaattatcaaatttgtacggttggaaggattttcagttaattaacttataatgttacgcacgaaattttcactgagcattgacggtgctggctcacatgctatctgacaaggtggtcctgctatcaatttgctataaagttacaactaatgtcatgtcgtcatgtgttagcattgttattcttttcgcattttgcttgtatgttcatcctcgattggtgctcaaagccaatcaagcagttcaaagttacaataagggctcctctgaatgcaaggataggagaaacataggattgacagaaatataagtgtaaaataaaaggctacaaatcacaaaaaaggaaaaacaaagatagcgcttggttagatggcatgaaaatgcaggattttgaggagagatcaaaatgaaactacccatgaggttggacctcaatattaaatttcctcaaaacctgcgtggattgaatcatttcatatatatttcataattctatattgtccagcctttgtttctaaggatcatttagaaaaaaaaatatagaacaaaaatcctacaaaatttctatgttcatagttcaaatgaaaggggtttacgggtattttctcaagggtactaggcaaggactaggtattttctctactaagctttttttctcatgtctatttgagatctcctattatatgtgttcaataagggattttttttttactcttagccatcctccctaacaacgtgttctcaaatgccatccttccaaacaactttaattatttaccatccgggcccactaggctattgctattttgccacttttgattggtagctcagcaaaccgggtgacaaaagacttcctagccccttatctcctttttcataccttcttccttggcagtccttcccctttcctcatgtcagcgagttggcctaattctagcaaggtcctgcaagctggcgatggaggtgagctcggagacatagtcggtcgggcttcgcggacccaccgggatagggaggatgttgttgttgctggtggttcaccacccaccccgtcccaacaagctccttgtcgatggaggcgacgataaccgacgagcttagatacacggctggtagggcttcacggtgccgccgggatggggaggtggatgttgctgtcagtccactaatgagctctctctatctctctctctctctctctctctctcgctcgtccgagcatgacaatgaaggaggcgtggatgtcgggaagtctctagcaatccaaacctccatccgtcgcctttaaggtcttccacccagtcatccatcgccgctgtctctgtcgatggttgccacccgtaggatccaacatggtggccggccttgcatcccagctccacaaaggggaatggtggcgacgacgatatgacgggggaggagtggagggagaagaacgggtacagttcgtaggcgggaagctcgccggtgtgtaagaccttgccggagccaaggcagctcgcgaaccaaaggaagtgagttggaagaaagataggagagatgagataatgggtgaggtcttttgttacccagtttgctaagttagcaattaaaagtgacaaaatagcaatagtctagtgggcccagatggcaaataatcaaggttatttggaaagatggtatttgagaatactccattgggaaggatggcaaagagtcagaagccctgtttaacgagcacaatatcgactattagtagcaaatacttcctccgtatcattttaagtgtagctgtggttgccgtgtccaatgtatgagtgctcgtcttatttgaaaattttatgaaaaattaaaaacaaataatttgcgcataaagtattgatcatgttttattatctaataacaataagaatactaatcataaaaaataaaataagatggacagtcaaacattatatacgaaaatccataactgcacttaaaatgggacggaggaagtagtgaggtcgtcagtttccaattacgtgcaaaccataaatatggtgtgcagtggcaactgagccagttcatatctgttcatggttctttctattaggagggaagaggtacatatacacatttttttttagcacgcccatttttctaacctaccatagagttgtaaacctcatctcatctagaacatcacaaaaaattttaaagcattgctctagaggtacaaaatgaagctacttcttcacattcccaatcctcacaatcaaccgtaatcattctccatttaactttttcatctacttttccttctcaatcaatcataatatttctccaatcgtttttacttgctttcttaatactcattcctacttaaaaatgcttaaataggatgaaggtactcctagcctcctagatattgtaaacttaaataggatagaggtattcctagcctcctactagtagatattgtaccttgttaacttcgttcgacactcgtttaattgctaaacaatgcttactgaaaacattaaaactccacacatcagtttactaagaaacgtcgccaccaagctcgatcaatgacggcgaccggacaggctgaaaaattgaaaatacggttaactggtaccgatacatccatgtgcatgtggtctcattctttgctctagcaacccaaaaagaattcatggataaggatttgtattcatatttttgtgatccaaaaactgatacggataaataactgtgataagaaaaagcttaaaatttattcaaatgtttaaatcctagataatatggataagccaaaaagttaaatagggtaggcatgtcttcaaatacttctaccagtacataggagtagcaggagtaggagtaggagtacattctagactgcgaggaatacaaaacgtcacgtgtggttaatcctcctaaccatgtcaacgcgaggagagccgggtcagcccaaccaaccaacccaacccaccaccgcctttaccctcacccacaccacccacacgccccccgccgttacgcaaccttacgcctatggcagctggggcccacgtatccgcgggaccaccatgtcagtgaccgggggtcatgggtactccagcttcgtgcggcagcgcgcacgaaggcgtggggtgtggtggtgggcccggctcctggtaggtgagctggatccagcgcggcggggcgggggcggaggcggcatcgggatcggcgatgattacacagatgaatgcgacgctattggatttgctagtttcgaaatgtttgattttttcttatttaaaaaatttaggtaattattaattattttcatatcatttgatttattgttaaatatatttttatgtaggcatacaattttacatatttcataaaagtttttgaataagacgaacggttaaacatgtgctaaaaagtcaacggtgtcgaacatttcgaaacggagggagaacgttttttttttgagagagattttgggcgcggggcatatgtggtattgctcgtggcaagaacagaggggggtttgggttccgagggataggggggcacagagcttgtgagcgcaggggatgggggatgagaaatgggagtatcgtgcacgagcactactactgccgccgcggccgttgtgatgatccgatgacgtcgtcggccactgttcatgtatttcctctatctatatattttaaatatattttaatgtatgatgccgttgactttttatccaacgtgtaaccattcgtcttattaaaaaattgatgtaactatcatttattttattgtgacttaattcatcatcagatattttttaagcatgacataaatattcccatatttacacaaaaattttgaataaaatgaatggtcaaacgttgataaaaagttaacagcgtcatacattaaaatacagagggagtacttagtacctccgccctaaaataaggctgtgtttagataaaagggttgtaaaattttatagtgttgtatcggatatttggaaatatatttaaagtattaaacgtaatctgataataaaacaaattatataatccacctgtaaaccgtgagatgaatttattaagcctaattaattcatcattagcaaatatttactgtagcactacattatcaaatcatgacgcaactaggcttaaaaaattcatctcggaatttacacacaatctgtgtaacatatatatatatatatatatatatatatacacccctccctcctgtcgcccctctctccctcttccctcccccagcgccccctccttccgattccccctccttttttctctccctccttcttctctcttttttagaaaaattaaaaataaattggtgaattcaagacttgaaccaatgatctcatggtttatgacaagcacttctaaccaaatcaccatatgatgatttgtgaacaaatcagttatgtacctataacaatcataccttgttactatgattcggcagtaacattatcccagaaatatagtaacatcatatgttactggaaaaatgtataggttgttactgcacttttggcagtaacaatatgacgaaatttatagtaaacagagaacatgcatagtaacagtggccctatagtagtaatgtttttttagatctagagtattttaaatctcaatatttagagagtactaacatacacgttatgtcttatttttctaacccatttgcatcatggcattcgtcaaaaaaagtgcttaacgaaactagaaccatcataactattttttaacattgttacagcgaaaagcagaggtgttactgcatattggccatcatgttactacgctgtttcagtgagatgaggactaaaaaaaggtaaatctcaatctttagagagcaatatctctcacatcatatcttgtattttcaatccgtttgcaccatgaagttcataaaaaaacgcttaacgaaacaagatccatcatagctactttttgacgttgttactgcgataatgtggtcttgttactgcacgatgaccatcctattactgcacgattcctgcaagacgagagcagcaaagtggtgggcgggggagggagtggtgggcgggtttgaccggtgggaggacgctttgaccgacgtgggaggggggctttgggccctaggaagggtggggggaggtgggtttgacccatgggaggggggtgtagaatagattttatatatatatatatatatatataatacttcgtgcatgtatccaaacattcgatgggatatggtgtaaaattttgctaggggatctaaacaggccttaaagcaacttactccctccattaaaaaacaacttataagtagatgatgatttgacaccacctaaaataatgaatccaagtttattatcctaggttgatttttcttaatgcagagattaaaaggtagtacctcatccacccgaaaatgtaaacattttttaggttggcacgggtattaactaaggaagtatgtgagaatgattgaagggaatatgtgattagttaaaaagaaaaagtaggtaaaggataatggttgtgattggttgagagtaggagatagatgaagaaatagcttcattttgggacaaagtactatgctagaaataactacatattaggatgaagatagtactacgaatttgaacctcttattccctccgtactcgtaaaggaaatcgttcgatatggtctccaaaatataactttgactacttgtttctataaaaatatttattaaaaagtaatatatgtatacttttatgaaaatatttttcaagacaaatctattcatataattacatcttcaaactcaacaacttgatagttattcataatttatattcccaaagtttgacttaaacattgtcctaaacgacttccttcctgtacgagtacggagggagtactgttaaactcattgttagcaccgtacctctaatactccttgttaacagttctatgcatgtgttacacattcaggtgttaaaaacaacaacagtcctaagacacataccatggacgattcttttgagatcaagctagtaaagctttcgcctgcagattaacgtggaacaagggtaaatatatgaggcaaataatatgactggcatccatgcaaacgcttccttatcattaaaaaaacaattaattggctctaaaaaagttactacaagcttcaaaaagaaatagtataaaataaaacatagtactccagagatgttttatctaaaagaaagatctttgcattatcagagatgttttatctaaaacaacatcagatatgtcgctgtggctcgatggttatacagagaaattcgttgactaaattagcagttctttttctaagtctgacggcgcttaagcggatagaattgatagttccttcgttaccaactgatgtactttgacacatttgatttcactattcgtattttttctacctcctccatttaaaaattactttacacgtcttaaaatactgtaatctatatcttatgtccggttttataatattaaaacggaggtattttagataactccctctatttcaatttcgtatattattttattcgttgcaaggctaatttgttttggaggaataaatttgtattttgtcatataagattaatgatgaaaaatagtactccctcatttttcaaattataattcgtttgactttcttcctagttaaacttctttaagttttatttttttatagaaaaatatagtagtattttcaacacaaaactaatttgagatttaatgaaactaatttgatattttagatgttgctaatttttttataaactttcaaatttaacaaagtttaattaggaaaaaagttaaacaacttataatataatatgaaacggaggaactactagccaagtttgcatggttgaatcaacattttgattattttacagggcatcttgaactgctaacaacgatacgaaaactttaaacatacactattatttttagttgcattttttatttttccatgccttattagccgtagctcaaatgacatgtgtgtcgacgtttaatgtctcgactacggtatttgcatggcatgggaatcgttggtactagggtatacgtgagactgaggtaaaagagatggagacaatgatttttatacaggttcgggcccctgaattgtcaggtaataaccctacatcctgttggccgaagccgatattgctcttattcatgataatcacaccagtataatatttggggtagcctatctaactgttgtcgacttggcggtctgaagttctgactcgtagtcgacaacagggtagccttcctcctcgaatccgtgcccggcgagatcagagatagcgctttcgtctctcctgacagtatccggagacaccgtagggtactagccgtgcttatccctgaagtcgatatccggtggcgtgtcttggcgtatgtaggcttctatattgtggcttctatgtcgattgtgttgggtgttgatcctgtcccctctcttcctaggggggcttgtatttatacccataggtgtccccttgtccaagtagaactagggaaaccaatatagatacaatccgagtagtcattgtcgtttccatgtagaactctggttgtctttccttatccggaactcctcctatatccgaacgttgcttccgtataggacatggtacgtagtgggtcctaccgagatttagtcaactactattaggtatgtggtatccataaccctgacagtagcctccgacttcaatgcaaatgaacgagttcatattctcaaccgcagaccttggaggaactgttatcgagcgcacatgaccattctcggtgagtgtagagataacattagacttcctttatcagcctcgtgtgggtacctaaagggttagtctgagtcaatctccgacgtcaaccaagaaagaacagagcatgcgactaagtctcccgtcttgctgtaatcgagaatttggattgaagtcaagaaattttatctcggtgggtacaccatctcttcatttcgtattccttgttgagatacatcaaccgttctcgagtgatcgagaaagcgcagaatctgcgacggagctttgtcgacatttgtcgtactcgccttagtcgatcttggtgtagaaccatagagacatggagccttcgtcaatgtcgaatagaattttcctgaaatcaatactctgaaaagaatattagatagaaatagccctcgagcgaacgctcaaagggtaacatgttataatataacagactagtgaattgaatgtacagaccagtgttttgtatatgagcgtcttctctcttaccgactccgaccagtcagtttgtagagtcatacactctccctagcccccagccttgtcgtcggagaatcgttctcggatgatgaggctcttggacctttgacctgcctcggttgaacaagcactgatcctagcccccagccgtgaagttgaaaaatccaatttccgattacacggcttggttaatacgcacggcgagaactcttacacgaccagatcttacatggtcttttgtctttaaaggatccgataaggccttatcggctctgggcgtccccagccgaagttcccttaggttcctcggaggccttgtcaagacggcgtaaagggacattaggataggtttcaacgctaggtgtcttctgtggtaagggatctctgggtaaaacacttggcaatattgtgtacatgatatcaactttgttgaagtagaggtaatgggagaatcgctacacctctggtcaagaaccaggtagtagtcgtaactcaaccactagaagtaaatgtacgagagatcgctacgattgactggttgagaaccagtgagtaggtgtctctcgatcatttgaagtcgtggaagtttgcggtgcgggagattgctatgtactggttcgagaaccagcgagcgagtagaatcatctctcgaacaccaatggaagttgcggtgcgggagattgctacgtactggttcgagaaccagcgaacgagtagaattatctctcgaacatcgatggaagttgcggtgcgagagattgctacatactggttcgagaaccagcgagcaagtagaattatctctcgaacaccaatgaaagttgcggtgcgagagagtgctacgtactggttcgaggaccagcgaacgagtagaattatctctcgaataccaatggaagttgcggtgcgagagattgctacgtattggttcgagaaccagcaagcgagtagaattatctctcgaacaccaatggaggtgctagagttggtttattgcatgtgcgtctcatatggctagcatgactcacgcacccaacttgtagcatatccggatgtccgttcgcaatcatgtcgggtgatcaagccgacgatgttcgcgaggaattatccgttaacaaccttttctcaagtagtccagcgattgctgtgttaacaaccaaatttggtaatatcagcatcggaagtgaagatgggatcgaagtggagtcggagataaggattgttgtgggaacatagtaaggatcggctggagtccagatcggctacgactataatcggctaagtctgaatcagactgggttaggtgatacagccgattccgacgatacgacttgtatccgatattgggtttgagttgacgtgcttcaagatgattgtcatatatggatggagtcctgagaaggcaattgtatctattaattaggatgttttgtgtaatttccttagagatatgtttagggcaaaagtctgccgcaaagacttatggtatcttagagtttgttagagataatagtcgtgtctggtatggacatatcttgtaattctcgggtataaatagaccccaagccctatgtaaattttaacacacacgttcaatacaatttcggcgcatcgccacctttttgctttagttttatttcgacgagttcttgctttcgggttgagctgcatcggtttcgatcttcaacaagaggtaaaacttgttatgatggattgtgttctcgggattagtgcttccatctttacgacactctagtcttgtatatgtaattcgtcaagttatcatatatcttacataatcttcgacaatatcgtcatctaacctacaatcggctaacatatgtcgacagaaggcagccgactaggttaaatagcgacgttgacctagattatataagatatctagcactttatgaaacatccagcggcttgattgtctagatattgttcttctttcttcttttcatacttaatgctgcatcagttaggtttgatctattaagtcatgcttagaatttcaatctctagcctgccttctggttgccgattagggtagtatcggagtttcagccgatcttatctgatttaactacttttatcttatatgctcgattgatatgttagatcttccctttatattaagatcttgctgcgtttaagtatattaagctcctgtttaatgtattctacttgctttaatatcttaatatagagtggtatcggagtattagccgatacatgctagatctatctgatcggctatgctatgaacatatataatcctattattaatatatatttccatctaagtgatttatactatctcggcaaggtgaccgatctatcccaaccacttgatttaagtatatatcgatataaggattacatatgattaatatctacagccgatcgagtagatttagttctgatttgtttactaatacttgccgatcgatgtacatatgacatcggcataagataaatggtatgtcatcggcatctagccgatcggctatcatttatagatttaaccacgaattctttgtctctatttcttgttgattacaggatcaaatcaactggcacgctcatacatccgaaggcgagctttggacctgcacaggagttaagcagatctcctaggcctcgtgttttctgtcaacaggccggcgctatgagatagttcgtcggtcttcgttggtgggttgggcgcgacgattctgcatttgtcgagatcgttctcgataatatggtgtacttgaccacagcctactcgagtgctcaattgttcctgaaaaatattttctagaagacaagacatatatcagataatatcgagtatgtactcaaaaactacatggatcttctagcattatcaggatatgacgagcagatataaatatcaggcattatgtaaaccgtaagcaagcatgatttatacgaaagaaaatagagcgagcccccagcattaaactgtagtcgatttaacattggggacactcgcgcaataggtattgtataaaaaacatgtaataggtaaacataataaattatagatctgacaatattgtatgatctgagtaggtacgataaattgtatataaaatattgcgtacctgtgaagatacatgccggatgtatctacggaattagtagatcaattaaaaattaatcttactaaataccttgtttagccttggtagccgatcttaactgtactctgaacgcacaataattagcatatatcggtggcctgcatgggccccacggtatgcatgctaatatttttgtagatggcgatgcgatcggtcggctggttggttctaatacggcaaattgtctggcttcgacatcctttgctgcggtggggttagtcgaaccatggtgaagcaccacgactgacaaccctaaaatcgacgtgatccgcggtggtgacgtcttgaagcttggtcgatctcgagagatcgaattgttgatgacgatggttccgatattgtcggaagacatactccggtcgtgttagatctccacagccgaagtcgtcgagtagcttgttgtcggagaatccatctcttaaacccatctcgtcgaaaccttgaagcaccaaaatgcccctacgtggcgcgttactgtcgacgtttgatgtctcgactacggtatttgcatggcatggggatcgttggtactagggtatacgcgagactgaggtaaaagagatggagacagggatttttatacaggttcgggcccctgaattatcaggtaataaccctacattctgttggccgaagccggtattgctcttattcatgataatcacatcagtataatatttggggtagcctatctaactgtcgtcgacttggcggtctgaaagttctgactcgtagtcgacaacagggtagcctttctcctcgaatccgtgcccggcgaaatcagagatagcgcttttgtctctcctaacagtatccggagacaccgtagggtactagccatgcttatccctgaagtcgatatccgacggcgtgtcttggcgtatgtagacttctatgttgtggcttctatgtcgattgtgttgggtgttgatcctatcccctctcctcctagggggcttgtatttatacccataggtgtccccttgtccaagtagaactagtgaaactaatatggatacaatccgagtagtcattgtcatttccatgtagaactctggttgtctatccttatccggaactcctcctatatccgaaggttgcttccgtataggacatggtatgtagtgggtcctgtcgagatttaatcaactactattaggtatgtggtatccataaccctgacaatgtgtaatactcaagtgtgtctactgaggaagcggaacatatcggattttctttcagcagtggaatacattctgatagtactctctccagtcataaggtttttgacatttagtcatttacaatagcttttactcaaacttttacaatcaataacttcgtatagttttaaactaactagaaaaaatatccatacgttgcaacgggtaaaaacgtattttcactgatatattaagagctaagcaataaattgaaatattaggatcgctatatacattataattgaaaaagttaatgagaatcctaacattgggatcactaacattgggatcactatagattataattaaaaaagttaatgaaaatatttcctgggtttagggtcaatagccttcctttatttttagccctaggcaagtccgctacctcattctgtttgtttggcctgcttcccttcgacccaaccataagtggagtcgaagcgcagctcaaagtctactaccatattcggccagtacgctacctccctccgtttggcctgtttcccttcgacccagccacaagtggagccgtaaactcaactcgcacagtctactactatctttggccagtccgttacttccctccgtttggcctacttcccttcgacccagccacaagtggagccgtaagcgcagctcgcacagtctactaccattgtcaatctcccgaagatagtcccgtggccgtacggttgccggagcaaatctctccccatcaaatctggtcgaatctttcccgatcacattttggttgagggtttttaattcactcgatcttctctttccgttttttccaaaatcagtgtaaaactctcccccatcaaatctgaccgattctttctcgatcaaccaaaattagttcagggtttttgatccactcgatctcctctttccgttttttttccaaaattagagtgtaaaacttggcataaaaacgtccggggaagatcaccgtcatcatcggcaattgttaaatggagattaaatccgatgaattaagaccgaatcgaaagggaaaataatggagaaaatgatggcggaggagtggggaatcgatttttgcaatcaaattggaggagaaatgtacaatcgatatggcggcggcgcagcacggcgctagggttcaaactcgggaggcgtgcggtgaacagatcgtgttaaaaaaccagatgaaaaaaaaccaaaaacacacgggagaaaaaaccggcgtccgaaaaaccaagcgccgggaggcgccaatagattaaaaaacggacgaaaaaaccaagcgcatgtgaaaaaaactccttcgcgtgcaaaaaaaaaaaagggaaaaaatgcctgtgccaaataaccaaatggacttttttttttccaaacggacttattaaaaaaaggttttttttcgatcagatgttttttctttatattttaccgagacagaagctctttttatcgcttttgaatcggactttttttttacctcattgagttcgacttttttttcctcttttaacagacaattgaaatttaagtagtatagataacataaaattaaaaaatcaactcaaacacgaatgacgtatcaaagtaccggcaaaaaaacatctttaatttttataatagtagagatataaatcgtacgcatgtatcttttgtcttgaaaagtataattattattatgtcattaacttactgaatttatataatacaaaattaaccaaagtttcaaaacatggatatattataatatgtggaatacatttttttctattttacgtaaataaaagaaaataaaaataatatgtgccctattttccgttcatcatcttttccccttgttccctccgttttctacggaagtgaaacgtggcgccatatcctgcggtgccttctccgctgttgcgtgtggaacggctcggacgggatccccattcctacacgaatggcgttatcgtcattacgataaaaacggaggggtgatcgggaaaccctctgggcctctccacgtcgtcgccgttacttcgaggcggtttcccttttttgtcagcgtccaaaaaatgagaagcccgcgctcttcgccttttgcagtaacgccccccgtcttatacaagattttcactatgaaccgtgagaaaagtcaaaaccccagtcccccgttcggagaaaagactcaatgaatccgttacttttttaaaaaatacgacaagtgtcagtcatttgtgtatcagactttttgtgaaataaaattatgccgcaccatgttttctatgtgtttattagttacttaaaaaaatgctcgtgtgttgcaactggtgaaatttattttaatcttattattattatatggtttaattaaaatgaaatttaccgtcggagtttgcttggatatatatatttttagaaaatcatgagctacagttaggagcccgatcgtttcaagttagtatgcgagtttttttaaacagatttcttatatgattccttctgtattatcaaaagtgaacaatattaaaaaccaattcaaatgcgaatatgtatttccaaaagcaaacgaacttaaaaaccgactcatacatggatgacgtaccaaaataccggtaaaaatatattcaatttttataataatagagatagagataggttgctcttaatgaattttactgattcggtaagtgttttttacataaaacatggttataaatttaatagactttaacttttttttttttgaaaagagactttttaacatttagtttactttagattcttttattgggtctctttctcttttaactctagtaactccttcagtatagaggacatggtagcgtctagaattgttcatagattgggccaaaaaatgcttaatttgtatagtataaacaaattagcccaaaccattcttttcactttcgttgttttgggctcaacaaaacccgtttaacatgtcttgttattcacaacatcccatgacgcggttgcattccctcaacgtcatgcctcaatgagtcccaacgttattatcccatagcaactatttccccgcgcttgacgagacctcaacgtttgcggcatcgcgctcgatgagtccaatcgatgattctattcctgcgctgatgagggctatacctctaagagtgatgtccctatacattcaggctgtgtttagatccaaagtttggatccaaacttcagtccttttctatcacatcaacctgtcatacacataacttttcagtcacatcatctctaatttcaaccaaaatccaaactttgcgcttaactaaacacaaactttacgcttaactaaacacagcctcaacaacctgcatgcctatgttcacgtggctcgatctgatggaacttcccacacatatagtgatccccgaatgcatgacgactattcctatcccctgccatggccttttgctacttctatgctctattcctttctcgtgtacaaatgaaggagcatgtacatgatttaactgatgcggtatatatacatgacagaactggttattcatgaggcggaagtattatgtgttatggttaggttcagttgagggtggttcttgcattaaagcaataaatggacacaacatgttagatacaaatctgatgaccgttcaaaattctacagactcgtagatataaacatgtcacctataccgtgtaaatggttcctaaaaatttatcttatccgtttcataatataagactttctagcattacccacaatcatctatcatctataatgttacgtcatagatgaatatggataatactaaaaagtcatatattatagaacggagggagtacttgttttcatccatatcgacaacatattctggtagcttccattccatgttatcgaaattttccgggcaaaacatattcccctatttttagcctccaagaacaaaatggtcacaacttgtaaataaacaaaagagcaagccccactccgcaaaacacacctctcctctccttccctcatattttaaccattccacccctcacaaatctcactatttacttacctttactccgccgaataaaaccaaccaacccaccctcctcctccctcgcccgcctcttattttttcttttctctcccccaaatctgatcccctcccacacgcaacacgcgaggccgcgtctagggttagggttcccctccccttcggccatggacgagctcgcggcggcgtcggcggcggcgaggaggaggtgggtgcagtgggaggaggtcgtggtgtcgaacgaccgggggaggcgcctcgtgcactactacctccggggagcggccgcgggcggcggaggagggggagaggtgagggagcttgcggtggtggggcgggagcggagcccgcggcacatgtcgtacgtggtgcaggggcggttcctgcggtcgctggcggcggcgggggtgggggtgggggtggggg

SEQ ID NO: 30996 - DNA, 17081 bp, Oryza sativa
  unsure (1)..(17081): unsure at all n locations
ccttggtcgatttacgggattgcccctggtgtgcggtgtgttggggataaaaaagttgtagccgggttttgcttttactcctatattgtttaagctggggtggatctcgcccgtcgcatcgcatcgggattgaccatcatcagcttcaccggtagtctctcctttccaaattaatcatcatatatgttttttttcgaggaatcattatatatgtttattatgctccaacaccaagataatttaaataacatcaatcaagatatcatacacatattctcccacaatgaatatatcattctattacatgatgattaatttgggaaagagggagtagttttntaaaanaattggtgggggcggtggtggcagtgccgtcgccgtcacggtcgccgctgccggcttccgcggagggcggggcgccgaggaaatggaggtcgaggcgggaggtcgtggactggctgtcctccctcgtttccggtaagatttgtgtggttttttttttttacgcctgggcggtcgattcgggtggtgttgtgcaggattttgtgttgttttgtgtgcgtttgcggctgttttgttctttcgcgtgttgtggtttgttttttctgtgttatatggtggctgatttgggaatcgtttttctgaatgttacggggtcctattccagactgcgcgcagatgcggtttgggcatatgtttttccctgtttctgtttggttcaatttgttcagggaatagcgtttttttggatttctataccaaaagaggctgtggtttctgattttctgacgattcgacccgaattcgcaaatagcgttttggatttctctaccaaaagcggtttgtggtttctgattttccgacgattcgacatgaacttgcaagattgtttggcctttagataggcggattgatttgttcccgtgaatcttttgtataacccatgcgtgttaatggagcggatctgatttctaccgtattaggtctatcagggcaggaattcaactttgcatccttttgttctctctgttgcgaggagttcatttctggattcgttgggttcaatctgctgcggcgcccttctcacctgattcgtgaggaggtagacagcttgttcgtatctcgtggttataggagaagagtacaaacgtttgcgataacccatccgcttatggtcgattgttgtatattagaaacttgttgctttgaacccggatttagctattgttcctttctattggaggggtttgattctgtttctatttggagggggaaatatgttctatttagagggcaaagattgacaatttttttcctccaaaggcaccttttttacgatataaccctcttatgacctgcctatgatttgattcggttagacatatcttatgtcagtattggaacacttatgctagttctagagttctttttttgtcaaaataactaatttatatgagttgccttgcggtttattctagaaagctaacaggattttatcataataagatgtataattcagtcttatattggtaacctgtaaatctcatgccttctccttttccataggattatggagaatacatgtgtgacccagtggaagccgctgcaggtttccctttttgggtcgattgtgtaagcatgcgttcggaaatatagagaaaatgaagcggcagcgtgagttgaaaggcaatcaggtgccattttgttcttcccttcttgtggcctcccacgagacacccatggaattaatccgtgtaaattgaatgcttccgtaatctgcccaacaatggtcaggaaatcctccaattagttctgtcgatgagcttttgtaggaactcttacggtgtgctgacgcatcaacttgtcaatgcttctgtttaaatatgaaacggccttacaaattagaagtcacctccaactctgtttgcttccaactgctcttggttttaaccttggtggtgtgcggctgtgcgtttcatcttcgatttttttttgtgttgttttcttcttgtgttgcctttattttttctgaatcacaagtgtgctactatgttttaaaccaatgttttgatgatactcctgttgcactgtcttgtatggtaaatttcttatgtctagtgcttcttttgcaggatgtaattacggatcttcttcaatgtctaataggttcaatgaaaatccatatgatgacattgagttcactgatgttgctgcttcaaaggtatagagctatttcaagataacttgcccttcatccttctagtatgtccaggatatatttctgaatttccccccattgctaattcattccatttttgtgtgcttaggatgtttcacatacatcatcagtaaggaataactcaaaagagttcacatggttaggtcctgcatggctttgcgaaaagcgatggaagcactacagatctttctgccgtaaggggattactatttcggtatgttacccactgatcattttcctgtattttgtgttgtcaccatgtgtaccactgagattttatcaaagaaatgaggacaacatgctgagatgaagtattgcagaacaataaactatgtagggttctaaatgaaactgcattatgaaaacctggaggagttttaggggaaaaagctatgacattctgttattgccctcctgtttggttttatacgttgtatttattagtactactgcacagtgatatgggagtatttcaaactattcaaaatagaagtttaaatgctaatacttgttattactctgaacctttgaaagggaaaccttggttgacacatgtttatgctatctttgtaggtgcataattttgtctacatcctgagtgaggaaaagaagaggctcatcgcccaagtggaggatctgtatgaagatactaattcaaccaacgttgtcatggtacgatggttcgacaaagttgatgaggttggtgtcgaattgccacctgatgttggtgacagagagattttcttttcccctggtctgcaagatctcagtgttgaatgcattgatggattggctgcagtcctgagtgctcaacacttcgagaagttccagagtagtccaaaacatagctattggcagccttatatttgtcgccgacagattgatgaagatggcgtcaaaccttttgatgtaacccaattgcaaggttattggagtcaagaagtgcttaggacaatgttcaatgcagcttcttctcttaaggtacgtttcaaggtcactaaaggtgcttctagttcagatggggcacaaaagaggaagcgtgatgcattcagtgaaaccgatccacagcagtgtgttccttccgctgcattcggttctgatagtctcaagaatgatttggaacataaaactcaaaagcagctatatcctggtagccgtgctgaagtcctatcacaggacagcggtataaggggctgctggtttagatgctttgtattaaagaggcgcggagacaaaatcaaggtgcgatatgaagatcttcaggatgctgatgagacaggaaatctggaggtgagcttagtgtaattctatataatctttttttccccactaaattggatctcagatcttacttgttacttaacctttgtttgcaggagtgggttttgctaacaaggattgctaaacctgatcagttgggtatacgcatccctgaaagaccaatggtgcggccatatcatgtacatagcaaggatccatgctctttcgatgctggttccattgttgatgcatggtggaatagtgggtggtgggaggggattgtattgcagcagggaaatgacagacgccttcaagtttattttcctggtaattacattcttaattaccatcaacatttcaatttgcctctgcatgacattttaataatgtagtttggagctactgaacttacatttgctttgttatttatcacaggagaaaagcagattgctgatttttgtgaagatgatttgaggcattcacgtgagtgggctggtggcaaatggaattccttgggggaaagaaaagatatcacacacctgttgccccccacttcagttcatgaagagggaggtttgcttagcaaacctgtttcacaagaaggcaatccctcttcaaaattagaatctgacaagaggtgtgatgacaaatcattgggcaccaagatttcacatgatcagaagcatcagaagcgtgttctggctgatctcacaaatgctctgaaattcgataacctgaaatggaggccaagaaagcggagcagaagatctggttccaaaaggcagtcagacactagcagtggcagtggcagcagcagccagggcgacatggaggagtccagcccctgcggaagttttgcagtgcttaattcagcgcccgatgaagaagtatgcaagagcagtggagaacctcttttcatgagggtttccaacctggtgatgtccagatgaagtcactccacgactgacatgttttagccttttctttccggatttcaacagccttggcgagatgtgagtttgatgcatccccaggttatttagtcacaactcacaactggtatcctgatcatcttgagagctctgaatgcttattcgctcggatgtccaggatgcaagcatggaggagcacactgttgtatttatgactgatctagatgagttttaccattttgtctcactttagggtcttgtagggtgttttaaccgtcttgttgtttagttggtgttacaaagatagctggctcattccacctcggcagtttccagagtcccttttttgtctttgtttcagcagtccaatatccaatttaatttgttcatcagctgttatagatgttcttatagtatactctctgaaatgataatatttacatcgtcatacgagttttttgttcttctgcctatgtggtgttatttgtgtgaatttattggtctataattgaaattgagtgtattgtcttcaatttctgctgcgtttttgagcctttgaatactagatgtggcggtaattgttggaagtcatgttggttggtgattatgtttgttgtcatgtttaaagtgtaccgatcttaccattttccaaccagctgtaccgacttcaccgggtcaaaattggcgccttagcgagctactgcttacattgcacttccgaaattctagttccattcgtgccttttctgtctgttttttcagacaactttgctctatggttttgccaggtccatggaacgcacaaactttttctagacgacattacgaagatagtagtatttgggacctgattccatccccgcgaggnnnnnnnnnnnnnnnnnnnnnntccataggaaaaggttttatcatcacaaggaagaaaaggccaacgagaagcagctaaggaaaggaccaccattcgtgcaagccagccactgaatcccagccagcgtcgttgtgaggaccagaatccgattcgattccgacctccagcagcgtccaccatgacaccaacaccccccttccctcaaagcggccagaaaaatacaacggcgagccaccggcatcagcttagccccagctgccggccaccaccaccatttccccttttgcagattcttctaccgttctctcttctccggcgagccggaagccgacgaccggtcgtcgcgcgccgccgccaagtggacagacggtgttcatgagtggcaaggtgattatggtgaattggaagtgcagagggggaatggtgtggtgttttgttgtggagtaactgaagctgtgttcagttttctctgcagttctactgcatgaccgtcaggatgagcatcgactgcaatgggtgctaccagaggatcaggagggcactcctccagatgcaaggtgaaaaaccggaaaatccaccagagattaccaccataaatattccttttggtctttgatgatttgataatgctcagtacagaacgatagcaggggaacaaaaaaatgggcatcaggaacagcatattaagcagcaaaaaacatctatcaagattctcttgttgattgtatttatttactaaaacaagcagaactgcttacctacacattcaacattggttacctgattggctacaattgatgtcctttcgcatcaacaattttccgtgcaaaaaatgtggatttcatctcacatttttaccccctgtgtatgtatgtatgtatgcaagaagatctggatagccacctgatcgaccggaagcagcagcgggtgagcgtctgcggcgccttcgtgccgcaggacgtcgccatcaagctccgcaagaagaccaaccgccgcgtcgagatactggagatcaaggagatcgacgccggcgacggccaccggctgtgaagtcgccggcgtcgcacgagatgggacggcggcggcggccgtaggaaaattctttgtaaataaatcctgtatattatagcgtatatcatttgttttaatcagagccgataaacttattcagctaacccttttaacacaaagcgagaatggtacgattgcgaatcatgaggaaagtagagaatggccagctgcatgcctgcatcagtatctaagctttgagatgaagcattcatcctcccaaagcatccaggtgaggaaggcaagctctgcaagcgtaggaacatggccaattctgcttggagtgcagcttcaggaagggcctaagtagccccaaccatatgcacagaggtggtccaaagatatgcactctcccataccctaacaacataacagaaactgaactagctctacagattcggtaccgacgatgatctcgtcgcaattgcgatcacatgactgacgatactgcgaaaatgacacaaaacaatagcagaaagcgattgcgaaatcgcctcgagaactatcatatcgccataacacggtctttcactacaacagattggtaacatcgagtaccagacagattgattgctggtgagtgagataaatgtgcaaagaagagctttgcatggtggtgtagatcatcaagaacttgagtagcttctacctccatccaatccaccaacaattgtcagaattgctggtcagtcagggtttccttggagtgccattaaagtccgcagaggtggatggagaggagagaaactaaacctgctgatggcttacggccaagacagcaaatgtggccgcacaacacccccaccatttttatgagcttgaacaaccgtcctggctcctccttttgtcacacccagtgagggttctgcaagtgcttcttctccttttggctgagattgagcaaacatgggcatggcgatgaggtgcgtcttggtcctcttctccgtctcccccgtgctgctcctgttcaacttcgagatgctggaggttgctctccatctagcgagccgcgaaaaggagctcgacaccgctgcggtaaccccttctgccagtttgagcttcctctcgaggtttaggataatgctggggatgaaccatcatcggtcgcggggccgaaggcataagagatattcagaagctccagctccagctccagcaccagtcccagcccatcaagcaagatcagaagctcctgcccctcttgttcatgtgcctcgaaaaggaatgccgtcgactcatcgcagccacattgccccagctagaagcccggtgcacaaagtgaaagatggtggtcacaccaagatcccgagatccgccattgttgctctgggtgtggttggattatgcctagttgttcttggagttgtcatagcagcattctcagtcagaagatcaaggaagttcaagaaggtgtgtacaaaggcattcaaaccatttcgtcatggatcaagagatcaaaggtcacctgctgctaccaggaaggtcagttcccaccctagcccagatccacttacactaagttccatagtacagtaccaacagaaccttccaaaccttaaacaatcatctgaatcaaagagtctatccattcagagcactattccgatgggtacagaactaatagtaagtgatcatgctgtgataaacaactcacaatctgatgaggttgaatctttccattccataccttgctctgatttatcagctggctccattacagagttacctcagcaaatttgtgatagaagagctattatgaaccgatctgagtatttcctacaaacacatgattcaccatctgattcatcatatcaatccctttcaccagattgtacatctcgtttgtctccaaaggatcaaactttcactgcttccagtcacctcagtttgcgtagcaaaacttgtccagaaaaatcagatggtgaaaatgctgaaataaactgtcatgatggattggaaataacttgcatttctgggtccatggaacatcaagaagcccctatcgaagagcgggccagaatcaatttcaggaacccaccatcacaacacatcttccctccctcctatcgtacagatacctcacaatccaaaatcaacatagcatttactatgactaactcaaaggttgaatcaagttctaaggaatcatcaaggattgagacctccagttcaatgggtataccaaaaccggcaccgcctcctccaccgcaaaagaaccctcctccaaatctgaaagggcaatgctatggccagcctccaccaccacctccattgccacttcagatacaggttggtaaagatgggtctcccctaccaaggttgaaaccattgcactgggacaaagtaagggctgctccaaaccgctctatggtgtggaatgatataagatcaagttcatttgagttcgagtaaggctatcccccctcataattgtgttcatcacatttcctattcttattatgttttacaataaagctatgctatgcagatttgatgagcagatgatcaagtctttgttcgcatacaaccttcaagggtcaatgaaagatgaggaggctatgaacaaaaccgcatctaccaccaaacacgtcattgagcaccataggcttcaaaatactactatcttgttgaagacattaaatgcaaacaccagtcaagtttgcaattctgtaatacaaggtaggtttcatgatgttttaagtaattataagttatgattatcaagttaacaataataacaatcaacttatcctcatgtctcggctgactcaggtaatggattatctgtgcaacaacttgaagcgcttgtcaagatgaaaccgaccaaagaagaggaggaaaagttactaaattatgatggcgatattaacatgctagatccagcagaaaactttgtgaaggtgctactaacaataccaatggcattcccaaggatggaggtcatgctctacaaggaaaattttgatgacgaggtagctcacatcaaaatgtcctttgcaatgatcgaagtaagtggagtcattttgcatgacttgtttaggacatattctgttgtgcttatatatattgttttatttaatagggagcttgcactgaattgaagtcaagcaaactattcttaagattacttgaagcagtactcaagacaggaaacaggatgaatgtcggaacattaagaggaggtgcaagtgctttcaaactggatgcgcttctgaaattggcagatatacgtgggacagatgggaagacaaccctactgcactttgttgtaaaagagatggctcgttcaaaaggattaaaggctttagaaaagctcaatgaaacacccagctcttgtcatgacacaccaactgaacgagaggagtattcatcaatgggtacagaatttgtctctgagctaagtaatgaactaggcaacgtcaagaaggtagcaagcatagatctggataccttgcgaaactcaatatcaaatctatcctgtgggctggctcaactgagaaatcttgttgagaaggacctagccagtgatgacaagaacaataacttcttgcaatgcatgaaatccttcctaaatcatgcagagaatactatgcaggggctcaaagctgatgaagctcaagtcctactcaatgtcagggaactaacggagtactatcatggagaggtcagcaaggatgagtccaatctgctccaaatattcatcatcgtgaaagattttcttggtttgctggataaggtgtgccgagaaatgaggggcacaaagcataaccaaactctcaatttagtccttccactcaagtgaataggtatagattaaccaactggccactaacaaattgattgttttgcatgtgaatgtttgtataacgatgttagcattaagtgtttgacaagttgactgcttgtgtatgagagtgtttctttgggagtgttagaatggagatcagttagcattaattataaacagattgtttatgtggagtggtattggcatcacggattcaaaatggatttgtgtggcatgatttttcaggcagcttttcattttggttagaatattagtgaaataatgcagaaaatgttgctcttggtaccatatatgcaaatacaattatagtaaaataatgcagaaaatgtttgcaaatattacaaatcaccaatatgacaaaccaattccaaagccagtatgcaaacacaatttgagatggctcagatacacctagatttacatactagcttaatttgtgatctttagagttatttccaagattgtaccaatgctaccaagagtgttaatggaggttaggaaccttatgcaataaagtagttttctccacaaattcaggaatacatttggcttttagcatcatatagaacagaatctgaaggaacaacaactcatgaggggcgaaaaatataccgaattacgaaaaattataattaccaaactattctacagttatagcttattgctttccataacttaatagtatcatctctccaacagtacccaacattcagaaggaaaaatagtacaaacaaccgaaaagtaatacccgatgagtgattaaagatacaaaaatggtattcgacaatagacctccataggaatcaaactaatgattagcgaagatagttgaaacttccaaggaaatcttacaaagttaagctctcaggatcctcaataatctttgcaaaagtttgcaggaatgctgccagatcagcaccgtatacaattctgtgatcagcagtgacattaacctaaaaaaatgtagatccaccttagttgtttctatatacagaaatgtcattcaaataaatcgcagataagcattaacagttcaagacgtaagatatatctgtggtgcttcaaccctacttcctaccaatgaattgatattttttatgagaacaatgctcttaatatcaggtgggtaaataaaaagactggatggatcatgtatacatataaaggaatgatcatatcatatatgaaaatcatgatgtcaaccacctaccacacccaaccaccccaaattatacacatggggtaattcgtttatcactaagcagagctcctgcctttgccactggctatcagtaatacatggggtctgggagtaaatgataatgagaactcagcattaaaaccaaaactcatgctaaattagtagcttaagagagatggttcatccacttggtagacaaatatttcggttcaatgtgtgaatttgtgaatgatcttatatgactaagcaaacagacacaaaacatactagagacgtgcttctatgctcctcggaaaaaaatactgcacgaaaattaaagcacatcaatggttcggattaaaagatgattactagggtaaaccgtcattaacgaggggccatttcgtccaggaagtaaaatcccacatcagaccaggccaatcgcaccatcgatctgggaggttgacacggcaacagggctgggtggtgaagatcggccgggcatgtgcgaggaatgggagggcgacgagctgtgcggggcgttgtttggtgcccgccgtcggcgttgagacggattatatataggacgacgagagaggaccagttctcgatcgaagggcaacgccgcagtggggaggctgcaggggcggcagaccagatggagcatggccggttcatgccacgcgcatccactacggccgccgttcatgatcatgattacgcaaactcccggccaaataaaagcttcttttgattcagtgttctcctgttctttgtactggcgaaaccttgatagaaatcccaactgttctcctgttttttgattcaatgtttttcgtccttgatagaggcggctgggtatggatatggaattttacttcctggacgaaattgcccctcgctaatgaggtttaccctgttaatcactttttaatccagaccattgatgcgctttaatttgtgtgcagctttttttattgaggagcacagaagcacttcccaacatactaatataacaatcactaatttccagtattggctgaaaaattgcatgtgtgaagggcaactaaccagcattttgctcttgacactaaagaaaccatctttatcagccaccactgtaggttttgaggctccgacagccattatgcctccctgtattcatacacactcaaatacttaggccatataccagtaaaggaaccacatcaatatttagcatcaagcagattaggagaaagagaacctcacctggccaggtggaagaattgcatcaaatctatcaacaccaaacatacccaagtttgacagtgtaaatgtccctgcagaccaccaattcttcaggtaagtacaattttcacatgtttttcaacaacgatctacaagactgaaacatcaggttccataccagagctgtactcatttggttggagctgttttgcacgagctttcttgactagttccttccatttttgtgagagcaaatatatatccaactgcatcatgccattgctcaagctattcagtgaactcatatgattcaattcctaaatgaaacgacattaaacacacagatatcctgtaccttatcagcatcctccagaacaggtgtaatgagcccaccatcgattgcgacagccaccgcgatgttgatgttggtgttgtaagtgaagctcttcccatccctgcagctagcattcaccaccgggtgctgcgcaagtgccatagctgcggccttcgccagcagaactgtcatggtcaccccctttgacttgacctaaccaaaccaaatcaaccccaacaatcaacaaaatgaccaaaatgtaataaaccatcacaggaggttaagcactgccacccccaaagtctccaaaggtatagcaccttctcatatagctcatcgagcttatcggtcacaattgggtatcccacacggaatgcgggcaccgcgaggctctccaccatgttcttgctcactgcagcctgcatgccagtgaatggaaccaccgtggcaccgggcaccggaggaagctccgcggcctgtggcacggcgccaattgccggagcagacagcggcacgggagcagcagaagcagcaggcacaaccttcggcttcggctcgatgccggcggcagcctcaacatcggccggcgtaattcgcccgaacggcccagtgccagccaccttagctaggtccaccctatgctgcttggccagcttcttagcttgcggggtggcaatgcccttcgtgccggctgccaccggcgccggagccgccggagcggccgcgggtggagaaggcggcggtggcggcgcggcggcatcggagggtggaggcgcctgctgcgggtgggccttggagagctcctgggccttggcgagggcggcctggaggtcgtcctcggactcggcgagcagcgcgatgggggcgccgacgggggcggactcaccggcggggacgaggacggcggcgacgatgccgtcgtggaacgtctcgacgtccatgtcggccttgtcggactcgacgaccaccacggcgtcccccttggcgacgcggtccccctcggcggccgaccacgacacgatcttcccttccgtcatggtggagctcagcgccggcatgaagatctcccggatcttggcccgcaccaccaccatcctcgcccgccgcctcgccaccggcgccgccgcggcgccccgccccacgaggaggcgcgccggcacggtggaggccgcggccgagagcgagacgggcgctggagtcgtcgccattggagaggtggaggtggaggaggaggaggtggaggcggcggaggcgaggtgggggaggtcgggtgtataaggagaaggtcggcgagggcggagaaagcgaggcggatgagagctttggaaactccgacgaatgctgaaatgggctggggagggccgggccgagcctgacgtcaaccccctcacctggcctctatcagggccgggctcaactttctgttttggatcgggctcgttttagtatattgggccggcccattaacccgcagacgcaagccatctgtcgcgacttgggaaaagtctatatcacctccctcgtctattactccgctctccatctctcctcgcaggcagcagggaataagttcaccagaggtccctcaacttaacagcgagattttctgagggccctaaactacaaaactagaaatcttcatccctaaactcatataaaccgtgcactcaaggtcctatagcagtatgtatgggtggtttcgacgtggcatcctagtcagcaaaaataaataaaaaaagtaggtggggcccacatgtcagtttcgttaccgcacgtagccgcgtgctgatgtcgtcgccgccgctcccacctcgagccgacgcctctgctgctcccgccgccgccccttttccccgccgtcgcagcggcggccgccattcccaatgttgccactcctgccacgtatcgccacagccaccgctgctcccgccgcacgccaacgccgacaccggccgctcctgccgtcacccatgttccccgtcgtcgccgaggccaccgctgctaaccaccacatgttgccacgtccgccgttcccctccccctgggaggcctccgcggccgccacgaccgccgctgctcccaccgcatgccgatgtcgtcgccgccgctcccacttttgcccattctccccactgatacagaggcaaaatgaccagaaaaagggtaggagtacagtacagtacagaggcaacaaccacgttggattagaactccgacgctcgcccgctgtcgccgccgcgctcgatagttgacgccgccgtccgcctgctccggccgcacgttgacatcgccgctccgcctgctccggccacgtgccgcccgcgcccggagccggtgctcacccgccgccacggctgcgctcgcccgctgacgccgccgctccgccttttccggctgcgcgccgcccgcgcccggagccggtgcagttccggatgaggagaggtgggcgccggccgccgctcccgccgtcgcggcctcacgggcggtcgcgccggccacctctctccccttctctggcgccggccgcctcttctcccctctcccgcttcttcccagcgcgccgcagtgcccgctccgccgtcggccgccatctgcctgcctgcgcgtgacggcgtgagaactgagaagttgagaagagaagagaaaaaagagatgtgggacccacatcaatttatctcactgacatgtgagtccccacatatttattttactatttttgctgactaggatgccacgtcatcaaaaccagtcatctatactgcctcgggatccaaattagatggttttgtatagtttaggagtgaagatttctggttctgtggtaaggggacatcaaaaaatctcgttgttaagttaagggacctccggtgaacttattcccaggcagcagtggaggcgagacagaccagaccgctgaagaacagtcatatctcactgacaatctgacatgtgggtcaatttacacttgtttttaaaggtcaagaggtgtaagtgattcgatcaagaataagatagaggaggcaaattagacttactccgcggaggcgtcacgaattttttgtcatttttagatttttttttaatatttacagaaataatctatcggtcaaaaaaattgcaaaaatagaccctgccgccccagtggtgggcggcaagctgatgtggcagacggcgggtcgaccgtgccgtctgccgctgtcggccaaaattgcaattaccgccttgccgcccatacagagagcggcaaggggctaattgcaatttttgccgcccataatgatgcagcaacgggggttcccgatctttcgatgagaggaggataaacttcgatttggggaaggatacgacgttggcggtccgactataactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccatgcatagctgatagtagacgacgagatctttccaacaagtactcatttgccccgtttgacctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagataaagaggttgcgctcgtacttttt

SEQ ID NO: 30997 - DNA, 17211 bp, Oryza sativa
  unsure (1)..(17211): unsure at all n locations
cagatgcaaaaagtacggccaaacgatttttctatgttatgttaatattaaataaagaagtatttattggtaaaacttgttaatattgttataaaaatgtattgaagttggttgtttcgcaatttcatatgttaagtaaggtagtattttgtaaattattcgacgtattagtactcggataattaatataggcctatcgcagtctcggtcgtagaaacattatatggacttaaacaacgagaattatgtaacatgaagaaatagtagtacaatttgaacatgatacaactattttcattgcggttacatagatgatattagattcgaactaggagggaggtaatgcaatagttgaacacaacgacgatgtagtaatgggacaaggaagcatgacagtagaaatttcaatatgccaagttgtccgacaatagctaacccctacgtgaggatccctctcctctctcaaaacgcgttttagtaactctgtattgctctggtagttcaagctacacaacacggctaggtggagttagaacccttatggtgtctatccattctctgtattgacatctccttggtggttcctgggaggaaagaatagatgtaaagcgaacaaagttagtaaatgttgtgagaaaataaggattcatgtaatcaaaatattcttaccatgaaatcgccatcaagaatatttggacaaacgttgtaggctttatggaacgaagaacctgacaatgatcaccacacctgcatcttggacgggtttcccatggagggagtgccgtagttagcacccgccagtcgctctgttgttcacgacattgtcattcataagccgcttttctctgtaagtattgctcagtactttcggatacgaaataccagcgaccttcttgtaaacaagtggttaggtcgagaacgggattttctgtatcgacccacttgatgtatgcgcaagccgtagtgcgggtctgccgaatagagtagtgttacgaagaataaagcgattgcccatacggaatgaataagcatatgcagataataaaatacctcacgatcatagttagggcacctacaaaagcgccttcctcgaatattaggattcctcaaagccattagttggcatcgatcaccgcataggcagagaggacgctggcaccaaggtggtagtaggtatacacaaggatcgctacgccagttcggatcctcaacaccccggcgtctagccattgacgaaagccggtaggatttgtaatgaagcaagtgggaagagagtactgaatgtgactgagttctgaaagattgtgaggcctcactcgttaaggcgacttatataggtgcaaaaaatcgagtgatatccctgacatgtgaacgtggcggggcatggtgggtacgcctgattggcgccgaaagttacatgcctgatcggcgccgaaagttacattggtcgtatgcggcaaatggcgggcaaatactcgtatcgcatgcgaataaaggaggatgcatcggtgcgacagaaagtagtcgtgcatgcgccgaaaggtatcgtgcacatataacaataacatagtcattacacaagcatacagtactagaaagtgaagcaaataaacaaagagaagactgctctactggccctgccccacgccgcgaccacgcttagtcctccgggcctgtgctcgcacgtggtcctgggagtaggtgaaacgatccggtggcatagcacaggtagcacgagtgtctggcggcggagtggcctgcgcctggtcctgcgtctgcttcggcggtgcgcctcccagctgtaaggggccgatgacgtcctctgttgagcctgaagcgaagtcgaagtcagtgatgtcgaagagcaaggtggaaggcaccaagcggtccgacgaggtcccagcatggtccagtggtggaccctgactcgacgtgccggctgcctgtgacgaagtcccggtgtactgcagaactgcgctgagtgcaaggtcgatgcagctgcctgagacgctgaccctgcagcctgggagaagtgggcggcctgcatcatagcgaactgggcgaaacctacacatcgacaacgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcgatcggcaagtgaaacggctcacatatatgtgcgaggcatgtacagaaaaatccttaaaaatacagctgcggagggggagtcggcctaggaacgtgcgcagctggacggggaccagtcggtacaggtggccgctgtacagctgcgtctgcccgagcaacgttgtctgcacgacaggtgagcactcagagaatcgagcgcatcgactccaccatccgcgtgtacgtcatcaggtgctcctctacgggtaccggaatccccgcgcctaaacgttggatcatcgttgaaccgtcaacgacgacccggttgatgtcgtcgacctggatggttaatttgttcgtacatattcgtaaaatttgacgaagagaaagacatgaaaacataaaggaatggtgcgatgcagggtactcacagcacgagcgaagtcctggtcacggtgcctggtgtagaggtctctagtgctcgcaacgtggggctgctgctccaagggagcgaaggtgaccctagtacgggtgcatggttggtacccgcgtaggtaggcctggtacgcctcctcagtgtgtggctctctctcgtggtccacgacctcctcggttgcgaacaaccagtcctcaataaaagtcgtcaacttggcgggccagtcgccagctgactgctgacccttgcgcgagtacctgcaaattaatgtgtcatattagtgtgaatcgacagatgttgcaaattattgtggacaggtagattttaatgcaacaactcaaagcgcagtgaaagatcttaccggtgaacagcagctgggacggtcgtcggaaacagtactggaaagggctgacggaagccgaactgctgcatcacgcggaaaggggcgtgaggctcaacgcagatgtcgaagaccatcagaaccgtagtcatccagtatgcctggtccctagtgcagagtgtggacagacccaacggcgcacgagcctgggtagccgcggcactgtagggctcccacacgacgtcagtcggcagaaggcggtcaaactccataacaaactcaagatacgaccgcctaacctggacgtgagcccatcggcgctgcaatacgagacgatcgatgtgatgtacaatgaacttagcaattaacttaacaatacgagaagatcgatgtgacgtacctgacgacggcaccacagagtacccatcatatggtagtcgacctctggtcgctccgcgtacagtgactcctcgtacgcgtgctggtccacctcagggcggccgatcgcaatcctctcagctgcccagatagaaagaaagagagggcacccaccaaaggtcgcgctgggatccgtcttcgtgcaaacctcacaaaggccacggtacagagccgccaacaacgcggaaccccagctccactgaggcacctcgcctaccacggcgtcggcgatgctcctggcgtagtgcacgagtcccttgtcgaccgcgtgcccgtgaccgccacagaacatcacccagccaaaaagccagagcaagtatgcctccaaacagcggctgtaggagtactcgtcggcctccgcctgtagctgctcgacctgcaagcgttcgataaaatgttaggcaccttaactgtggactaaatatgtagtacgcttgtcatttcggtacgaaaacactcatggtgaactgaagcagccacctcttcgtaggtccggtgttgcggtggtgtgccaacggctcgagagggagatgcggtgcacgctgtactagtgcgaaacgtgttgtcagatcgtcctgccagtccacacccgtggtcactggcccaacagcgtctcccgcgagcggtagccccaacaagtacgatacgtcctgtagggtaggggctacctcaccgcacggcaagtgaaaagtgtgcgtctctggcctccatcggtcgaccaaagctgctaggagggaccggtccacagtccatcgtctggccgggtccgcgtcgccggcggtagcctccaccagccgacacatcggtaggaggccggcctcacgcagcctgcaataacaaattaatatgtcattataaaaattattacatcacaactaatttatagtaatacactgttcgtacctctcgacaaaggagtcgtgaaccgtaagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatgtaaaacaaaagataacttgtaaaattatgaaatcgtaataaaatcatgagaataattatgtacaacaagagtacaggctatttaaatatagcaaacgttactaagggtacataacgatgacgtgcaatttaacatatatgtagagttcgataatataacataacataacataacattatgtatcgaagtccgacattacatcagcatacctaaagacactaggtgccttagtctgacgttacatcacgagacctaaagacatgacatgccgaagtctgacattacatgacgaaacataaacacatcgataagttcgaaacaaattacaagcaaagccacatgccaacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatatcgttgcggatgcgacgagtcttcctccttccagccttgtctcggagcttcgatgggtcaggaatattgagtacttcatcgttagtctctgtgaactccccagctatgccgaacccataaatctcgccgctccatgtatgatatattgcttgcttactgaactactgtgacacatatactgcatctggtatgccacactccgctgcggcagcaatgatatgggtgcatggcctgtggagcagcttctgctttgcacaagagcaatgacatgtgctgtcggctttgagaatacactcctgcttcactctcttgcggtagatacccctgcatgccttatcttgacatagtatctcaaacctgtgctgttgggtaccttgcactagagctcgatgtttcatggcctttttacgcaactcctctagctttttttgcatgaaagttccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatctagttcttctaaccaatgttggactatccgttgggagaggtccaagagcttgaggagggtcagcatcggcagtcgatggagccgctgcacgctgatcactgcatttggctgtcaactcatctaatctcttccaaagctcattgatttttttctcctggttttgattgcatagcctcttaaacatgttcatgagctccttgttcttgaattgcttgaagaaattagctcccatatgatgcatgcaccacctactctgtacatcttcccactcaccagggtatcctcattccatactcccaaactgtaactcttctatcgctcgcagaatgccagcgtgcctatcatgtatcaggcacacatttggcctcataccaacaacttttgttttaaccaatttcagaaaccagtaccagctatcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcctagggtttctttcctcgataataccaagcaggcgtggcaaattgtcatactaggcttcgtaagttccaaatctcatctctattattttctgtttggccctccaggccttggcatagctaatagtatacttgtatgtctcttcgatgtgtcggattattgaccttggtttatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccaaggacaaccatctttttccttaacacaccgaacttcatattgcgaccgattggacttggcaacccaaaactctctatgaagtgacactgcaaaatgttttaccgcctccttcatatcttctgctctactataaatcgctccttgaataacctcattttctttgtactcccatctcacactatccttttcagagacgaccagcccagaaaaatcctcactagcccattctgctggattaatatccgtctcatcatctgacgaatcaccttcctctacacgctcgttgtcagaatcctccctctccatttcatccacaatggcaccacagtctccccctcgtcggccactctacctggttgaatgcccactggagctactacgcccctgtcctctcgtgcgttgacctcctccacagaagtctcatttacttcagcacttggtccctcgccatcatccatgttcatctgcacacctggatccttcgggtgaacaaacagaaccatagctagaggccacccgcgttgcaatgcatttttcacataccatctccacactcgagagttttgaactggtattagttcccaataaaaacccttagttgcccaacttactataacattgattgttatgtcacttgtctgtggatcaactctcaagcccctcattaaccatcctnttatagaaggtacactcctctcagccggtctatcaattccccttttctgatacaataaaatctgacagatctaccccagttgacccgtaacggatgtttcctgggccatggtaaacttggaatatttgtttgttcgacatatctgtcaacgaaataactagattatattactctttcatgcaataaacatctacaacgtaatatcttcttgtgtatgccaatgcaacggtaaagtattgattccaaactagcagatctacgtagttaccgatatctgcaatacgcacttctagattagtacaactaaaaccctaaaaatataatgcatttattcaaacaaagttttaaaaaatacacactatttaactcaatagtcacatataggatctatgaatattacctgaaatcggcgtctgaatccggtagggcttcgccccttcttctcttctcctcccctttcttcttttttttcactggatttgagaggggaggaatgagggctgggagctgggcggcaggccttttataggcagcgaggcctgccgcccggccagagggcggcaaggggccgcctgcaaaatgccggccccgactggttttttttgcattcaggccccttgccgccccaacagagggcggcaagggctttcctgcaaaaaaaccctccctccgtcaccgcccgtcccttccccgtttgccacgtcagcttgccgctccaaaggtgggcggcagggtctatttttgcaatttttttggccgatagattacttctgtaaatattttttaaaaaaaatctaaaaatgaaaaaaattcggggcgtcactccaagtcgcttcttttatttgggccgggcagtttctgggctagacccattttactgttttggcccggcccatttagccgccgctactttccagcttccaaggaggccacaccacgcaccgcagctgcagctcatccccacgaccaaatctcgccgtctccgcctcgccgccgccgccgccgccgccaccgccaagagggggggaagcaacccgcagccgccgcgcggcgagatgaacaccgacatcaccgcgtcggtgaagccggagtacccggtggtggaccggaacccgcccttcaccaaggtcgtcggcaatttctccgcgctcgactaccttcgcctctccaccatctncgccgtctccgtcaccgtcggctacctctccggtacgtcctccccccacccctctctacgttccacccctgggaggaggaggcctcaattccgcgcgtcctttgcagggatcaagccggggatccgcgggccatcgatggtgacgggagggctcatcggggtcatgggagggttcatgtacgcctaccagaactccgccggccggctcatgggcttcttccccaacgactccgaggtcgcccgctacaagtacaagctgtagtgagaaactttatcgattcgctgcgttctctctctctctctctgctgctgcaagcgtttacatcttttttttctttttcctgatgatctcgttttagcgtcacttgttgatgtgcgagatgtgtggccttggctgaataaatgttgtacgctgcacgcttgtgaggaattcgtgctacaatttagctccctttgccatggtttagtggcaatttggttgccgatctggtaaaaatttatggaactgaatgtgaccccctgcctgtgaaatttggggattttgttcttaagtgactctggaagtcgtttcaggaactcaagatttgggaggttgatttctttacatgtagtggtagtcttgtggtactggccagatgcggggcaaagtctgcctgccaaatagttcgtagatagttgttgtgagaggggaattataacttgcatcttggagaatcgtaaggaagtaagatgttacgatgagggagcacagtgatagttcttgctaacctaagaatacataaattgctatgccacatttagctaagcggtctctagtggttttgctcttagtttattctctcagatgttatatacactgaaaatattatttgaggcaaggaacactcagcggtgaacagtactgcctcaaattttgccgcaaaaggactaatattagtttttatatatgtaaatctgaaggcatgatacgataattatttgattctgagtaccatgatggcatggttgaactagtttaagacgccatattagactagcaatgccatgctgcatagttgtcttattcattctcttatgtaggttagcaagatatatgagataacatatcagtaatcaggacgcataacttgattcagttgtttgtttttcatactcatctcatcccaatgcttttgataccaaatcacgtgcagtgtttagttcagagaatcggatattggctcctcctatgtctcaaactgcttggctgcctactagaaatgagttgataattgtagcatttaaaaaaaaaatcgaccgctgtcctagctttggtgatattcagtcgtggatttagaattttttttagcctaagcaagcctaatgatagataagaagtacacataaacccatataactacatagaccatttatcataggcataagcaaaaaattacagttgttgagttctaatttacaaggaaaaccgatgtacaaaattatattgatgaaatgatggccgtgtattatcttaaatagaaattatatagggcttgtattatcttaaaaaggaaaaaaaaagatgatgaatgctggacagttaggtcaccttgccttcatattgcagacatatgatgatgtaagtatttgctttgctaatttacgttgctgatccactgatctgacattctgatctccattagaactagttgattaaacatgtcaaattacttgttgttccaaggtttgtcctaagtcaaacatttgtatctttgaccaacaatttctagaaattcatatagttcaacatcataaaattaatgtttttaagatgcaccatgagaaatgtttttataatatacaattcacatgttgttaaactacacgaatttctagaaactgatgatcaaagataaaagtgcttgatttaggacaaagctagaactacaagtaatttgaaatggagggagtacctattattagtacttaactgcacgcggctcaacgcctgaacctatgatgataactaagtactgctcactgcgctgcatgtggcaaagtgacgctaattaagtattactggtcacttgatgcatgcggcggagcccgggcacctgtggcggcctgtccagggtagtcaattcctggctccgcaactggtgatattcctgagctgatgacttgttcagccaccctgcattgtacaagaacatgcagtccagagatgttgattggagagtgtgagttactttttgcttccccatgcttgatcacattaagtagttctttaggaaaagaggacaaacctatgtatggtgccagcttccatcaaaatgttttgttttagaaatgatgtgtgtgttgtaatgttattcttgcttatcatccatatctaaatcgttatgttcttgaaaaatggaaatcagaaacatagtttccaatctgaatcttttgggaaggttctagggactacatattctggttactttaagttggtataatttaataatatagctctttggcgtcctagaaagtatcataatttcatatttagtatggtaaatgaaaaatattggtggaatgaacaaagaattggtcaaacagaggacctcacactgattgtttttggatttgcatgttgcttgacaaatagaagtataatttacccagaatgcctccatctatcttggaagatttggtaaagtacggtgtcacttctatctatgctgaatgcctgtatgtgtgcaacctgagtatatagttgtatgctgtatgcctgtatatgcgcaacctctatgttgttgcagtagaacgtttgagaagtttatctgaaaccaattgttttccttttgctacataattacatgagcttgtgactccgttcttagttaaatgttgcaccattgttagtaattaatctgcaggtaaaaatatgaccaggaagtcttctgaataacaggtgttatgagactaggacgatgacattgaactctggaatttactgcagtaaaccaacgcgtctattagtggatcatcggattcgttccctgtccctcccacagcagtagaggcgtgagatgacatagaacatccgcgctcatccctttgccctcaagaacattgcagaagtagacagtgaacacagatatagggtggggctctctctttattatagatttcatttggagtacaagccagccaatcttagatgtctcgccctgcccttatatatataggggtcttaggaaggaggagatagatcttacctctactccgtttggattagtccaaaaaaaaaagatcttatctccccgggagataatattccgtaacatttgcatctaccaaagttagctgcatagtttttctgtatttgctgatttgcattttgcagtaatttcctcttggcacaaggttttggcttctacattagctttttaattagaggttagctatgcgtttatttcacaagtcagtgcggggggcataatttcaaaacttattgttcagtgtttgagaaatcagcttaatatcaaacaaattgtgttataaaaaattctgcatatgaaatagagccctgttttttttacaaacattaacctctctaagctgcgtaggattgctgaaatccttattatcaacctggtcagggaagaacgcaacgacccacgaaattcgtgggctagtttaggttcacttctggccccgcagagatctttgcggcccataaatattaatggaccgaaagttccggttggaccaaaatacagatggtccaccatgaagacgggctagattaggtccatatatataggtgggccgagaataccgtatgggccaccagttgacctagctagtggacataaaaggatggtttgtaaatttgacttcccgttcaagttcagggctacaatttgggagttttttttcatttttattttttaatattcacagaaatattataccggtgaaaatatttacaaaaatagaaatattaaggtgacgtggcatatggtgccatgtgtgtattttgcgctgaggtcatatgcaattttcgccgcatgcaaaattcgcatgcccgctcagcagcctccaatacctggtcacacaagtcaccctgccaccctccccgagagcggcagggtttatttctgtaaatattttcaccggtataatttttctataaatattaaaaaataaaaatttaaaaatgaaaaaaatctacaatttggcgcatgatatccccgtggattgggctaaaagtagtaaggccgaggaaaaagctaataactggataaataaacaagatgggtaccacgcgcgttgctgcgggagaattgtgtgataatataatatatatatgagttctaaaattttctttcttacctactatacaattttttttcatgttttatatatttttatacctttatcaattatccaaaagttataaatgattgggttgtatggtgtgccttttaggagaaagagatgcaatttgcaagaaccgcatcaatttgcgtcaaaggtcctagatacataactgcccaagatattatcttaccgccttgatgaatcatccaaatactaaaataaattgaggtgatgtgaaaagaagcaatttacacccttgatgaataatccaaaggctaaaaataattaaggtgatgtggtttcatgagagaagagagaattagcattaactatacttagtggggataaactttatagatatataggataattccacttcgattttcttaactagcagccgaatctgactcatttacaatagcagatctctcaacccccaattattaaaaccagtgcaatttgattccctcgactgttttggaatttggaggatagtttcgttgacgtggcggtgttaacatggtattcatccaacatgacattgacatagcgcttatgtgacattagaattaaaaaaatatgagacccatttgtcatgtaaaaaaaagttatgggacccactaacatgtggggcccgcataatcatcttctccttccttcttcctcctccctctctcttccttctctctccttctcacatagctggggctgagcggcggcggcggcaagagatggagcggcagcggcgggtggaaaaggagctaggtggcaaaatcaaacagtgcggcgacgaggaatggttgcgtgccctgagcacaattccgaagggagacggcgcgcggtggaaggcatcggtcatcgaggaagatgggaagcgtgctccacaccgcctctcctcgtcgccgctgctccacgctgccgctcctcttccctgctccccatcgtcggtggaaggtgtcggcggaaaccggtccacaccgctgctcctcgccccctctgctccgtggagccatcctcgtcccagttccgcgctgccgctcctcgtcgttggtggaaggcgtcaacggaggcgccgcgagttaggatgagatggaaggaaacctctgctagaacggccacgtcgtcaacgcgtggaccgagcgcctgatctactcctaactcattccaacaccatagtttggtatgccactactactttgctctctagtgccgccatggcgccattgccaagaatgccaccttactacgtgcttgtgaccagggtttcccttatcgtttggaggggggttatcgcacccctgctataaggcggttactgtggtaaccgctgaaaaccgtgttaatttcggcggcaaacatttgaattaaaaaaaattgatggtttcgcggtttggttgcggttatcacacggtttgacacggtaaccacgatatttgcgcggtaaccgtgagttgtgtagccgaatagaataatgctaaaaaaattgaaaaaccacctaaaagtagaaattagggataattagaagaatatataggatacttgtaaacctaacttttggatgtaaaatacagaaaacgggcatgactttttctatattatggagatattttctcctctattgagccggttgcatggtacaacttaaggcccaatacctttttttattttttttcattttctaaactattattcattttgccctcaaatatgattttattttactctttttcaaaaaaaatcttcaccatctacctttttttttaaaaaaaaacaagaactacattcatgctttttttttggaaatgttgaatttggtcaaaattccataaaaccctattgacggtaaccatcatcgtacccctgcggtaagcacggttatcgtgctaacagcacagttttcgacggtaagggaaaccttgacgacaacctacggccccccaccccccacagccttggctctactcaactcttcatcatggatggcgcttgcatgatccatgaccttcttgcttccatcaatgtcaacgaactaggtcgggcagggagggggggggggttagcggaggctaggggccggaggcggttgctacccgtggcctgtcgacaggaggttcccaagctgtcactgtagacgtacaccatcatcacctccacgtggttgcaactcttcgccctgctggcactggcgagctataaaagttattgcggaggatgattcatgggagaagaaggggagcccgccgcggattaccggagctccttgtcgctgacctcacactgccactgcctcctcccgttgacgggcttaccggccaccaccccagcggtgaactcctggggaagagtaggagatgagaggaagagaagaaatgaagggagggaaagtagaggaggccatttacatgtgaccctcatatggtttttctattttattcttactgactaggatatcatgccggcaaaaccacatacccatagtgttataggagtatgacctaatttgacccggttttaagatttccggtattgacgttacataaagtttgagggacgtgaactagacttatttcttatgtgaatgggctatatcgtttcgtttgtaagccttccggcccatcttctgaccagtcggcacaaaaatgggctggaagcctctttcaaagacgttccctgtcttcgtcggcgacggcggcggacgacgccggcggcgagtaggcttccagcaaataccgcggcctaaaccctagcccactccggcgatgaccaggtctcgccccaccccacccgctcgatgggggcgcccgctggatagaggagcagcggccgaccagccgccagtggcgaagctgtcgccgccaccgattcgcgcgccgcggcactgttcccacctagagaatcgcgctgttcgacctcgtcaaccacgacggcgctgccccggcctcccggtacaccctctccgtggctttcggtgacgagggattaaggtattcgttttcgtagttcttatctgttctacttttttgatagtttgatgcacatttggggttaggatgctgcccaccgcgagtgctgattcaaagctaacttactgaatttaaaatgctttgccgacaccggacggcgcagctgagcaactgcggcgccggttttgagagactgggaatactaaattggagtaaatatcccactacgtgagctgaatgcatagggacgatgggagacttgttgtttattatgtgctaaatcgccgacttaatgacagttcattagctgttggccacattagctttaaaactaggaggcttagctatgattttttgttcacttgttaattttttcaagttatgcgcctttttgtgcatcatataatttagagtaattgaaaagaaatgtggtctggttcgttccttcaattcatcccaagaaaaggtctcgcaaagataaatcgtaatgcgtgtatcttttgcagttgggagtgttctgtccaaaagatttctaatcatcataactagcccaactaatttcccaaatcgcgaaaaatctttcagcacttcataaccatcaactacttgatacaaatgtgcaataatatatgtcctctaaagttaagtcctattgttaacatatgtcgaaaagctttccttctttgcttaaagaaaggtgaaggcatggaatgttttgggagtatcaaacactctctcacatcaccaataatgcaccattaaaaattcgtaccatcaactgttgcccctgtattaggacacccttagacatttgcatcaggaacctgacgtgggtgcagaaaattatattaattgtttagcctgctgttgttgctgtctcagttcaaaatgctaattatcagcaatttgtctacctatatttctactaacaacttgtcaaaagttaaaagtaaagcattactcacaacaattgcattggatcatgcattcaactatggtatcaagttgatgaaggacaaaattatatatgattcaactttctggagctgagtctgacagattgaaaagccataggaaacggctgccagttcgcctgtttgtttgtccagtgattccattttggtgatgtttcatataacccaatcaagccacattcacgaaaaccacatatgttttgatcttgggaacttgttgaagcaatgatctggttatctgaatctatgtaaagcaaatgcactgagataat

SEQ ID NO: 30998 - DNA, 3541 bp, Oryza sativa
  unsure (1)..(3541): unsure at all n locations
caactgtggtaatagatgctctttctggattaatgtaattactatggtgaattggcagatgcacattaatcttgtgagtttatattctactgctgattcagatttattcgcttgtcatttggattgcttggttttctgtgattcgatcttgcaactattaccatccattctgtcaggtgcatgatttgaataactctcctgctagattgaaattaaatttaagagtacgaaatttgccgtttcaacttttgatcggcatggcaagctctcatgcattaggaagggacaacctaataaaaaaaatcaatgtagtgcctcatcagcagcattaatgaagtatgcacattagctgtagctgcaccattggactttgacgagtcaaattgtcatttgtgaactactgtaatcactgttttccttttctaatgaagctgattgagatccaaatgctcgtgatgaaaagcacagcatgggatggtgcgccctgtttaagggcagcatgatgagcagaatccaataggtgaaaagattcggcaccatggtgtccctcgcacgcagcttcagcgaagctgcagccagcccaaatagcaagagtaaacaaatgcagccaagtacacagtataggtacatgtcttatgcatgtgaatttgttattatcaatttaccatgttccaacacctgttactactattaaccatgactggtgattgttggctttataatgatatttatatgacctcaccctgtccagttagaaatatgtctgatttagtcagccccaataagccacagccaaacaatatagtttggtattacccagtatcacagtataagtctatcctcctggcacacgatacaagtccatcgacaaaaccaagaggttatttaaccacttgatttttcttcaggtttttgcacgcacaagatcatacctaacgtacaggtacaaaaatatttttataagagccatctatctgtctgtcagtacctgtttctgctaattattagttcttgcttattttttttctctgtacacaaagccagtgcaaattaaaaagattgtactaattttaaactgggcagcatccaagcagagtgaagctactccacgcaagtgggagttttttcctgtcagcaaactcaaacacattggaattaataattgcatcctattgttccctgttcccttccttgtttttccccccgctgcctcctctcctcatatctgcccattcggttataaaagtagacctggtctcgtcccctctttgcaccaacacagcattcttcctgctccagttctagtcttctagggttagaagtgatgagaggtcaagataagctgtgggtaaacaagctcaatcactatggtgtgggtgtagagatctgatctatatatccaggtaattaattaaactaattacgttaagtttactttcgagccatctgtgatcttggcatgactgctggtttgcagctatggctttcaaaagcttgctgtgtcaatctcctagatctaatggttggcacagcaagtatataacacatattttggtttgttcacctagatctgctttcctttactgttccatgtcaatattgatccttgtggaacatagaatataaggggcagcacagatcttgttaaattacatagtgtgcttgatctgtggtaccagtttgattttttctgatacatgggaatctcatactaaatgccaacgttacttttcctttccaaaaatcttgctggttcaggtattatttacatatcaggtgcacttaacatgcatgtacgcttgatctaccaaagatgtcttcagcaagtttattaccatctatcataaaaaataagtatattacaagatgcaacaaagcaaaggtgccactatactgcatatggaaccttaagtgaagtcacctcactgggggttttagagttggagatgcctccattgtgtgtgatgcatattttccacttcggatggctaataaagtaataataacatagcaaaactatatttgttattgacaatacttgacacttgattgtgctaacatttactagttcttcttgtaggttttgtaaccaggggcaataagctagaggcagcaactgcataacttgcgagaaacttgtaagatttctttacaacctatggaaaagataggtttacttgtcttaattttttgctgttcttgttaactaggaaaccagaagaattattaacaagagagaatttataacaaacaaatttgatgccaattctatccttgactctttttttttctattttttttatctcttgagtcatctagtcatttcactgtttgaaagttgggaacatctgcatcacctaagatatgatcctacctatccctgtggaatgtgttatctgtgtgttcagtttacaggctgtgttactaaaataatgcatgtatttgtgagtagtagtgttctgatgtgatgaccttcaagctagacctccacatttgcgagaactttcaccatcaagacaaaaaaacatgatgaaacaacctatccaatacatataaagcgccataggatgaactcactcataccaaactggcactctcatggtatggtatgacatgtggaaatgggtatacgcatgagatctcccggaactgaattcactttgatataataacaccttggcatgtaatagcattagtaaatgacgtccaaggaatattagagtaatcatagcgttaatactgtaaaaggaacatattacttgtactagtccttgattgacattcagggtctgtttagttcccacaccacaccctgtcacatcgaacgtttgaacacctgcatgaagtattaaatataggctaaaaaaataactaattgcacagattgcgactaattttgagatgaatcttttaagcctaagtgctccatgatttgacaatgcgggattaattaggcttaataaattcgtctcgcggtttactaacggattttgtaattagtttttttattagtgcccaaacaccccatgcgacaccctatataatatccgatatgacacgctaaaactttacacctctagatctaaacaccccctcaatacgtactgaaacagctaccggaatccagaagtaaaactttttcacctgagtatcacataagctcagccatttcgctatggtactctaaggtctaaacatggcaaatagtctaagtctgtaacaattattatagatatcagtacaaacaacttaatggtgaggagacagttatatcatgattttcatgctgattattattcctatatatgatgtgcttccttcaggttggatgatgatcttgccaatgattttgccgcaagttatgcagttgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 30999 - DNA, 660 bp, Oryza sativa
ccgtagctcaaatgacatgtgtgtcgacgtttaatgtctcgactacggatttgcatgggatgggaatcgttggtactagggtatacgtgagactgaggtaaaagagatggagacaatgatttttatacaggttcgggcccctgaattgtcaggtaataaccctacatcctgttggccgaagccgatattgctcttattcatgataatcacaccagtataatatttggggtagcctatctaactgttgtcgacttggcggtctgaagttctgactcgtagtcgacaacagggtagccttcctcctcgaatccgtgcccggcgagatcagagatagcgctttcgtctctcctgacagtatccggagacaccgtagggtactagccgtgcttatccctgaagtcgatatccggtggcgtgtcttggcgtatgtaggcttctataatgtggcttctatgtcgattgtgttgggtgttgatcctgtcccctctctttctaagggggcttgtatttatacccataggtgtccccttgtccaagtagaactagggaaaccaatatagatacaatccgagtagtcattgtcgtttccatgtagaactctggttgtctttccttatcccgaactcctcctatatccgaacgttgctttcgtataagaca

SEQ ID NO: 31000 - DNA, 38422 bp, Oryza sativa
cactgatctaaaagtatgaacaggtataaaaaatatctacaaattacttacatgaagggctcattaaaatggcctccagagtgatgagaaaaacctccgatagaattctgcgtttaatgagagaaaatcattaattaggcacttgaagcagcaacaataatttttcaagtaaatatcaagtaaggatgagagttatactaatgaaaatgtccaacatttttcatgggtgttttgccatcatggtactattgttgcactagtatatataaactataaaaacttatgtgagccacaaagtctaaagcacagtaatgcataagtaaacataaatggtgatatactgatagatgcagaaaatatattgttacagaagatttagatgtccttaccgcccatgtcattaacaggctcactttcgcacggtctttcccagtgttcactagctataataaacacagaaaacaaaaggaaggatggtcatgtaatttcatcaggttgagaagattaagagcatctcttcatgtaaatacatatgaaaacttaatgggaacattcaattcagtagaatattcattaatcagtaactcctcaagtaaacagcatgtcccatgatctaagaacaatcactgtaattaaacatttttctatataactgtattctgaaatgttttgacatatatgttcgcaccaacaatattattttaacagtgaccatgttaaaattctcctgtcgacataaaaaggcagggctctctctaccttatgatccatgtcagaactgttacatgtggaatatcttggctgaagttgccagaacatatttcttaatataaatgttattgaaccagtatcagattcaagcaagaattagagcgagacatggttaatcccctagttccacaaacctaatcccaactgttatcaacaccgatccacatgtatattccatgatattatctaaaggaatatacttatcaggaaatatgaaataaaaaaagatgagggaaatataccagctgaagaacctgccagcctagcataaaactaactttatgagtcacttacagtgtacacaaagacagaagttgggaggctgctatctttgtaatcatgaggaatgaatggtgatatctgacgacatgagattttaaggtctggatccggttcacctgaatacacggaaaaattcataagattcttaagttcaaaacatgtctactgctactaaaaaaagatatccatcaagttcataactccatataatagtattgaaaattaattatgtaatcaacatataagctggcttggcataaagcatatccatctcttggtagaaaagagaagtgtttgtgccatcacaagatgcaagcaatgttccacagctccatgatggcataccatcataaacagtccatgccctaggaaataaagcatgataggtagaatgttgaccgctcaagttccagtcccatgaagaaattccagagtcattacatttcctgaaatcaggtaaggcatcaaacaagtgcactctatatcaaatttgttgagtcataactgaagcgtgattgcaacatatatataggtacaataaactagaattctgttcacattatgcacagcgatgtttgactcttgagtcacaaatgtacaagaaagaatttggtatatatctcacactctctctgctatataatatgcaagtcgatatttgaaataaatttctacgcacagcgccgttggcttttgaatcacaaattaaaattaaaattgaagcgcaagtcacttatataaagtatgcaaagtggatctgcatttcaaaaggccacatactatatgggaaacaaggcacatcagaagaacaaatacaaggtaacaatgtatgcactatacaattggctgtgaataccattcaatcaacaataaagaacttctgcaagttttaacttcagaaaagcaatgcaaaattacaaatctacttgttgaagcttacccttgtgcaagatacaggattgcagaatgacgagctcagaagctcagacttagtaaatttggataaactaaagaaagactgttatttgcaatataaatgaagaaacttactttaaaccttcatggtgtccgggagacaataccgatgagtactttttgttccccccatcgcgagatacaaatatctagaacagcagggtactatgtgtcagttcaagactctcaccttagttgtgagaaaaaaaataaacaagcatagtgactcgggagtactaagtcaaaagattcaagattttataaacagttgctgtcataaatcttgtatggagcccctgatgggcttgattgggtggcccacatccatggaagtttatatacatcgataggaaaaataagtgtgtaatagctggcgaattgacaagaacttgctaactgattacaacactcatcaaaaagtgtcacaagcagcagatggaactcgtccatccacaaacattaaacagtggaaacagtcgtgcctttttatctcaacaaaagtccccaaaaacactccactcaacagttgatttcacacttgagcacagccgcaacaacaaagatagcacttaaaagattctttttgacgcatatttagtgaattgccataatatgagtatgtgagacaccagtgaagggtagatgtcataagactttccccaaaaataatactagtgactagtgaggggctaggagcattttcagcagtcagaagaaaatccttcagataagctagctaatggtccaaaaattcaattatgcatcaccataaaccaagttgattaaccagcaacagcagaaagaagaagaaagcattactgaaaactggttctccatgaccggggaagtctcacataaaccaggaatgatatgccaattcttgaactctcccctgaaacctcttgaaatgctaccactcctgcaaaaccagtgtattggtatcaaaattacagcatccatagtgcaaatagacaagcataaacatgagattattggaggttaaaacatcaattcaggcggacacaccccatcccaccaagcggtacgccctgcgaagcagacggcttacatttctctttggtaaacggatcaattggagctttctgcaagcatagcagaccccattttatcaccacacacaatttatattcatagatgtttggtataattttagataaaaggaaattccattaagtaatgaaatataaatagcataagaacagccgatggtacccttccatgagaagcctcctctcggacatacgaccatagcctcaggccaaggctcatctgaaatttttcacattccaaaaaacaaatgattagcagatagcagcattaaaaaggaaacgacgcaggtgttacagaaatcaaactgcttgaacaacatgcagagaaccaagcgttgtaacataccatcctcattgcttccatgaaggtgacgctgaattccttgagtaagttggcgtggctgttcagacgccgccgccatgcctgctccggaggcgacccgccgtcgaagtccaactgcgaaatccaaagcatccccagcaaaatcaaacacgcgcccacaggaagcacaagcccaaaaggaacaagaaattggactcaccaactgcagggcggttcggccgacgtactcctcggccggccacgagttcctccggcagtggaagaggttgccgctcaccatcccgtctcacccccaatgccaccacgcccccgatccaactcccgccgatcggaggcacgatccacgaacaaatcccctcccgcgccgcgccgcaatcatgcgcgcggatccgatcccccagcgccgcccctcctcctcatcgcgccctcctccgatccgatgccgccctctgctcccctcccctccccacctctcgatcgattcaaccaaaccagatcaaaaccaaaccgaagcgggcagcctctcgcggagaggactctccagtctccacccacccgcgcgcgccgccgcgggaggcagttgctccacgcggagacgagaagaccgcgaggaggtcagcggaggaggaggctggactccgaagcgaagcgaagcgaagcgaggcgaggcgaagccgcgggaagaggaaggaagagggtggagaaaaggaaggtggttgcggttgcggcggtggcggtcggcaagggcggctgtgtgtaggcagaacgcaggcaaagcacggacgcgcgtgggggaagaagaaatcaaacgggcgtgtgcgatttattgcgtggccgtaccaatttccggggagtccgtccgttgcccatgtttcgtcgtcaggtggtaaaattgttggcgataccccggtagttatcctgcacggttctttattactcactctatcccaaaacaatatcaatagttttgagtttttgtctataattaccattcatcttatttaaaaggttatgaaattattatttattttatctgtgatttgttttattatcaaaagtattttaagtataacttatccatttttatatttacactattttttaaataagatgaatggtcaaacgttaccagaaaaaatcaaaactacacctaatttatgatgggttattattattattattattattattattattattattattattattattattattattattattattattacctccacgaatctgtgctgaagggtgaaggttacggatgaagaggattggaatatttgcatcttttctttgcgaggaaatgggagtgggaggggggaataatttcgtgtggatagtattttgtgtcaataaacccgtggtgacaagggttatgtgtggttatacatcaataaagtatgagggaatatgttcatatttgattgatattttaagtttgcgtatgctgcttgatgttagccttagacacacgagcataatgatggtgaaaagggtttcaaaaggatgccttttccttttatttgctctacgcttcgaaaaattaattaatatatttcctagaagaaaaggtagctcattatttacacctcttatctaaaattatgtttatttcttaaaatatttaatttattcatataataggtagaaatccacaccaataatctaaaataaacatgatgttaagtcaccaatgacacaacggcacatattcttaacgttaatatatgttcaacatagtttatttttcaatactaatttttaagttataaggatagatatataaaagttttggtctccaacagctgttttagtacataactagcttatagtcaaccgataggcccttctatcttttgtggacacgtgattccattttatttacgatcaataactaaattaagcgtaactgtgcttggctatatgcctatatccaaaatcattatgcaatcacattgttgcatataatactgtactcattttccaaatttggagaagttcccttcatacaacaaaaaccagagctattggaaaaaacaactgctagggtcgtttgagcattttctcatctataccacttgctatacactgcctattttcaacttcacaagtcactgttctagcatcagtgtgaaaaaaaagggtatttgtgcatgcttgtgcaatctcaagttaaaagtcaattgctaacatctacatatacatataactaaaccaacccacaaatagtcaactgatcatccaaattattatttctagtataggctgtccctaattttatttcccttatatatagagttccttcagaatatgtccctgttgcgaagacacatctactcctatcagaagagaaccagtgcgtgctctttggcttgccctttttccttttcttttctttttttttttggagagaactcactttcggttagtttcatgatcttgacagcgaacttatttatcaaccgacattttatctttttcttactcacatgaatttatcctgtgcttggtagaacgacgcgtccgggttagaaaggattatcccgaaacagtgactgtaaaagcaagtataatagtgagctataagcctattataagcttaggtggaggaaagagatagtgaaaaattaaggatgttggctcttatgtaagagctagcttatcacaagctccaagacaaatgcattaaatgtataagtgagagataaagagatgagaagaaaattgtagccaatcttatagctaatctattatatatgttggctttaagatgggctaatagtagaaattgggctttattattatctaagttgctttgttttcgagcaaagtagccttgatggatacgcatctctgacgttcgataattaaaggatgatatgtactttcttaaagactgaatgatactagtatgtagagtacttaatgggacactgacatgtgaaattgagcccaaatttcatttatctatatggagataaaggctacgtttagttcatacggaaaaacttttcacattatcatattaaatgtttggatatatgtatgaagtattaaatatagaaaaagtttaattacatagattgcgtgtaagataagaggcagatttttttttctaattgctccatgatttgacaatgtggtgctaaagtaaacatttgctaatgacgaattaattatgcttaataaattcgtctcgcagtttacaagtattagtctatgtttgatactttaaatatgtatccgtatatccgatgtgacacgccaaaactttttacccatattacatattcctctgttccaaaatacaagtatttgtaatattaaaaaatttgtatagatcaatctaagtatttctctaatactaatttaaatgcaaagaaatccaaacattttcaagcaatcagaaggttaggaatgaaacataaggcgattcaaaatttgacaaactgtgactaaaaaggaatattcaaacagcctaaaaattagtactgatgtactatattttagattaaaaaaatatatattccattttagacttgaaatttataccagggatttatccagaagtttcaatggtcggaagttgtcccgttcagctggctcgaccgagaccagccaaaaagaaaaaagaaaaagtactactagtggtacgaaaagtacaccaggaaaaggttgggtgaaccggggcgccgtccggtgtccagccatgcagccatccacacccttcccttccgtgcacgtcgccgcgcgtggccgctgccacgccacgcctcgtcacgggcgggtgccgacgcgccgccgccacccgccgcgcatgcgcgccacggcggcggcgtcgtcgccagctcgatcgctcagtactttgccggcaggcaagcgagcaaacggccggattgacccctgtggtgttcactgttcagtaaataatgccggcgttttgcgatcggtggtggccatcaatccctcattttctggattagatatggatctttgtataaagtcgatgagaaatgagtaggagaggggagagctacatactagtactgcttattattcagtcatgtaaagggatttcgatatatatatatatggcaaaacaaaacttgttatttgggttaaacgatcgtacgtagggctgatttacggcttacggggaaggaagaacgcgggcgcacaacgtcggcgttgtcgacgcaagaaaccctggtggtggtggtggtggttggaatagctgaccaagcggtaactagtactctaccaagtcgaccgctaagtccatcggtaattgttttctagaatgaaatcagcagaaaagtactgctactattcaaacgacagcgacacctgggacctctcggatctcccccggccctcttccaaacgtcattttcgagcttttcctcctcaaaacgaccgcgcggctttgcactttccgatcatttttttaccattttatctagggacggtctatacgtcattcaacggagaacatatttaaaaatcttacgaattttatatcacaagattatattaagattcgtgcgagtaagcaaaccttaacaatctcctcattctctcgactccggttcactaataccaacacattctgcgtcgccgtcgccgccgccgcccggccttgccgactagccggaagacatcaacgcgcgccagcgaggccccactgaagagcctcctctcgctcccccctctccttcctcgagccatcagtggcaagatgccctcgccctcgtcgtcttccgcttttccggtggctcttttgttatcggatctgccaccaccgagctctacaagctcgctatgcccccgccaccaacaccggcctcgtggcaccgtcacctcccacgatcatccctctaagtcgacgacctcccattcttccccttccctttccccttctcctcccacctccacttcaaccccctaattcatcggtcctccatcgaaattcgggttattatgtaggcaaaatttgctacatggcatctaaaatttgtgtaattggtcataggagaccgtaaaattgtgtgactgctaaaggacatcaaaaaacggtgtaattggctacaggacgccgaacacattattttataattttcaaggcaaagtagagagagaattttttaaaaagacaagtttacccctgattaccctttctccccatggctatgaggaggcgacggcagcttcaacggtggcgagtggcagtgcaagcaaagcagtgacctgctgcgatgggcggcccgcacaggtggacgtcagccactagagtaacggtccggcgctgggcctgtccctcggcagcggtggaggagaccaacgcgacggcacactgtggtggccgtattgctgcgctggagccatcgctgatcctgagcatgcttgacaaacgcggcagatgcagctgcgacggtgaccgtggccctacgcattgcgtcattatatagctgtccgtcggcgtggcggtgaagtgggagtgtgtggaggagatcaacggtgagatggtgtcgtcggcggacggtcaggcgagccggacggcaacgactatggtagcatccgcaagaagctccagtattgatttgtatttgttcatccacacagcacggccaacctggtacatcacgtatgtccacgcgtttttttacattgtattgattggtatttgatcatcttttgttggttgaatacgtgcggatcactaaaccagcgctttgttttttcgagcagaagcagaaagtccctttttactcgaaaatcaactgatgctcaggccaaggcaggggcaaacttgtatttctttttaatttctctctcccctttttactcgaaaattataaaataatattcctatagccaattacactattttttggtgtctctcggcaatgacacgatcttacggtgtcctccagccaattacataaattttgaatgtcctgtagcaaattttgcctattatgtatgtggaaaaaaaagaaagttgttggagttgaataaaaagtacatgtaacataaatcacgaaatatatttaataaatcaaaatttatatggactttctgttgaaagaagggttaagttaacaactccattttctttttttaatggaaaactccattttcttcgtcacacaactagcacacacaagcacccaattagtggatcccctccgcttgtgggtaaaaaaaacgccgtgagtttccctcgcaccgcgtggccaccccgctcgcccagtgccgaccaggtttcacaccgcgatctctccagagggagagaggaaaaaaaactacccgcacaccgagacgctcgtgagtcgtgtcgtgtcgcgcgacgcgccgtgccgtgacgtctcttcgtcggcgcgccgaccccgcgagcgccgcgccgccggaaaaacgacgtcgtcacgtacgcgcgcgcggagtaccctctcacaaaagcgagtgcttcttttttttttccttttggggggcgtagtggcatctgcgtcgtctcgtccacacagcagatgacgggacgagtggtggtgtggtggcgtccaggtccatcgcgtgcaccgtcgacaacgacgacgacgagtccttttcttctttattactatctccatattttaatatatgtcgcccttaattttttattctatgtttgaccatttatcttattaaaaaaatttatgtaattatcatttattttattatgacttaatttatcatcaaatgttctttaaacatgacataaatattttcatatttgtacaaaaaatttaaataaaacgaatgattaaacgttggtcgtgaatttaaataagtatctcgcacagtagtataattgtagcttttttttggtttatctcctggctgagctctcccggtttttgcgcccctcgtcagcgccagaggacacgggccactacatttcagcgtcttagccctttatttcttttttctctcttttcaatttgttctatattacactgtacttgagtgaagaacatacgtaaaattgcaatccactcagaaatggcacggaggaacggacagaagaagcgacgttgatgtgcggctgtttctctctgtccggggactacaagtgataattgggggcgaggttataatgcattgctcgactgacattgacaagtcccgaaaaagaaacggttacatgttcgttattgcgcacgtccacattcgggaactgatcgatcgatttattatacgtatgtagccacaaatacctcacgactccactcccttccttccttttaacaccatctatcggataaacagggaagagcaagctagaagctaatgatagattttttctttctttcttttcctcccatttggagcggcggccaagagaatacacatactgtaacaacatctttttcgtcgaatactacatatgtagtgtatagagcatcaacgtgggtacaaaaaggaaaggaagcggtgcggcattggaagcaagcaaggatcggaagcatcccgtgatcatgccatcttcctaacctatatattcgctattatatactccctccgttttaaaatgtttgacactgttgactttttagcacatgtttaaccgttcgtcttattcaaacaaaattgtgaaatatgtaaaactatacgtgtacataaaaatatatttaacaatgaatcaaatgatatgaaaagaataaataattatttaaattttttaaataagatgaatggtcaaacacgtacttaaaagtcaattgtgtcaaatattttgaaacggagggagtatattttttattcctaatgagtggatcgctgattaatctataatcgtggctcaattagcctccatgagagatgacagcgtcacggtcgatcgatctccgtatcattcaagcaggcatcgcacgtggaggagtggaagctagtgtggaaccttccctcccctgccgcctgcctgtacacgccggcgcttacagtacaccctacaagcgaaagaaacccaaacaaaccaaaaaaaaaaaaagttgcaggcagcgaatgcccctcagcacccgtgcgcgatcctgccggtgggtctcgcgcccgtgccgtccctgcagccgcgcgtacgtacgcacgccgcgatcgacgaaacacgggcgcagtcgtcgtcgtcgtcgtcgtcccggtggtgtttcaagcgcgtgctgtgcgtgcggcggcggtgacaccgtgcgcccgcgtacgtatccgcgcgggacaagcagcggacgggccgagcaaaatccggtgttgtacgcgggccgggcgcggtgaggccgtccgctcgatgtaggccgttccgttgcggaataagttcaccggaggtccctcaatttaacagcaagattttttgaggtccctcaaggcctcaaccacaaaaccagaaatgttcgcccctaaaatttcacaaaccgttcaccagaggtcccttggcagtataggtgggtggttttgcttacgtggcatcctagtcaacaaaaaaaataaaaaaatttcgtgggacccacatgtcagctgcagtttattttttcttctcttttctctcctcttctctttcctctcctctctctttgccggcggcgggcggtgatgggcaaacgcgcagctggagtaggtggaggggcggcgtcagtgcgctagagcaggcggagcggtggtgtctccaggcgagcgtggctgcggcggcgggcaagcggcggctcgggcggtgcgtggccggagcaggcggaagcggcgacatctccgggcgcgggcggagtaaaggggcgggggacgcggggggcacggcgggcgagcggcggcgaggcgtcgcctctttcgccctctcccgccggcctcatctccccccactccgtccgctcccgccgctgcggcgcgccacctcgctgggctcctccgatgagtgcgacggcggcggcggcggcaaccagcggcgagaacgacgtgctcgttcgctctgtccgctttgcgcgccgctctcgccgccgacaacgacgcgactggcggagtaggccgccacgctcctccttcggccacctccgccgttgcggccccttcctccgcctgccgtgctcgtccgctctgcccgcagcccgccgcgcttgccttctgctcgcccgccgccgtccaacgtcgctacgcgtgccgccgcgccgctcgcctccgttctgcccacagggcgcgctcggtggatagcgggctcaaggacgacctcgtgttcggggaccccaacgcgccgcggtttgtgctgtgggaggggaagctaaggccggtgccgtccaagcccggcgacctgccgttcttcaacctcatgagcatccccggcaagctcagggccggcctcggcgtgctcggcattcgaccaccacccccttctgatccctccgccaccggcggcaacatccccgtcggccgcaaggatcccctcccggagcaggagcccgtcccggaacctgcccccatctcccgccgtggtcgcccgcggtccgccggccatcgccccgcccgtctcggtcgtcgaagaagagagaagagaagaaagggaaaaaaagaagggatgtggggcccgtaccgttttctctcacttacatgtgagccccatatactttatttatttacttttgctgactaggatgccacgtaagcgaaaccacccctataggacctcccgtgaacggtttgtgaaattttaggggcgaacatttctggttttgtggttgaggccttaagggactttaaaaaatctcgctgttaaattgagggacctccgatgaacttattccttccgttgcgtcccgcacggcttatgccggccggcccagggaggcgacacataaaccgttcggcctttttatttatatgtaaataaggtccattttatatggatccatatagggatcgggcgcccgatcttttaataaaaaaatcgggcgcctcttccagtcctcccagcttttttactgccaccacgtagacgcaagccactgcatcaaaagaagccatgcattaatagcactaaacaatagtaggatggttacagtattttttacaaacttcaaactattttttctcttaaattacttatccaattcacgatctgattacaccgttgtattcgttataattaaatctttacaacaagaccacacatgattatatttcgacaaaaaatattttagcttttttattgatattttttttgaatgttgcatatggtctcttttgatgtttcaatcagtagttttacgttgtttcagctagtgtacttgtgatgtttcactgtgtacggatcaaatgttgcaatagattttgatattatagaagacgcccttgcaacaaatcacgcgcatattatggaaatcttctattaaggaaatccgttttatattttgttccaccaaaaatgtttcacatagtgtactcataatgtttcactatgtatagatctaatgttgcactgaacgaaacattccattgcaacaaaaagcccacatattttggacatctcctattaagggaatttggtttatttttttttgttccaccgaaaaatgtttaacctagtgtactcacaatgtttcactatgtatagatctaatgttgcagtgaactgaaacattctttcgctatttgctgaaacattgtttttatataagttgaaacaacatccaatttaaacgagtgaaatattttcgatctacttagtgaaaccattccgatatatctggtggaacatcgtacaacattttaaaaaaattcaataataaattaatttttttcgtcggaatatatccatgtgtggtcttgttttgaagatttgattgcaacgaatttaatggtgcaattgaatcatgatttggataagtaatttaagagaaaaatcggtttaaagttcgcttaaaaagtttaacatgcatgcatgatgacgtcaccccgattcctagttgcttcctgctcctcagtgacttgcatgtatgtcaggtaggcatgactgaggatgggataacagcctgataacttttcccttccatcgggcgactgacatcaagcattttcaattttatatccctcaactataatccgagttccatttgtccattactaaatttcaacagaactgctcgttggtttgactaaattagcgtaaaactatataaatttaaggtgttgcagttgcataacgaaaactacatatttaacgtgaaatttctcttagaaatatagatttaagatagagtgtcaaaaaataatagaggttaagtagcaatcatcacaaaaaaaaactacaggtccgtaacttacatagctcctacacaatggcggtgctagggatttaaactctacaatccatagttttgtgatagcttcaatattaaatatgtaggagtgaaatacatgggatggtgtcacttaggtccgtgtgaaaattgcacgtttagatccgtgaacttggtttaatataaccctggtccaatggtcctttgaccacgattaaccaccaaggtggcaagcaacacttttgtgctcagccccctccacatatatcttcgcacataatttgccctgaccagtgcatttcaacccaaatccctcaaaatatccctaaatcggctagggtttcgactgtgaggttagcggaaggaggccgagaggtagcggctgtggtggcctcagcggtgagattagcggcaggaggcagcgcggtgtagcggggttagcggtggcatagtgcggccggattagcggcggagacagcgcaatgcggcttgcactctaggcatccccatggattctccaagctcatcctcgccttgaagtcgctagaagaaggtgttgttgatcaagtgtccgctgtgcaaggataaggttattttggagcgcagagcaatgacaattaacgttaatcggaaccatattttctgtacatgtaaggagaagaatgagaggaaagaacgatttgaggattttttttttgggattctggtgtcactatatagcaacaaggagatatatgcgacgtgttgtgatgtggagggggctgagagcaaaagtgatgcctacgtggcatgccacgttggtggtcaaatgtagtcaaaggacgtttggatcgggggtggtacattaaaccaagttcacggatctaagtgacaccaccacataagtttaggggccggccatgtatttcactcaatatgtagttttgtgatacttgttctttaatatgtagtttttttataacttttccactcaatctttagtttgcgatataacatttaaaatttttagttttgcaatagtttggttgacgtatctataggtttgtgaaatttactctttgtccatttaactgcaaaagccgatattgagtgttcctcaacttttaaaaccagtgcaaatcgagtctctaattagttttgtcctacgacctgttgacttggttctaagaggcacatacgtgatgcttacgtgtcactggaaggagaatacatgttagtgtgctctcaacctttcctactacggagtacttcctctgtttcacaacgtaaaactttttagtattgctcacatctatatgtatataggcaatgctagaaagtcttacattctgaaacggattctgaaacggagggagcagggagtaggtgagtgatggcgcggcaagaagcaacggcgagtgacaaaggagcaacattggctgtggtgtgggaataagcaaagggaagtgcatggcagttctctaatcaccctcgctgccaccccctccttccgacaaccgtgtctgaggcatcgccgccatgccaaatccgatcgagtattaattagggacaacagtggtggccaaagtgagagcagtgagggtcatgccatctaggatgaaattggcatccaaatcatcgaggagcttgattcggactagttttgatagttggagaatactcctactttacactcgattatacggttgaaggatacaaatgaaacttgatatccttctggtgagcaaccgggaaccggtctgccggtttcggctgcgttatatactgtgaggaatgtaaagtggactttttcccttccggtgaacacacacgaggagtggttgctggtggcggcccagggcgtcacacaaacgtgtggcctttttatgtttcactcaagttagatgatgtgagcgttgttattatgtataaacacgattaatcagtattattttcattatttatgttggtcaagtatgatgtttgtgatgaccgtggcacggagaagccgtacacaatgagactctacagatgctttccatcggatgtcaactcttgtactttgcaatgctaacaactagtgctagctatagcctatagctccggtagatcatcttattttttttagcgtcttggtcttaatttcctgacaactaccggaatcatgtaatcgtgacgcataatatagcacgtaattgggactacgcatcttgttagctacttaattaatttcgatggaatcaattggttgacagaccttcattttgcaacgcaaaatatatttttctcgcaataagcagttataaaattacctctaccaaacagcacattggtcgttgacaatagctactcccatctctatttaatgtaacgtgctaattaaattaaaaatattaaccacgagatacacctgtatctacgcgtataatacagtcctataccaatccatacccgtaccttcccagtaaaggaatattgcaatacgtatatctctctctgtgttgcagttaattttcttttctttaaatatacttgttaatttgaagatcatttcctaatgtaacctgctcgaaatcttcaaccacaaaatacacctattccagctcagacgcataccttcccattaaagatatattacatacttattctctctgcgtttcagagaacaattccaaatataattgtttctttgaagatcatttcctatctaatctaacctagtagtgaaaaaaaattccagccataaaatatctgtattatacgcatcctcagttctatgcatctcagccacaaaccttcccatcaattgaaaaacaatttttttatatgtaaatgaagtaggaggtctgtcccttttattttatacctagaagggaacaataaagaacaaactattctaagatataccatcacaataccagtagtacatatttatctctgtatttcacggaattatacttccaaatacacacatgttactatcgagttaatttcataatgcgttgcagccttatcctgcgatcaattgattacacgattaatttagacctaaacgcagcatttgtcgcatcgggtcatgagtcatgacgcgaggccagcgacgtaattacattctaaactttgtggtattttcaccaatatattttccgtctgaccttcgcgcggcctgatcccctcacggtcgtcgtcgtcttcttcccaacgaccgatcgatcgatcgatcgatcgtcgcggcgagaaggggagatcgatcgcgatcggagccgatttgatcggcggcgggcggcggccatggccgtggtgctcggcgcgttcgtgccggacaccgcggcgcagtggcgcagcgtggtgaagggggaggtggcgcggcagctgggcgtggaggcggaggcgaggaagctgggggcgaggctggagaaggtgggcgccgcggtgcgcgacgccgaggcgcgggtggcgcgcgggagcgacgccgcggcgcggtggctcgccagggtgcgcgccgcggcgtacgaggccgacgtcgccgtcgaccggtgcagggccacggcgcgccgcctgacgaggggccgggagcagcagctgcagcagcataaccaggtgagatcgctagccttgaattccgacaaaagcaagaacaccttggtgacaatggcgtcgcagagcagctaatttttgcttcgtgttgttctccggcgagaaggcactgccatggctgctgtccacctgctgcgacgtggccgagccgcgccgcgacatcgccgccgacctcaagaacgtcagccagaagctcaagtccatcatcaaggagcagcggcagctgcagctccaggcatccgtcgccgatcacactgacgaccatccacggaagatcctgaggcaccggaaatccgaacccaccgacatcgacatcgtcggcacggcaatggaggacgacgcgcgccgcctcgtgcgccggctgacgcagccagacagcggcggcgtcgtggccatctacggccccgacggcattggcaagaccacactggcgaaggtggtgttcgacagcgagagggtgaagcgaagattcgagacgaggtcatgggttcacgtctccaggggttgcgtcgaggacggcaagcgagaggccgcgctgctctcgcaggtcgtcgaggccgtcgttgacggcggcggcgccacgacgggcgccgagaccgtcgccgagctggagagaatgctggccgccctggtggcgaacaggaggttcttgctcgtgctcgacgaggtgaggaacggcggcgagtgggaggagttggtgaggcggctactcgagcgcggcggccgcggcagcaaggtgctggtcaccgcggtcaccgccggcgtcgctcgggacatgggcgccggccacgtccaccgcgtgaacaggctcggcgaggacgacggctgggcgctgctccgcgtggcggcgtgcgtcgccgacgacggcggcgcggcgctgaggggcgtcggccggaggatcgtcggcaagtgcggcggcgtccctctggcgatcagggcggtcgccggcgttctgaggacgcgggaggcgatcgccgaggagtgggcggtggtggacgcgagcccggcgtggaaggtgaaggggctccccgacgacgccatgaagccgctgtacctctgttacgacgacatgccgtgccacctgaagcagtgcttcctctactgctcgctgttcctctcggacttcgccgtcgacaggagatcgctggtgcagcagtggatcgccgagggcttcgtgcagatcaggggagacgccggcgtcgaggaggtggccgaggagtactacgacgagctcatcggaaggaacctcctccagccggcggaggccgaccggcacggctgcgtcgagcggtgcacgatgcacgacacgctgcggtccatggcgcaggtgctctcccatggcgagaacctcaccggcgatgcgcaggcgcagcggctgcccagcgacggcgacgcccccttcgcgccacggcacgtctcgtttccgaggaaccaccttgctgcaataccagaggaggttctgaagcttgagggtgtaagaacgctgctgctccagagaaatccactgacaattgggagcaacatctttacaaggctgctatacctgaaagtcttggaccttactgaaactgcaatggaggtcattccagagactttggggaatctgttatacctgaggttcttgaacctgtcccagacaaggatcaaggcgcttccagaaaccatttgcaatctgtggagcctcaaattcttgctgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttcaccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattgtggacatggagagccttgaggctgttgagaacattgctgcactgagggaactgagtgtttggaacacccccaatctgaagaaaatatgcaacttgccttccctcgaagatcttgacatatgccattgtccgtcgctggagactgtggacaacatcaacaggctgcaagaggtgcacatcttcgatcatgaattgcaggagatgccgagatggatccaggcacatgcatcgaagctctgctcactggaattcatgagcacaactgaactgttgaagaggtgcttgattgatggtcctgactggcccgtgatcaaggacattgcacaagttcatggatactcgaatgactctagttacatatactattccaagagtctcaagatctttgagggcagcgcgagtattcgagaaagccgtgatgcagaaaggagtgtggcagattctgataaagttgacgatgcatcaatagagagcagaaacgttgatcgagatgcagaaatcgatggcttcttcagctcaaaattagtggagacaggaactgccaggagtgaagacaatgtaccggataggaatatggagaggttcatgacaagatccactggccgccgattgcataagctggaagaagtccccgaaggagatgaggatgaggaagaggaaggtgcagatccagtagttctgattcctgatgatacaactaaatctgacaccgtactggagaaacttcatcctgttgttactcatgatcataatgataaagcgggatccaagatgaaaagggatcctcctgcaaaaactgctccaggtacttctgttattcaatctgctgccacaatgtgtcataagttggtccgagaagggtctcaagcaatcagcattactgaaactgatcaagatctgagcctcgattcatttcgaagcaaagaacatgcatctagtaagcagaaagttgacacatctggttctgtcatagaaaaagtaaaggaaggaagatataaatctgcaaatatcaatgaccgtaagcacattgagagagttcatgactctgcaaataagatgtcaactacttctgtggagaaaagcattcccgaaacagtcaaacctatgaaagcaacaaagaataattctaaagcaacagactatcatggaactgagaataagtcacctgatagtttggcttgttccaggcaaacaataagccagatagaaaaggatgtttctgatgctgataaggctgcaaatcatccatccagcgcgatcacagagaatcgtctacacaaagcaaatgagatcgatgcttctgctactgcaataaaaactgaagtatcaaagaaatctgctggtgccaatatttgtaataccttaaaccctgcagattcacaaacagtacatgctactgacactgctcaagatttgccttccagtttactccatgatgacccacatttaccagatgttggcagcagtacttctacttctatcagtgacaattgcattcagacagagagcagcaacacaagtttgtcggccaacttaaataatgaagaacctaaagcgaaaggtgttaccaaaactacttgcgcatcagggccttgcaaactgactgccaccttagactgcaaacaacagactactaatccaagtgacgacacagatgcatccatgaagaagatggcgagcaacatctctgagaaagttgtcaaaacattgaaacgcccacatgctgaaacagtgaatattactcgctcttcatcactgccaattgaccctaaatctcatgtcattgataccactgcagcaacgaagaaactagaagctaccctgaaaaacagatcctcaagaaatgcagcacctggccttgccgatgacaaaaccccagtatacaacgactcccatcaggcaccaaaggtgtataccgccatctgggccgacaccgacacggacaccctgaaagcccggttcctcagcacgatgcagcactaccgcaggatggcttcgcaccgtcgccgacgccatagaaagcatggctccaggaccaagtggagcatctggccagtgctggtggccatcctcctgatcatctcagtggcacagctgctgttcaccttctggatgtaccgcaagctcatgaatcaaaactcaaaagtagacgaacaatgaattctacactgcgaatttcatactttggatgaagtagactgcgcgtgccttgtgcgttcatatgttgtgttgtgtagctactagctactgagtactgactagtgagagcaatagcccaaaactttggcgggagatcgtgaattttgaagcagtttggcgccaaccattttcaaatggcgctttgctccccgctaaagcctagtagctctgagatttgggaagcgaaaatttggggggaatgaaaggggacagaatgaggaagaagcagaccaagaattacccgagcagaatccgatcgaccggcggccagaccaccctccaatctttcctcttcaaatccaggtagggaaagaagctacctcgaattcagattgtccccaatttttttccccatccttttcgcttcttacatttgcccttgaatccttcagcgttgtcgatgaggaagtgaagccgatctcgccgccgccggagaaggaggaggaggaggccatctcgccgccgcaaccgccgaagcgggagatcatccgagtcaccaccaaggcgatcgtcaaggtaaccaatcgaccaaaccaatccgatgcttccccttccttcgcggtgtaactctggaaatgcttcgggatctggcaggagaaggcgagcgcattctcgtcggtgggctcctcctcctcctcggggaagagcggcgccggcggcggcgccctcaacgcggcggcgctgttcaggcggttcaacagctcagcccccgtgccgagagcggaggccgcgggagacggcgatggcggcgtccggctggagatcgaggacatcgcggcgggggatcgccgccgcgagaccaggaagcggaagagccccctcggtgcgcgcctcgcctctcgaatcccatctccccctttcaggctttcaccactcatccgtgacgcgatgtcgatctccctcgcaggtggtggcggcggcggcgacgaccaccacagcggcggaagcggcaagcgcgtggtggtgctcggcgacgacccgaagccgaggcccgcggcgaggacgatgacgacgacggcgacgacgagaaggcagcggcgggggcggcggcatgcggggcccaccggccgcggcgaggagggcggcgaccaagctgcgtacaaccactgtaatctctctcccctctctcgttcgctctctcgattttgtgacggaaatttgaacggcgtggtggcttggtttcagacgcgagcggcggcgggtggtggcacggcgagatggagggcgtcgacggcgaggaggtggggtggaccgacgacatgtgggaggggatggggtccatcacgctcggaggcttggagtggcactagcagcagccgccgccgccgccagtcgcgagctccgccggtcgccgcggcggcgcagctcgccggttttgggtttcgggtttggaaggtgacatgcgttgttagccacggcgagctgtgggtcagattatgctatgtctaatgagattattatatcatatgttactccatttggcactgtttgaccactcgtcttattcaagaaatttgtttaaatataaaaaataaaaagttgtacttaaagtactttagataataaagcaagtcaaaaataaataaataataattctaaaatttttaaataagacaagtgataaaaagtgcaaacaaaaacttaaaatccctatattatgtgacggagggagtagatatcagtgaaaaacaaaaggggttaaaatgctgctgtgctaacggtataggagtattttgaagtactaatataatttatacgctttatatgtgagaaatgatcaattagtacatcccagcttaatcaaactctgctacggcaggcagaccaatgtatctctaccaaccacaacaaaaactattgttaaaaatttacaaatggataacaagcaataatagtatactcccgctctctgttttatattataagtcgtatactttttttttgttagttaaactagtttgtagaaaatataattacattttcaatactaaaaaatctcaaacgacttataatataaaatatagttaaatttaatgaatctaatttggtgttgcagttgttgctatttttttataaatttagttaaatactaagaaaaaatcaaacgacttatataagtataaaatggaggaaataccatttagcaaataatagcatgaagagagaggtgaggacaaatacatagcaaaataataaatattttttattcagtgttcttcttagtactccacgatgcttactatacctgatagaacatataaatcaaaaaaatttacttataaattacttcatattaataagccgttacagattataattgtaagccaaaaggtggggttgtttctaaaaaatcctgatcttttcttcaataagagttggatgaacattaagattttcgtggcacgtttttcaaactgctaaacggtacgtttcgtgcgaaaactttctatatgaaagttgccctaaaatatcatattaatctatttttcaagtttataataattaaaattcaatcaatcatacattaataccatatcgttttgcgtaaaaaaacttaattttcatcttcattttcaggagaaaagaacaccatctaaaatctacaagctagacccccttcatctacctattttcggcagtcaaccctacatgatggcatgatgcaaaatgccaccacgattcattattgatcatagttcatactccctccgccgctccgccccctaatacaaatgattttaatattttaattgtaagatttgatcacttgtcttattaaaaaaaattatgtaaatataaaaaatgaaaagttgtgcttaaagtactgtagataataaattaagtcataaataaaataaataataattctaaatttttttaagtaataatggtcaaacagtgtaagcaaaatgtcaaaatctcttatattagaggacgaaaggagtacttcgtaaacttaaattcgtgtcatatggtatctgcacttcacttcactaacccctgagccagcaatttgatttgaactgctctctcggagatgatgaagccgaggaaacagttggtgctcaaacctcatcttttcaaatcttggtttgcggctttttcatctggctttggggtaccagatggtaaggaagtgactccggattatctccaaagattcgtaaggtgaactgtcttgcttcactctgagaccaacccattaggcgccatgattcttttcagctattggctatattaaattattgcgatcacgctttttaaaattgctaaatgttgtgatttttgaaaagtaaaattttatatagaagtttctttaaggaaaataaataattttatttttaattttgtcatagttaatatttaactaatttctcaattaagtgccttttgcgataagtcaattgctccttcctccaacctctgaaacgaacagtgctaagcactactccctccgtttcacaatccctccgtttcacaatgtaagtcattctagcattttccacattcatattgatgataatgaatctagacatatatatctatctagattcattaactttaatataaatatggaaaatgttagaataacttatattgtgaaatggaggaagtatttgtgatttgtgaacatccaaaggacattgtggtgactcgaaccaccattcagttgatctgtaaagcactaataaagcgtagaaaaaccactctttggcaaagaaacaacgtgcaaagttcaatcacgcataattagaaggcccaaatgctaatcaaccgccaagtgtagcaaaattcctcatttgcgtcttctcgaattaattagtcgatgtcagtgacagatgacacaaaagcaaaagtcaggcagctcatgtactccctcagtccctatatataaagattttagttgaatgtaatacatcataatgcaacgaatctagatgatcattggtccatttggatgggatagtgcgccaacagcgagaaataaatttcttgtttgggccttgaatggaaattggaaaacagaaacctggaaggaatcttttcaaattgaattatttcacataatcacatggaaggcttcgttgctccaaacagaagtaaaactgcaatgcaccttcgaacatctaatattcactcaatttaaaacgtactccgtccgtcccaaaaaaataagagattttaaacgaatgtgatatattttaagacggatggagttctatgagtttgttgatttttccaataacatctgaccattaatctcatttaaaattttagtgcagatataaaaaaaatataacatatacttaacatacctttaataataaaaacaagctgtaacaaaataaacaatacgaccaatcgtatgttcaaaagtcaataatatcctataaattccaatttaagcttaaaaacgcagtgtgctcatagacaaaaaaaaagtctttatttccatgaaagagatagtaaaacattacaacatttcaatacaaattcataaaaaacaacaacattgcagcatttctactgtcagatcagatcctctaaaacgcggttaacctggacatgtttcaaaacaagaactgctattagtaacacacacgaactcctcccgctcctcctaatgttgccaatttcacacgatcgccgcaatttcgcagaggagaagatgaactcatcatcatcatcatctttctcgccatgaactcgatctcatccttcacctcctgcatctcgttcagctcccagaagatgagctcgccggcgagcttccgccggagctcgtgcacgtcgtccatggtgaacccccgctccagcttctccccgtcccagagctccatgcacttgatcgcgaagagcccgcacgacgactcgtcggtctgcgccgggaggccggcgaccatccgcagcttccatccgccggcgtccgcctccgcccccgcccgcccggccgccgccacgcaccgcgcgacgccgccccgtatcttggacatggcggcgtcgtagaatctggggccgaagcggcggccgtagttggaggagtcgaggatccggtactcgccggcggcgacgtcgagcgccgccacgaagaagtgggactggtggttcaccgggaagagcaccgtgtcgtgggcgaggtacctggcgcccgtggccgacatgtccgcgtcgtgccccgccgccgccgccgttcttggcgggagggagctgacgtactccagccagtcctgctcctcgacggagccgaggagcacgcgacggccgttgcggcggcggcggcggccggcttggcggcggcggaggaggtcgagggcggcgtcgaggagcaccccggtgatctgcctctccgggccgtcgcgggacaggggcacggcgaggcagcgcagcgcgtcggcgcggacgcggacgcgcggccgctccgacgagaccagcagcttgtccttgcgcccgccgtgcgcctcgacgtacgccatcgtcgcctcctcccgcgcggcgtcgacggccgtgctgctcgccgcctccgagcggcggcgcgcgttcttggtctccgcaatcccgatgttcgacgccatggctagctgacgcacgcacgccgcgctctcacgtgttcgtggttcgtactcgccggagttcgatcgtagcggcggcggaagcgcgagttctgagctccgacggggtcttgagaggcgaattcgcggcgtgcaaaggaagaatctcgttgcttcgacgcgacggcgacgagataaatggaggtcggggaggcaaaggcggtggaatggtggggatggtcggtggcgcggctgcaccgaccgaccgagcaaaagtcggtttccggaattgacttgtctggagaagcgggctgtacttgcaacggcgaccggtgggcccaggtgtatatctatctactgctggcccactgtaagcccatgttaatgaggcccaattagatgggccgcatcaatgtggtttccggcccaacagtggcctcattcccggcctcttcaggcccagaatgtatgcgtcagacgtaggccgattcctcttcaggcccagaatgcatgcgtcagacgtaggccgattccttttcagccccagcattaggccttgttcgtttaatcccaaaaaagggatttgggggagaatacatcacaatagatatggaaaaatcccttccaaatcccaccaattctcttgtggaagggattaaccgaataagatcttaatgggacccaagaaggatgccttccatttcccttcaaaattaattatactccaatcttttatcaacgactttttcttcctaacgaaatgcgagagggcgaaaggggtgaatgggaagtactccgtgctacccgttgccacaccatctccagctatacggatcacaaccactatcggctgccaactatttgtgtctattgttcgtcatcgccttccaaatcaccttacgtcgccaccacattctgaacacttctagtgtgtcgtaaagccactctgccatgctatcactgtcttccgcagatcgtcaaagtcctcgatgctcctagagcatcgcgaagccatccaccatggcatggacttgcctttactcttatgcgttcatcggagatgctccaccgccatccacatctatccgtaataagaccttggtgtcgatgcttgcccgagagctgatcatttgttctactccttcccttttcagaatatttttgtaccccttaatttgaaatctcagtgttaaaagttgtcagctagtggttcgatgctcttacgactgatttttggaatcaacacgtgaccaacaacacatcttcaccagtgatttatgaagaggagttagggtgtgtttagttcacgctaaagttagaagtttggttgaaattagaacgatgtgacggaaaagttaaaagtttatgtgtgtaggaaagttttgatgtgatggaaaagttgaagtttgaagaaaaaatttagaactaaaggtcgtttcacattttcctaatcaatcttcctaaagtttaaccatacttgtgaagaaaaatagcaacacatataacaccaaattaattttgttaaatctaacattaaatatattttgataatatatttgtcttgtgttaaaaatattattatatttttatacatatttgattaaaacgacttataatattaaatatagaaagtaataaacaatactccctccgttctaaaaaaaagacaaactgtgggtttccatgccaacatttgactgtccgttttatatgaattttttttataattagtattttcattgttgttagatgataaaacatgattaatattttatgcgtgacttatctttttaattttttcataattttttcaataagaccgacggtcaaacgttgaacacagacataatagtttgtcttttttttttttggatggagggagtatgaattagagagagtaataaactgttaaattgcccggaagctcgtgcgctaaacgctgagatttattttcattatcttaaaataaagcacagtattaattaagaagttaataatcgtattacgattcacaagctagaggagggttcgtggacacatcacggttttccactgagcgcgctgcgcgcgacgcgagcgactcggcgatgcccttggcgacgcaatacgccacggactcgatggtgatcatcgggttgacgccgacggccgtcgggagcaagctgccgtcgcagacgtacagcccctccgcctcccagctctcgccgccgccgtcgacgccgccgtgcttggcgctcctccccatccggcagctccccatctggtgcgccgaggcaaggagcgcccacttgtccgaccccgggtgcatcggccccttctccacgctcacctcgtccaggaacgcctccacgtcctcgtcacgcgcgcccttgcaccggaggcgcagcccgtcgctgcggttcgtgcccacctcggcggcgccggcggccaccaggatgcgcagcgcgcgccgcaggccggcgcggagctcgccggcgtcgccgcggctcggggtgaagcggacgcggccctcgccgccgacggtgcccgcggcgcggtcgcggacgagcaccaccgcgtgcgccgtgcgcgcgtaccgccgcatccgctccttcatgtcgcggccggactcccacggcaccacggcggcgaacgcgcccgggccgagcgccggcgtctcgatgatggtgcggtcggtgacgcggtgcatgctggtgatgatgccgccctcgtaggacttgcccgggagctccgccgtgctgtccgggaagtagccccacgccatggacccgggtggaggtgaaggttccggccgatgtggcggttcttgagcccgctgttgcgcagcagcggcggcgtcatgagcgcgccgcacgccgagacggacaccttcgcctcgatccggagcttcttggtgatgcctttgcccaagcacttcgccacgacgccgacgcacttcttgcgccggccgccgccgccgccggtgttcgtctcgaggatgaaccgttcggccttgcacccggtcaggatgacggcgccgcggccgacggcgtcgacgagccacgtcgtgtcggtgccgcgcttctcgccggtggggcacccgaggttgcagctgccgcagaagtgcccctccgacgagttgcgcgacacggcctcgacgcgcagcccaagcgcctcgcagccgcggcgcaccgccttgttctggaacccctcctcccggcaccggccggtgacgccgagccgagcgcacacggcgtccatggcctgcacgtagccttgccccccgaacagagggagcccatggtcgttcgaccactcctgcaacacgttcgccggcgtgcggatgcaggccgaccagttcaccgccgagccgccgccgaccgtcgcgccggcgaacatggtggtcgtcacgttcgccgtgctgaacacgccgccattctcgtagaggcgctccatggtcgggccctccagcgagctgtagtccctggcggcgaagtagtcccccttctcgacgacgacgaccttgtacccggccgacgcgagcacggcggcggccacgccgccgccgcagccggacccgacgacgacggcgtcgcacagcaccgtgtggtggtgcgcgctcggcgacgacgcgcccgtcttcagcgcgaggcccttctccgcgagcgacatgagcaaggcgttgtcgtccagctgcttggtctccacgacgccattgtccagaggccggcacggcggcgccgtcgccggcgccggcgtcggcgttgcttctgtaggttcttctttctgtggctcttcctcggccgccgggacgctgtacccgattgccttccaacttgggttctccaagttctcgtccacctacatatgttgggaaaagaaggttaaatcgttgataattcgaattttctgtgaaaatgtgtatgcttgcatttcttttatgatttttataatggtcagatttttcatgaaccaaagaaaaaaaagtacaattcttaataaggtatggtaaaatactaccaaaactatagtaagttaacttgtggtaatttcattatgtaaaaattacagtattttaccattcttaataaggttccaagtgtcaatatattctatagtaagtttacactgtgaagtactacatccgtcccataataattgcatttctataaaattagagacggattaatagtaaacacaatttaccacaataagggcatgtacaaagatagagttaaatatgagctctacgttatatagagactagcatcctataacagttagagacaatatggtctctaatcattaatgtatcaaaatactttttcttacttttctttcctttctttcaccaccatgcaacaaaatttgctctaataaatactaagagtcgactctgagctgttgtcatgcataacaaccatacacatttctctttcttccatgtcatcaaatttacttgcatggcaatagagagagaccactaataaacaccgttgtacgtgcctaagacggattcttaataatgcaattattatgggatggaagtacttcacagtctaaacttactatatgatatattaacacttggaacctaccaaaccaggagtagattttttaggggctatctaaaaaaaactccacaagtttattatgtaaaaactttcaaatgtaactgtattgtaatataattataccgtaagtatattttaattacattgtaatttttatgtaatttctgtataagtattaaaaaaatatatgtagcttgaatcatagagattactatttaagttaaagagtgattacatatagttgcactacatgcttatatttgaaagttttttttacccaaactttttttagcaatatcctttttttttactatgcaaagttcaaatcgaaacaaattcggaaagtacgactagttgtaaggtggtggagttgtggcctcgttggtgtatgactcgactccacccgttagggttatcgatgaatatacgtgagtgagctttcaataaaaaattactagttaagctagggatatatcacccgttcatgttttatatgtcttacgcgtaataaaaaaaaccattttcgttagaattaacattaccgcggtgtagaagacgaagtggcagaggaccttgatgagggcaaagatgatcttgagcgcttcagcgccgcctcccgccgctccaccggcatgtcggcgaaccggcgcacgtaggggaactcaccggagacgcaccgccggccgcacagcgccagcgtgccgaccctcgtggccaggatccacaggatgatcctcaccagcacccctgcctcccagatgcaccgtgtcatggtcagctcagcaaccttttcttgcaagagattagagacaaagagaaaaaaaaatgttaagttaaacacaacttgttgtatatcaaagttatctgaaatagttagaagaatcagagatttttcagtagttattaaaagacaattgttcgagagttgacttgaatagttgggactgaaatgtgcaaaaaataataataataataataataataataatttcgggcctattgtccgaagtttcttttttcgaaagaagggggcaaagttggttagttggttagtgtagctatcataattagcacgagaaaactacgtctacgaagattagatcatgataaaaatgcactgcatctaatgtttcagttaactgactgatcaaatgccaactaatcaactcgaagaattggagtagctagggtgaagacagatggaatttctgttagattgctacagcttatcagggcttgggtcgagctgtgttagtttcctgttagtctgtaatgggcaggttggatgtttcttttgtggttatcggctagggacctggtctttctatcgatagctatctctcttttttttttcaagacttgctgtagtttattttcatttttagtaatgaaaatgggggtgcttggcgccctagttctaaaaacactaatcaactcgacactggcaaaaagtattttttaacaaaataataagtggacatatattgaagctttcaaaagttttaaaatgaacacatggagaaacaaaaattgagtcatcaggttgatgagttgattatcgtctctgacagcgctgatcagtcgcgacgaaatcatctcaatcaaatcaataccatatgcgtcgtcaacactgatcgatgacgacgcatgcgctcacctcgtcggggacggtggactcggcggcggtggcgaggtagaaccgctcgacgtccatgtcgccgccgccgcgggcgccgtcctcctcctccgccggcagcgccgggatgagcgcgccgcacatggccctgagcgcccccatctgcgccgccccgagcccgtgcgtgtaccgctcccgcctcgccgggccccgcagcgccgggtgccccctcgccgccggcgccgcctccttcgccttctgatccatggcctcctcccgcggcggcgacgccattaaccaattccctgcagctcgcgcaagctcagctgctagctatagcacacgtacgtgtgtagatatagagtaagtaccgaagtacgtaccggagcttgcggggcacagcacgcactagcctcgcagcgacgtcgacgtcgatctctctctctctctccgattttgtgaagctgacatgtttgtacacacgtatgttagagtacagtataccagagaaatcttgtgtagctgtgtttgagactttgaggagaaggagatagagaagattggaaagatacgcaaaacgaggtgggctattagcgtattattaattgagtattaattattttagactttaaaaatagattaatatgattttttaaagcaactttcatatatattttttttaaaaaaacgcatcgtttagtagtttgggaaacgtgcgtgtggaaaacgaaacaaacaaactccctttgttctccgaacaaacgcatacattatattagaaatctcttacgtgacctagaccgctgacacgttaattagaggaagtaacactggtggagaaaccatctttcgtcggtcggccgatttccacaatagtcccggatgcaataaaaaccggggctaaagatgatctttagtcccggttcaaaagggaaacgggcatatttgatctttagtcccggtttgtgttatcaaccgggactaaagatcatctttagtcccggttcgaatgctgtcaggacctgtcaggcccccccgggatctttagtcccggttggtaacaccaaccgggactaaagatcttaactttaccaaccgggactaaagatcccggtgatctttagccccggttggtgttaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaactttatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaaataaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtattgaaatggaagaagatgaagtggaagacgacaatattccggactttgctcagtatgttggatttgaaggaaatcaaacgggcgaggaggaaatagctgctgatggtaacgacgttgcggatgatcttggtcagatgttacaggacgccagggaggactgcgaaagtgaaaaggaggcccataaattggacaagatgttggaggaccacagaacttcgttgtacccaggttgcgagcaggggcacaaaaagttggataccactttggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaatcatgccctgtttgcaaagcactacgatacaagattagacgggacgatccaggagaagttgacgggcagctaacaaagaagagaattcctgctaaggtgatgtggtatttccctataataccatggctaaggcgtttgttcaggaacaaggggaatgctagaatgttgcgatggcacgctgaagagcgtcaacaggacgggatgctgagacaccccgccgatggttcgtagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacagtaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaattctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaaacatatggaacaacgcggcgaccttcacccggaactaa

SEQ ID NO: 31001 - DNA, 1552 bp, Oryza sativa
atatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaatgaaagaagggcagagggcctgatgagcctaagcgtcaagtggttctcccaggcaaaaaaaaaatcgtcggagttgaggacaagactgacgaggattacgatcagttggatgggcaaccccctttcacggtgacgattgaccctagcatcctcctatcaaatgaagacactccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggaaaaatttttaaaagtattaaatttaatatatttttaaaactatcattcatatattagagtttttcacaa

SEQ ID NO: 31002 - DNA, 374 bp, Oryza sativa
aacgagagcgagaacgaacacgtaacgtacgttgccgcgacaacgtgaatgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaatgagcgaacgaacgaggacgaacgttaacgtgaaatgcaatatatatatatatatatatatatatatatatatatatatatatgtcggtgacatgggaccgggagtatcatgacttagagacttgaggcagacacgatcacccacgtggcctaaccccctcgggggggggggggg

SEQ ID NO: 31003 - DNA, 2912 bp, Oryza sativa
  unsure (1)..(2912): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaaatcataaagaaattgagaaaatctggaaatttcgggctagctaattacttgctggggttgggggggggggtttagaaattagcgaaattgcaatcacttccttaaactgtcctgaattgttgattaagatgtgaataaatacacgtacatataatacatttatacttcctttgtccaaaataagtttatgtttcatccatccacatgtactaatcaatacaaaaccaaaaatattagaatatccttattttatcaaatcctaatgtaattattctccacgtattttctacttaacaaacttgaatacaatgaacataaaaagaaataaacttattctgcgaggaaagtccatgactttgtgaaagatggtatggtcggcatctccattggtggaagaacatacgtacatgtgtgcaggatcggaacacaccattggtgcaaattaagctgcctgcacatggggaatacgtgcatacgtaatcaagttgacggacacatgtacataaaaaaacgatgattaattactttattctcacaacgcccatccgtctgttcgtctccatgctgtgccatcgattcgcaccatcctcatcatcaatttggccgtactagtgatcgaaggagggtcagccgctaagccaaattggcaagcagtgacatagtttccagaagtaaggagctaaagctaggctgctaaaacagagcaacgaatagctgggctatcccatccggccatcaccctgcaatgcactgaacaacaaaaggatgatggatttcctaaagataggaaggaaacgggtagatctagactgtcaaatattctagatacaatgaacaaaaaattcgaatgatttgaacccaaaaacatatgaatgttacacatgcagtctcaaaatttaaataaattatcggctgtaggcggatagggagaggcactcctcggtggcaggcggagaaatgaaccagcaccgacacatatatacccgatcactactgaaacaattttgtgaaatttgcttaaaaatgctactatattttccttagctcaatagtaggattttttttttctgactccactcctgaacagagaggaagtgctctcccattttctatcatcagaaaggtataggctaccagaacagagcaacagaaatgtaaacaaagactaggctgatcgcatacacaatcaggctgccagaacaacaaaaaatacagacaaaagcatccagctccccagctgggacatatccaacatttcctttggtctagaacagcatcagctctgtacaaatgcatgatcacaaataacaaagagtatgggaacagtcacccttgcttcagagatatgatttcttatggaatataatcaagtacgtacttctgtactaatgatcaatggtacacacattacatataggtggttaaactaagctttcgcgaaacctgcatggaggcatggagacatagaacaaaacactgttgttctctagcttatagaacctctcgattgcagatggacactccaaatatgtcgatcgatctagccctatatatatatgcaatgagtgttttcagataagttgtgaatactatgttaatatatgcgcacaaactataaggtagcagcactgaattgctatactgcatgctgaagaacatggcgagcacctgactaaacactgcaagcgagagcagcacagaattaacttagctagctagccaagctcgatcagtcaagctggaggacgaattgtgggtgccatcacccaagtaagtatatatatctatatatatgttcactgcgtcgagcttattcgggttaattgattgggaattgggattgaaacctcaatttttggcctgagcccccaaaaaatcctggaaatggtatagatattaggatttaacggtgtgaaaattcatgtcaggattgtgtttgcactcatttgtttaaccgaaaatgtgaaacttcatgtcaaaacagggacaaaattcatgttaaaaggcttgatatcaaaataagggtaaaaatacaaagtcctcagaaaagtaggggcaaatctataaatataacgactgtatgtctttgacactggaatagggtaaacacaaagctttagttaaaaaaaatgaatacaatcacaaaattgtaaaagtaaatgtaaaatcaccattgaagtttaatttaaaacatggataagaatatgattgtccctataatatcaacaagctttctacataatattatttgaaaatattactagaatggtacgtaggtctggttgaaaatggtaaaatgttagttttttttttctttgggtcggcttggccttgacaatttaaattgagcccgtgcattttcaaactaccgtgcccggggtttaatgaaggttccaaaagcattcagtcaccaaataccgctctcaagcggttttattgataacggtgagtaaagtgctactgtatacaaccaaaaaccggtagaaagcttagataaattttgctagaattttaaatttgaatttgaattttgaaattggcaggttcaccaagcagtttatcaattcttccagatactaaaggcggtcagcaacagcgataatcgagtggttaccattgtattttcaaacccctgcagtgcattgaacaagtttgcacccccaagtgctttttcctcgacttaaatttgagtatatatatatatcgcagtggatcatggaaatcatgttttgcttgat

SEQ ID NO: 31004 - DNA, 756 bp, Oryza sativa
tgtagttacatatatatatatatatatatatgactattcaccaatatttaaatccgtgtctaaattttgcgcgcatgcacgtacattttctatagactctaataacaatctccgtaaggaaagaaacattgtgtttggtgtacacgtcgtctttcattaaaaaataattttgaagacaaaaggttgaaaataaacctgcactactaattttaatttaaatgaaaaaaaagaatcttctcatgagccatgcatgatccctctttattttttcaataaaataaaataaagatccatgagccactccaccttagctcctataaagactccccccctctcccctcccctttcctctaaaccccttccaataatccctcaccaacccatacccccacactccctctcacactccactctagctagctaagctaccttcttactccatttgagcaaaccaaagctcatctagagagagagagagagatctagagagagaaaccagcaaccactcttcctccatctccatgagcaagagaccagatcgttcgttctagattgttctagctagatagcttcatcgtcaaccttggcaacgccaagaaaattaaccagcaagaacacaagaagcggcggcggcggcgatggaggtggcgacgatgctgacgctgacgctgctggcgtactcggcggcgatgctggcgcggctgctggtggcgcggtcccggcggcggcggtgctacctcctcgactacgtgtgct

SEQ ID NO: 31005 - DNA, 2010 bp, Oryza sativa
tgaacaaatcagttatatacctgtaacaatcatactttgttactatgattcggcagtaacattatcttagaagggtagtaacatcatatgttactgcaaaaatgtataggttgttactgtaaactttataggttgttattgcacttttggcagtaacaatataacgaaatttgcagtaacagagaacatgcatagtaacagtgactctatagtagtaatgtttttaaaatctcaatctttagagagtactaacgtacacgtcatgtcttatttttctaacccatttgtattgtggcgttcgtaaaaaaagtgcttaacgaaactagaaccatcgtaactattttttaacgttgttactgcatattggccatcgtgttactacgctgttccagtgagacgagaactaaaaaagaggtaaatcacaatctttagagagcaatatctctcacatcatatcttgtatttccaatccgtttgcaccatgaagttcataaaaaaacgcttaatgaaactagatccatcatggctacttttttacgttgttactgcgataatgctgtcttgttcctgcaggatgaccgtcctgttactgcacgattcctgcaagacgagagcagcaaagtggtgggcgggtttgaccgacgggaggacgctttgaccgaggtgggaggggggttttgggccctagggagggtgggggaggtgggtttgacccatgggagagggggtgtagaatagtttttctaggggaggggtgtagaatagattcactatatatatgtgtgtagattaattaatatttatatgaatatgaataatactagaaagccttatattatgaaatggaggaagtaccaccgaaaatagtgtgcctgaagaccatagcaaaacagtgcttctttgtactgtgtccatgaggatttttactgtgggcggcgaagtactgattgaagtaaatggatttaatttgttcggggatctatgaacgagtagtggaaggctggaagctatgggctaatgcccattactgttgccatccgtttagttggagacagccctaacggttgtggtcaaccatatatccacaccacatcaaaggtatccacacaacttcacgggagaggtgtctcaaactccaccagttattgaggatcaggattctctgcagtcactgcaccgtacctttatcattgatatgtaggtccgatgtggcgtcgggtccatatgtcagtgataaaggtatgctgaagtcgactgcataggatctcaatccatcattgggaggtatgctttcatatatattttttttatcacatgacagacagacatatattgtcacaccctgaagttctcctcccaagcctaaaatttaatttataaatgactctaagaaaatgccggtgcaaatcaagagaaaaccctaagaaagtaatacaaataataatcgaatctgacatgtggaatttttcttgagttctacatgtcgaaattcactaacaggatttttagtggaattttcagatccctagaaataattttaaccaattaaaattgagcaagcaatattctaattccagggaaaatccctttctcctttttctttttctttttcccttccctttccgaatgggccgccggcccattctctcctttttctccccctcctccctgagccaggccgccccgcctccctcctctcccggggtcgccgacaggtggggcccacctgtcgggtcctcccccaacctcccgccgcccgcgccggtcaccaccccccccaaaaccgctgccgccgcgccccacctttcccgctttccccgcgctcacgccgcgtcgcccgcgcccacgccacgtcgccgccccctctccccgcgtctcccagccgcgcccgcgcacgagaggggcgggattcgattctgaatcctcccccaccttccctctctccttcctcacgtcgccggcgaaatcggacgcgctcgggtcgttcccgacctccccgcccctataaaa

SEQ ID NO: 31006 - DNA, 9868 bp, Oryza sativa
  unsure (1)..(9868): unsure at all n locations
cgtggttcatctccctccctgtaatctctctcttctccttccttagggcaccccgattctcgtccgccggttgccgtcgtcctcccgtggctcgccgtcgccgttcgcggtcgtcttcctccgcgccggccaccctcggtgaggcgccctctcccctctattcccctctctctcccttctagccgccgctttagcgccgccgcccgttagccgccgctctagcaccaccgcccgtcggcgccgcctttgcgccgccgtctccgccgccggttaccgtcactggcaacgcgtgtgcgcgcgccgtcgccgtcgccgtggccgcttggccggtcttgagccgagccgggtcgccatcgcccgtccgatcggccccgggccgatccaggccgtcgatcccgtggaccggcggtggaccacccgcgtggtcccggtccacggtagactgaccactcgtgcgccgctgccgagtggggcccgcttgccggcgccccttttccctctctcccgagccgctgaccggtggggcccgcttgccggcgccgcgccccgccttgatgacgtcagccctgggatttattgcgcaataaatgatttaaggactttttgttatagtaataaacacagtgaatcttctaaaattcataactaattcatctgagctccgtttaagcccattcaagtctcagtaaatcaagaaaaatgtgtagaatccattaaaaatggttttgttccctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgtttttcttcttcaaatattgcattgttttataatgttactatggggtgtttacctattgtcatagccatgctattgttgtaccatgtccctttgtcagcttggggttataacatgactagagattggactagggattgcttagccatgcttagttcaactagtgcacaatggggaaaattctattaatgtttagactgttggttctaatggtattgttggattagtgccaccgctttggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttacctctagctgacgcatccaggcaagggtgggagtgatggagcggggcgggccctgcgacggcctctgtcgcttccggattcacctaggcacgagaggggactgcccgctgccttgcgaggagtgggggtgaaacctgaggtgtggtgtgcttggttagaggggttatgcgaagggtcctgtcacggcctctttccggtatgtcgtggtggcatgtcggcgcacggaaacatgtcgtggggttgtgtcttgtgggtacagttgtacacctctgatcagagtaaaactatttgaatagccgtgcccgcggttatgggcggacaaccagattcaccgtgattagtctcaccctagtttagtcttttgaaattggatagtataggtggatggttgggcctgtcgcaacgtggtatagcgttggacagtggatgattaatattaattaattattatgactgttttcttctttaaacttctgtttattaatgctcgctttatgcaaatgaaccactctagctctcctttgataattccctgcatcatacccctattccggtatgacttgctgagtacagtgggtagtactcagtcttgctctatttttcccaaccccagagtacgagtttgtgtcagatggaggtttctctgaggagtaggcttcgtccgtgccgtcgaggatgcctgtggagtggtgtttccgctgcagttctagacaaggcttagctcctgttgtctttcgttttttctgctgcatttatgtaagacttttatgatgtttgtaagacgtggatctgaatgtcaacattgtcgtttgtgtaccccggctggtcctggacggggattttaatgcacattctgcttggaattctattcggaaatttctgggcgtgacatatatgcccacatatcactgcacatgtaacacatgctcaaatatatgcaaaccagcggcacattcatgaccttactaaattcttgttggaaagctatttacatgtatgtaatattcatagaccccaatatttgcatgtgatgagtggagtcatgcgtctacaacttcgtcataatatataccactcgtgttttcctcagtatctttccatcttgttttcaaggttcctctttattttcatctttcatatattattttctgtttttagtttattatctagttttatatctttttccttttctctaactatattttacaccttttcagttcattttgattttctgaaatttcatggtgggatcaaacaggagggagtgtgatcaaccccactataaatattactacttatgttaattctctcccttttttatcatctaagcatgcataagattgataataaatgaggttcctttccaaaaaagttgataaataaggggaagagtagcatttgttatacaaaaagagacagataaccaacatattagtgtctatatgtgatttagaatgaaacagacttatggctttaaattgacaaaaaaattatcagaaagaaatggaatttgatagaggcttcagtcatatggggctaaactagccttaatatcggtagaggtcgaaactggtcgctgttaatagatgtagggttaccctttgtccattgttcccatgcaactttttttatactgatcgatcattttgctagtcatcaatataatcttttatgcttatagagatggttacctgaactttgactgataatatatatttcattggaaaaagatacgaagctgcatgaaaatgatatgtaagatttgctcataacagtattgatcaaagggaggttctggacttcaggtgatctatcaacaacagctagtttgttgctcaactataccgaacaaaatacttctttcattccatagtgtgtaactattgtcttaggagtatccatattaaaacattgttagttgaggacatgacaaaatatttacaaaatttgaccctaactgaatgcttttgaaagagacactgctcctcactccgtttcatattataagtcgtttgactttttttttctaatcaaacattattaagtttgaccaagtttatagataaaattaggaacacttaaaatatcaatttactttcattaaatctaattttgaatatattttgataatatatttgttttgttttaaaaaaaatgatactatatttttctataaatttagtcaaatttaaataagtttgactagtaaaaaaagtcaaacaacttataatatgaaacggagggagtacatggctggtggtcaaaatcaatcttacaggtggctggcctgctgcctgtaaccaaaggttagataaaatcgtggattttgacaagcggaaaaccaacctagcaaaaatcgacttttgctagcggatctcataagtcactgccaacgaagagatatttggggccgaaaaagaaataaaaacattttccacaacaacatgatttgattcaaatccatatttttcacatggacatgcaagcatcaacatcgtcataatcatcgccacacacaaagccaccgcggtcatcatcttgtcgagcttcatcggcaaaggcgtatgcggtccttctttcttgactacggatccgggccatgccgaggccttcacgctcgtcgccgagccatctgtcgtcgagacccgccggcgcatgatctggccgccccgaggtccgtcgtcgccagatctagtggttttgaggctggctcacccctgccatcatcgtcccaaggctattgccatctctgtttgccgtacgtcgttgaggcccgtcgacaccagatctggtggccccgagacccaccattgcgccgttgttgtcccgaggccgccctgtcgtcgtcgtcccatcagctgctcatggagctgctgggggagagagtggagcaggagaatgagtggagaccgaccgcctttgccaccccgtggccgtctcgccatcgcaggtgataggggagagagtggagagggacaactagtggagaggagtgagggagagggatgagaaccggtgaggatgagtataggtgagggatgagaatgagtataggagagtgtctcctaaacttgtatattttacttgttgatatcccatgctttgatgtaggatatgtggatgaatgcatgctataaattacagaaaggatagatgtatatgtttaataatgtttaaaatttattttttagtagtgagatatgtatagtagttgtactatgtatttccttttttgtcttgaaaaaaaaggtgtactatgcctttgtgggtatactgatggtcgtttgtcattaaatttttctccttttctgctcacttagctcggtctatcaattacagaatggatcgtggtggttgaataatgcgaaatacatcatgatctgtaaagttcatacatacacttgtttatgatgtttagcccccatcaggatttgatctccaaagctcagatgcacatgtttacttgtacacattcttttagttctaaatttcagttcttttctcttcacgcctagtataatttacctaaataaaaatgatctttcactgctggagaaaccctttttaatcccggttcacaaccccctatagtcccgtttatacaaccgggataacgaatccgagactaaagatgtgtatttttagtccggttgaaataaacaaccgggactaacaaattactcgtatacagtacataacaaatctaatcatagctattttcttacatttcgacagacctcctggtctcctaaggaagagtgagcttccctttacagtgaaaatatcaccaatcaaaagatatgttgtacaaatacaaaaaaattgggaaatacaagaagtggaaactcagaacaataatgttagcagcagcttagcacttgctaataattttacagtcctgtcaagtaataagtaatgcctcttaataggaacttaaaactgtcatctttgctaccgactaaattcagctgtagttgcaatttgtaatcaagtgataggtcacactaggcctcaagctgtgtaatagttcataaatctaggcaatacttaaacaaatatatgagtcaggaaatctgcttgcctaaatatcattctgggacacattttaaatgcattttaaccttgctacagtcaactaatggtccacagagttgacacattctgaaattatttttagttctgtaaataaataaattgtcaatctcatatactcaaactaaaagaagctgataaaaacagatgtgacttgaagtcttgaacaacagagctcattcagcccaagtcaaatcttgagcaaacttatatacagtcagtcccattggggatccctacggccctacccactggatgaacacatcaaggacatgatatgaataatatatccgttagctaattgcttgatcaacacaacttcataactactccgacagtggaactacttttgacacaccaaaaaaatgagataactcgtaaattgctacagtcaagtcacatagataatccctggacaccagtcgttaaacttacatatattttagacaagtttgtcaaataagtattacttgctaaatgagcagaacaaggtccgccaaataccagcatgagtttactggagacgccttccaatacacttgggtacataagacctatctacatcaagcgaaccatgataccagtatggctcgggcacaggccacctgtcatccaagataacttttcctatgtaaattgatcgttgaatacaacaatctaagatgccagaaacaagtggcaatgaagaatccaaaaataaataaataaatacctgtttttcttcgttccctcaccgatatctatgggcataggattgttacatccactgcgaataaaaaaaatttcagtctaaattcttagaataagcattatgcctactagctatcatcaagatataacaaggaaaaaaatcatacctttctgatggtaaatcattcactctgcttaaaacttcgacaatcttatgccttggtaggaaaggagttgcttcacttccatcatagaagttcatgccaacaaaactcccatcaaaattaataagagggcctccaatcccagcctaatacaaaagaaaggacccaatgttactggaaaagttgaaattcctgagaagtcatgtgctgtgattatagagataactcagattctcatgcaactatctatatgggctactacgtaacaaaaaaagtaagagaaattcaccacaccttcttgattttacatgtggacagcttaagatctttgcagtcaagtttgcatccctttttaccacgcttcacattaccaattgtggccatcaatggtccaagtctagtgtcacgtcctatagctactactttttcagatggctcttgcaccgttttactaaaaatatcttctaggcgaacagcattgaaattcttcttgagactgacaatagcaatattatagtttaaattatagaattccaatgtcccacaacaacgttggttcggtgggagaaacacctcaatctgcaaacataaagtgagttcagctagcaatcatataataaagataaagataaatgactaggagaaccaaccgtcaggttactatcaatcttgtcatcattacaacgattgaccaaacttgctgaagtcaagatgacagtgcgcgtagctttgcttccatgccactttataatcaagcctgtgcatgcaaaaaacctcacgaaacctacacattacaactttaatcattagttagtgaaggtaaaattgcatagaaaagtaatgaacatattgctgtcaaaatcaccattgaatgatgcaagggagacaacacgacgagatatatttgtcacaacttctttcggaagttgataccagacacgattcctacaagacttggctggatcaccataagggtaccctttccatgcaagtaattcaccaaagcgttcttcaaaatgattaagcaattccccattcactggttaaagaaacaagatcagaaattaactacaaagaagtgcacaagggagatgaaagcaatatcaaaagcaacgacttacattcaagcacaagtggtggtggcatgggatacccataggattttaaccggtaaatagttttcataaatcctgatgcaattaggagatcattattagtactcagatgatatgtgacattagcataataaagaacataggtaacatttagaatgatgattcgcagtaattgttcatcacctgaaggcacttatgcttgatacacctttaggcaacgaatatcctcggaagtggagatgtttaggactgagagaacacagtacacttgttatgacaaacaaataaatacacacgaactagcccaaccgcaaaaacagtcataccaacacaggaaccaaactgtatgaaaggaaccaaggtatgaaaaatgtactaaaaaaatcaggatattaaatattcaacataagacatgagaggactgagcatattcaaatgtaagaaatataagttgcactatccatatggccaaaacgaattgttttgagtttaaacacttcctcatttaggaaatacattaagcatgggcactaatttagtaaaggacatgtggcaccgatgttggtaaccataaggtagaggtatcaagaatccaaattgtttcaatccaaagattacagtgtgaaaactctgaaggctccaatgctgctagaatcaaaagataaccatgtgaaaactcctaaggtcccaatgttgttagtataaaaatggcttaccttaaacaaagggaatatgagacgaatttggaacagctatcaataagctaagtggggaagaaaaaactcaaataaaggatgtgtaaaagacatacttcaatatcccaaaatgctccaaacgcttccgaagcaatttcgttggtaggaaagcatatgtcaaagttccatcatcatcatggcaaatgctaaagttcatcccaataaatcccttatcctttccaagaagcggccctccaagtacagcctaacaaaagcaaattggtaggataaaggaaaaaatgtattgttttttttttacttcgttgcaaacaatgataccttaagaccatcaatattaatgcaattatttaattcaagttttccatcataccaaaagtaacaaacagattataacaacataccttagagatatcttgactatctggaacccaggtgttgttgcagcgaacaaaaccatccatagccattaaattgcctgactcgaaggcacgcccagcaactagtgcttgaataccatcaggacaggccttaaaacttataggacggacctctatgagcccaaagcacgtgacaatagcaatatcatggtcatatagtcctaagaacccatcagtaattctattattaggaaggcgcactgcaacctatagtgataaaagcagtacatcagcatacaatggccacaatcagtttggataaataaagcaaaatggagggcgtaatgaaggccaaataaaccagcaaaatggaggacaatgatttgcagcaccaaccctcaatttatcatctctatttctcttctcgtcgaatactctaaccaaagcagctgatgtcacaaatctcgttaggtgttctctagttgtcccatctggtagaggtattcccgagcatgcaaataacatcttatctcctgggcaagatcatggtttaaataattaagaagtgacaactaaatacaaattacgaaaatccataagcatcggagtgcactcaccatcaaacaaagcaagggagacaacaatggtagacaaatctacatcaacattagcactgattcgataagtttgttgaccgggattgacaacatggccaaatgatttctcttcaaaagcaatgctcgaaacttctcgatcacgaagatctttgtcgaatcgttcctcctctatagcacacagattgttgtaataattagccactgccttccgaatctcttgatctgattaacgaacatgatgtatacacaactatgagtgttttattagagcaacatgtaccagaaaaacaagaaccaaaaaattcaaaatcaatgacgcacattttctcatattttttaagccgcggcttggcttgtctttcttgtcatcacccctacttgaaagcaatgaggaatcaagtttgttccttctgtttatggctctttgctccctactcacacctcttgtgcaatcaatctgtgcctcgtttctcagggtctttgcagtcctgaagaagaaaggaaatgcaaatggttagtcaaggtttgatcataatgcatgtgtgtcacgcccgaaaattcacaagtaatttccaaactaatttgtgtattaaaaatcctcgtccaggaatcacccgaggtatacaaactgacaatttataatatatagattcatcataataactaaagtgattaaatacttacatatgaggcacttagtcctcaccacgaagaaaactgcagcagaaaagaaaatctagcgnnnnnnnnnnnnnnnnnnnnnnnnnnnnnnnnnnnnnnnnnnnnnnn

SEQ ID NO: 31007 - DNA, 5963 bp, Oryza sativa
  unsure (1)..(5963): unsure at all n locations
cagacgatccaggtggttggcgagcaccctcgtttttaaaacggcgacgtcgacgtgaggcgactacgacctcaacatcgatgtccatctctctctaactttgagtaactgatatgtttatctacatgttagagaacagtgagtgcatcagataagtctcggttacgtgaccctgtcacggaagtcgtaaatcctccgatttactgtcatctgactttgaacgattgacgccccacgtgtcagcgactcgctgtagagaacagtaaatccgaggatttacactggtggagaaaccctttgtagtcccggttcgtaacccccctttagtcccggtttccaaaccgggagtaccaatccggaagtaaagatcgatctttagtcccggttggtaacaccaaccaggactaaagatcgagctgaccttttttttttgcatgcccctgttgctgcatggtttatatatatatataaaccatgcatatatatgtttcaatacatatatatgcatacatatatatgtatatatatatattatattatattatatgtatatacatgcataatatatatgtatttatacatatatatgttatgcaaatgcatatgtatatagatatatatatgaacaaaatatatttacattatagaaaagtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttaaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgatggaaccgataccaagccctacatggagtttaaagctattattcgtagtagcaattaacataacaagattttcttaattaacaaaggaacttatgacggtacctgtctataagttcgaaaaccttgtcaaacgtagactctttnttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcaatgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccaatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcagcgtcaactttcgccttctttgttgcccttgtgtgggcaagcggtggagctgggggggcccttgactttgaaggtaccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaactttgaccttggagtatcctgctggaatcggcctggagtggtaagtacctgaagggtccgttgggatggccatgcccgacgccaccttcatattgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctactcatccgactcctgtacgtgtggatgtactccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaaggatgaatgtctcgagcattgtggtccacagcatctctttctccgaatctgggacaaagctctcatgatcttcgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgttaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcgtttctgcaagatacaaaaaaatgtattaggataaatgcgaagtaacatatatatatatatatatatatatatatatatatatatatatatatatatatatatatatacatatatatatatatatatacatatatatatacatatatatatatatatacatatacatatatatatacatatatatatatatatacatatatatatatattgacggagcttggggctcctcaccgggagaccgcgcaggcccccctttgccggttcggccgggggccctgggtgagattctaagctcctagtctgtatgtggaaggttcgcgagagtagaaacacacaagacacgggcgatgtatacaggttcgggccgctgagaagcgtaataccctactcctgtgttttggtggatctgtgtatgaagaagctacaaagtgcgagccagcccccgattgttctgggatcctttttctctctctcaaatcccctcttctaagtgggcaaggtcctccttttatatctcaaggggataccacatgcaccatctctccctctctttcttttgtgtggggactcatcctctcttccctccaatttgacttctcttcattgatggacggagatttgtatggctgccatccgaatgaccttctgatgggacggcccatacctacctccacttccgccggaagcaggcgcgacgtgggaacatggctgtctgctgacgacatgaccattgtcagaccggtctcaaatcggtcattcttgtacaccacgtgtcagtttaac

SEQ ID NO: 31008 - DNA, 20152 bp, Oryza sativa
  unsure (1)..(20152): unsure at all n locations
tacgttgtatacttaaacatgagacatcgtacactctggcgatctaaaaattaattactagtgacagtgctggtcaacagtgacgaggattatttgggaattaaggatggtataaaaataccattgtattctctatttgcagctgaaaaaaatcacaaaagtacaatgcatttgattctcaatttacaaactgaaaaaaaaatcaaaatgaaaaaaataccgggatcatcataaattcgctgcaccgctggatcgatcgttcttgattgatccaacggccggtacacgtgtggggatggtttgaagtacatggttaatgttgtgcaggtagctcaagaaagccttgagttgggtttacctgtcagtaaaaatggtccctacaaacaagtgatcatcagtaatttctagcgatgcttttgtctactgtgcatcatgttctctggtcacacgccattcaatcggtccgagctactaccacgatcagatcgaagagttattgcatgcgtttcctttttcttttatttgtcatgggtttttattttttcttttctgattatatatatagaataacacaacaaatatatagtaccaattatatgcatgcactttatatgctcacaagtacacaaccatggttagtcagtgatacagctgtttagataatggagctagttagtactactgcttaattaagttaggtctctttctgttacctttctattttttgtgcagaaaaaagaaaagagctcctgaccaattttagctatcacttcccccaaaaaagcgcagtactgaaattaattaccagtggtggttaggaaattaattaagaaactgtgtgaaagtaggaataaaatgaagaaaggagccgaggtaaaaaaaagagtacacaccaaattaattagatgtttacaaacattttacaaattaatcacaattctcaaataaaagggagttatcccaactatccttattaaatctacttcatatggtgcatattagtaaactataaagatgcttgtgcatgtactattatcatttatcatacagcatgctacccttattaaatctactacaagtagtgcatattagtatactataaggatgtacatgcatgtaccattaccatttaggcattgtttagttccaaactttttcttcaaacttccaacttttccatcacatcaaaactttcctacacacataaactttcaacttttccatcacatcgttccaatttcaaccaaacttccaatttttgacgtgaactaaacacacccttattagaaggcacgaattttggtccattatatatatatacatatagagagatattcgttttgaaaatatcgtattagactgtttccgatcgtcaaaatattaagatttaattatgggcaaatgcataatagattttcttttcaggctttcagtctctccaccatgttttcataaatttcataaaaacctataataacatgaaggagaatacagtgatgattgttgtagtagaacagtagaagtacacactctttggtactacactccaatactccatcgctcatcgacagagaagtaaatgggatcgtgaagctagagctgcgctgcactggactgagctttcaaccacactgcatgtgagccagctgctctgctccatactgcccccatagcttaatactaacagctagctagctccttcttcttcctcctcctccattaatggcggctcagcaagtttggtttgcctttataagagcagctaccttacccctagcctagccaccctgtaagcagcaagcatcaatattgtactgacgtggatcatgtcttcttcttcctcctatggaacgtaggagtggtacagtacgtagtaatggtagatagacactgcctttcaccggtttgggcctttgggatccatggttgccggtttcagtggtgaaagccagtggcttttcagttggagaaaaatcggagagtatggttaccccaccgaccgtagtccgacctgacaggtcagcaaaagcgggcggtgaggtggcgcatgcgtggaaatggtgtgcccacgtgtataaagcatgggccgaggtttggtctaggaataacaactgagatctatcaattgacggagtaaaaaaaatatagaggtcaacagtttagatcgattgtccgtttgatctagttggtcaatatatttaagtttctaagtaaatgcaaggatttttatttttcttgtggagaaggcatttttctaaatttatttacatttagacaccaatacattatgtattggaatactattatgcctctatccagtctccatctctccgatcaattaacggatcaaccgatattgcaacaaaacatacatggcttgcattttaggattcatggtgcataatctccatgcatggatgaagtagtaatttggagtgtaaactttgaacatactctatctattcagacatatttgacatttagcataaatttcggttgaactaacaataacttttaaaatgcctatttttttattaaaaaaagtatatgtagattcaccatagaaatgtaagcagtaacattattataagctcattagattttgtaaacacattgtaataaaaaaatccacagtcaaattcttaaaaatctgactaattaaatcttattctaaacatgagatttgttttcttgggaacaaaataaaaggcccacccttttgcttattcctggaataagcgaaacgaagtgatctttgaataaacctttatatacatgttcttaacgatctaaaagcaaaggttgaagaataaacttcgatgaaaaaaaccttaaaatcaccttcaaatttaaggttaaaaatttaaattttggctgataagtagtataagcatttgttggaatgcatatggcaggacgcacgcgaacaaggtggcgctggtgatgacgtcggagtcgatcgccccaaactggtacgccgggaacaagcgcagcttcatgctgggcaactgcctcttccgctccggcggctgcgcctacttcctcaccaacgacccccgccaccgccgccacgccaagctccgcctccgccacctcgtccgcacccacaccggcgcctccgacgacgcctactcctgcgccctccagatggaggacgacgccggccgcccgggattccacctcggcaaggacctcccccgcgccgccgtccacgccttcgtcaagaacctccgcctcctcgccccccgcgtcctccccctccccgagctcctccgcctcgccttcgccaccttcctctcctccggccgccgcagcggcggcaagaagacctcgccgtcgcagcagccgctcaccatccgcatgaaggccggcgtcgaccacttctgcgtgcacaccggcggcgccgcggtgatcgacggcgtcggcaaggggctcaccctgacggagcacgacctcgagccgtcgcggatgacgctgcacaggttcgggaacacgtcggcgagcagcgtctggtacgtgctcggctacatggaggccaagcgccgcctccgccccggcgaccgcgtcctcatgctcaccttcggcgccggcttcaagtgcaacagctgcgtctggaccgtcgagaagcccgtctccgacgccggcgtctggaaggactgcatcgaccactaccctcccaaggagctcgccaaccccttcatggagaagtacggcttcgtcaaggacatgatgaacttgtgatcgatccatcaaattccccaattaattcctcgatcgatctctcaagaaccaatataatcaatcgatattgcatgtgcttgcttgcgtgcatggattaattaagcgatcggttagttaattaattttatcgccatttgctgcagctctgttgatgattaggatgaacattatatttacagggagggggaagaagaagtaagaacaatcaatgagttgaacaaaaaaaaaactaaggattcaattcataggtacatatagcagcttgtgattccataattttcttttcagcatggtggtagtatatggattttatttatttatcttattttttttgttgttgtttgtaactctctgtatgttgctagctacgagtgtcgtcctagctggtggcaggtgttgtgtctttcattaattgttcatggtgatggactatttctattcaaggatcaaattaaattatttttttttgaaaggaggattatttatcagttcatggtcatgtgcaagtctcatgctgcaataaatatcatataccctgtaaagatacaaatagtatactatgtactagctactataaggagtatatgttttattcatatcttttgagaaccaattcagacttgattaaggtttatccttttttcattctaagtatttttcctaaaacacaatatacatatagaggctcatatataaacattagcacactcttattcagagttagagcatcccagcaactcgtctaaatttgatcttccatatagctatatagatggtcataaaaaaaaggaaaaagtacgaattactccctctcaactattgcacgcgttcaatttacccccctaaattacaataccagatatttttaaccctaaacttttcaaaccggacaaattacccccctaactcacctcgaagcggttttgatccaacgtggcgcacacgtggcggtccagtcaaccaaaaataatactcctaaaaaatagtggctcccacttgtcagcatcttctcctctcttctactttcttccaccttcccctcccatccatctctctctctctctctctctcaccaaggagcaagggccggggaacggcagcaacggcgtcaccagcgtgggaggagacgagcagcaggcagcgcgcgtctcgcgaccgcaacggcacgagctaggggtggcggaggacggcgcgacagtctaggctagggcggcggcagcgttcccggggtggaaacgggtcggcggcgggagacgcttggcagtgcggcaggcggcaatggtgtgcgaaacgagggcggcaagatgggacgcgaccttggcttccatcgacgcacaggagggcggccggacgttgtcgtcgtcgtccttgatgtggccgagctccatcgccatgccgaagacttcctgcaacctgcagatgctcctgaggaccacctgcatcacgatctggaccacgcagtactccatggacgccaccgactcgatccctcatcaaacagaaactatcctaccatgatccatccagccagagatcggtcaagaaccgaatccagtgctatcaaagtaagatcgcaacaagcaaccatgaattgattctagaatgcaaagtaccgattatcagaaaagaacgagagcaatgcaatagattaaaagggaggctagcagtgacggcaaagatgccaggtcggcggctgcggacgagtgtggcgctggaagcgcaggtgcttctggtgggggaggatgccgccacggacggcgcggggacgacacggggagtcggggacatcaccactccggctccgacgaggtaggcagaatgggctactgttcctcgacgtcgaggcacttgcacttgcgggcggagggtgaggggtcaacgaggacgaggagcgcggcagcggcggcgaggtggtgagtgagaaggaggaggaggaggtggatggtgggagatggagcggcgtcatcggtggccgtggcacatggtggtggagactggagagaggtaggaggggagagatctgacgatgggccccaccgacttttttttaatgaattgctgactggattgccacgtgtctgccacgtaggaccaaaaccactccggattgactaagggggttatttgtctagttttaatagttgagggtgtaaattaaatatctggttttcgagtttaaggggataattcggtcgaccgtgatagtttaggggggtaattcgtactttttcataaaaaaaatttcctcctttatatttctctccacttctacagatcatccatattacatcatctatatcacatcctcaaatattttaagagtatcttttaactaccatcaattaatattaatttttctttttttttcaccattatccttctctttcactcccttctctttcactccagaagtccagagagcttgagagaatgggaggacgcgagcgaaggacggaggagcggaggggcacgagcagctcgccgccggtgggagcggaggggcggcgcgagcggctcaccgccggccagagcggaggggtggcgcgggcgaaggggcggcgcgagcagctcaccgacggccaagcaaagtggcggcgggagtggaagggcggcgcggccgaaggtggtcgacggcgggagcggccgacgaaggtttgcctcatcctctctccttgatctaccttcattacttcaccctctgcctcgatctcgattcggatgggatgggagaacggatgggagcggtggttgcgggatggcatgaggagagagaactctgggaatagcgcatgcgccatctatggaggcctagagggggggtctaatgggcgatcgatcgctagggcgatcgcccagtgatcggtccacccccccagctcctatagacactcctcccacttccccccttcctcctccccttcttctcttcctatcagagtacaccacaaaaaaaattaaaaaaacaaaaagttagaaaaatttatgtataaaaaatttgaattcaaattcaaatttgaatcaggtatgtaaacttttgacttgtagattttggatctataaactttaggtgtataaactttagatgtatagaaatactatatatgaaaaatatttgaattcaaattcaaatttgaatcggatatataaactttaggtctataaactttagatgtatacaaatactatatatataaaatatttgaattcaaattcaaattcgaatcggatatataaatttttgacttataaacttttggtctcaactttagatgtgtaaacttgaggtgtataaactttaggtgcataaatttactaaaataggaaagtaatacggtgccaaaaaaggaaaccaggtggaggaagggagggggaggagggagggaatcgatcgctcgctcgctcgcccagtagcattcccgaggcccagatggcgtatctgttggagccggattttctccccccatacactattttctggatggaagatgggatgccggaattgatgggaatgctcttagatcgcaagttttattttttattctagtattaagtaagtgatgcatcattggttgatagagatgcaactcaatatgaatcattgtgggcagcacccatcagggtttcccaaaccgccggggccagggttaccgcgccccggcggtaagcacggttaccgcgcagtaaccgcggtaaccgcaaaaaaccgtacaaaaccgtgcaaaatttatcaaaaatttaaattattttttaaatttatttgaatttaaggaggttacaacggtatttatattaccgtacccccgcggtaagcccggtaaccgcgataacctcacggttaccggcggtaaggtaaaccctggcacccatacgacctaaccatgtcaagattcgatcggtttttcccttttagaaaaaagtaagagatcaactacacttcatttcattaagaaagaaaacaaaccgcccatatttcattttttaaaaaaacaaaccgcccatataaccaaggcctcacgagccattcattaaaaaaaaaggctcacaagcacttcgtcaagaacttatccacaatgagcatcacacaagacgacacataattattttctttttttagaaacaacgcagacactcaccttacccctataagcatcttcaaagactgcgcctcactgttgacaggtacgtcgcctatcactaaaaacacagcgccgttaaatcctataaaattcgctctcatggggagtcgaacctaagacctcaggtgctactgaggcttttgtaactattaggctattaggctacagtacggttgtctccgctatagacccgctctcaatcctctgggctatgataaattgataatgggaaacagctagcgccgccggaccggctggcctgcatcttatgatagatgttccatgatccaagcacatctacctgtagttactgtacaaacgaaatcattaggttatatagctcatcgccaactagccaaatccctactcatcttaaatacacaattactccactaattaggaccatctaaaaatatcttgagctagccgcaatgccaactcacacacagagaatatagtccctctgatatttagaagggctgaatcagatgttcctaatgagactgcatccgcattattaactaataatacagcaaattaatacaagtacagtgcgacgtcccattcgcaaacaaacagcagtgctctgatcaatcaattaacgaaaaaggggatatatgatcccaattgatgtgctgttgatatgtgctgctgtgatgccacgtggagagggagagccagacggatggtgatggtgacacattcatttcaagcctaatcctcattcatttcgtatcatatataatcacaattgctgattgatgacaagttaattaactgtactatgtatgttgccagcatcgatcgtagacatgcagatcgacgcggtccccgagtggatgcaaattaatgcctgcgccattttctttctgctatggtcatcgtcgctacttcgtgttttaggtgtagttgagaggagtggaaattagacaattgagagtgtcattaacatataattaactaagtattagttatttcttaaaagataattaatatgaatatttaaaacattttttctagagatttttaaaaaatatcatttagtaatttagtaagcgtgaacggcaacgggtaagtttttcctatttttgtgctattggcgaaagcagccctatagttttgtctgaaaagttaaataactatagctggtaagtctatacaaaatcgtgacaaacatatcaaattagtttaattaaaatcaacgataacaatacctatttcttgatatatagtgtattaacttaagtacagtagatgttaactatatatttatagatttgctccaagttaattttttttgacgtagttcaagactagaacaacttgcattttggaatgaagtatccggtttcttactgacattcgtctctctaattaagcatgtgcgaaggagcacatttttttgtacatattaatttgatgtactttctctgtcataaaataactttatttttcacataccctatatatatatatatatatatatatatatatatatatatatatatatatatacacacacacacacaaataaaacaaataaaattttctttattttataaaatcctaatacaattttcttatgtttatttttttggttttttgggacggatggagtaagttgctggtgcgcacacgccctgctcatgtgcaggttcacctggccctagccctggagggaggaatggggcaaaacttgtaacgaagaaactgcttatccatatattatgacaccatgatttaaatataattagtatactatgacattaataatagacacgttatgacaccaacgaaacgattttctggatccgccaatggcaacgagacagcacggcgacgagccaacgactgactaggtagcgacgaatcaacgaccaacgatggcagtgcggagacgatgcggtgcggccgcgaggcagcatgccgacgaggcgcgcggccggcgacgagacaacacgatgatgagggggaccagcgacgaggcgagcgggagggagaccgacgccgtcgtcgtgttgtggtgaggaggccacacaacgacgcagacgagcgagcgaggggagtggacgggaggttggctacggcgcgggtggcgcacaacgacgcggatgagcgaggggatttcgctggatatgcaccattgagcatgtatcgatgtataagattgattgatgataaggcatatgattgattttaaatcataaggcataggtttccttatatgtgtacatcccttcatccgtttgggcctatggagtaacgggccatattaacatagacatagacttttggggcctcatagggtcacctgcgggtcagctttcatccccgccccggccccggttatgttcagggccccgacccgatcgacccgcgggttaaaaattgtccccggccccggtccgcccccaccggcacgtcagcacgcatgcagtttgctgtgccatatgggggttattatcaggtctcaaagaccgtgtttagttgttttggcaaaaaaatttgtatatacggacacatatttaaagtattaaacgtaaactaataacaaaataaaatacaaattccacctgtaaattgtgagatgaatctattaaacctaattaatccgtcattagcaaatgcttactgtagtaccacattgccaaatcatgatgtaattaggctcaaaagatttttctctcgtaatttacatgtaaaaactgtgcaattgatttttttcatccatatttaatggtttatatatatgttcaaatatttaatatgtaacagaaaagttgtaagtttaaacggaactaaacacagctatagccgcgccgcgtcttgtccgttaacggccacggcactgaggctttttgcagctatagctgtcgtggcggccgtacatataggagacggacaaggggaataatggatgcgccggccagtggggagtgaccggcgcaaggacagcaatggccaatggttttgatggatcactccactgtccgtcacttcatcggtatgtggttgtggtgtactgatatattagtgcatttgtgtcaggattattgataccacatatctaatattagttgactaaatatcggtaggacccaccacataccatgtgttatacggaaacaaccttcggatgcataagaaaggatgaatagagttctacatgaaaacgacaaggactactcagattgtattcatattgttttccctagttctacttagacaaagtgacatttatgggtataaatacaaggccccataggaggagaggggacacggaacaatagatcaagacacaagatcaacatacaagccaacatgcgccaagacaagacgccggatatcgacttcagagataagcatggctagtcccctacggtatctacggatactgtcaggagagacatagcgctgtctttgatctcgccggatgcagattcgaggagaaagactaccttgttgtcgactacgagtcacacttcagaccgccaaatcaacaacagttagataggctaccccaaatattgtactggtgtgattatggtgaataagagcaacgaccggcttcggccaacaggagtagggttattacctgacaattcagggggcccaaacctgtataaaaatcctcgtccacatctcttttattataatctcgcatatatcctagtaccaacgatccctatactatgtaaatgaaattgcgacatcaaacgtcggcaatatgaatcgaaaaaaaaaaggagggtttggcttacttatctggactgtttaattagctcttgcgttgagatatatgatatcatgatcgaacaagagaggcggggctagctgtaggcatgtatggatgcacgttatctatggtactgtttactgatatgtaagtctcacttgcactctctctctctcgactgcatgtaccaagatgcatgcattcccttcatgagttgatcatatcaaaatttggtcctgccaaatgattgttactgttcagtagttagctgttgatttgagctggaattggagcttatgtacgtcgaattgaatgtgaagaggcggccggcgtcgcgtgtgtatatatgctcactgctcaacaccgtctcttttaatttcgttctgctgtactagagttatgagagactgtacaccgtactcatacataggctgtgtttagttcacgtcaaaattagaagtttagttataattgaaatgatgtgacggaaaagttagaagtttgtgggtaggaaagttttgatgtgacaaaaaagttataagtttaaaaaaaagtttgaaactaaacacagtcatattcccgtaatgggcagcaatgatgggcgtggccgtatttggttatgaggttgatcagtaatcaggcttaagacaaaattgtcattaaaattttttttgtcagcattcgaatattttggagtaatcacgagacagagcatcaccgggttcgatcttcacgtacctaaattgcaacaaggaaactttgaaaaagacgtgccatcaacaatcccatagccccatactctcgattcatagcccccacaacccactccatcttcttcctctcgtcgctgccccatgccgtcttctcccggtttgtgatagctcatgccgtgtttttttcattgagttgaaaacttatcttccgcgcacttaaaatagagcgactcactgacacatatgattgattaagtattatctggagtaacttttttaaaaaataaaataaattaatgtgatttttaaagcaactttcctatataaaatttcttataaaaaacacaatgcttaatagtttagaaagcatgtatgaagttgagaacagtgagaaaaaaaaacacatccgtcaccatctaaccagttctttcttttattacttatttctgccatcaccaaggccgtgtttagtttcctccatattctcaatttttcatcacatcatatcatatcaaaaacttttctacacacataaacttttaactttttttccaaacttccaactttctttcaaactttcaacttttttcaggatctaaacacggacttttaggtacattctactgctagtatatactactagtatatttgatctaatggtgtaaattcatccgatcttcctcccaaatatcctgcagtataaattatttagagtatatttgtctttttatctatttgcgtggggggtaattttttaaattcgtgtttcctcacttggtcagatccgatcgatagccacccacctagtcgaagcccctttttttctcgatgctgcgcgcatgggcgatcatcgctgctaatttcttctgcgagctgccgacgaccacaatctgtgccgccgcgccgccgttctttcttaattaagttcaatgaattaaggactgtatgtgttatggattcagacacttagaaactgatcgaaccaagaatgtatgagataatccacttcattgctatgaacagatcaaatctatttacactattatgtggttttatccctgaccagttttttccctagtgttcttatgcaaatcatgcccattgcaaactcaatctactagattaaatccgatcgtcgaaggaatcgctatgcctccactcacgccgtcgccacgcgcgatgggagcgctacaacacccggacaacgagatccaggaactcctgattgaattaaatcgcaagaaataaatctcaatttcaaattactaaacaacccttttcagagttttaacaaataacaaatctaccctttcacatactactagtatatactagcaatagaatgtactataaaaagtcctcttcgtaaatacgaggaatcaatcgaacaaacccttagaaagaacattttctcactttacctgctctctctgcttagtatgtgtttggatggagggttttgggtgtataagacatggcggtctatattttttttaggtgtttagttgctgggcaaaagtgggataggacggcccggaggagaatattcccccagatgcagccgcccaaggctcgggcgagccgggcgagcgaccaaaggagggtcgcgtcacccctctccaaaagcgagaacgacggcgacgcagcggctggtgcgtgcggcgagggcggcgaccaacgcgagacgcgagagccatgacggcgggaggtgagctcgacggcggcgggaagaggggtcgacggtgtgcccggaggcggcggcggcaggaggcgagctcggcagcggcacgggatgtgagctcggcggcggtgggaggagagcgaggcagccaaggcggaagaggggccgacgacgagcgggaagaggggtgacggcgagccggcggcggcggcaggatgcgagggcggcggcggcgagctcggcataggcccgggatgcgagcttggcggcggcggaaggcgagcttggcggccgacgcggaagagggggcgacggcggcaagaagcgagggcagcggcggcgtgcttggaggctctctttttttccccttttttctttgttatttttctttttttttctgtgtggatttgtaatcgggttttgggtctcgccccactcacgttaggagagaaggtatccactaacccaccgtggcagaaaatcaaatattgatttttcttattttgcaaaatatgttcactgcgcggtcttggtggcgctatgttctgcatgcaaggccatttgaaagttctgcatgcaaggcttgctaatccgcacgcatacaaggccgtttgatcaggaagttgttagtgttgaggttgttaccaagatatctatttaaaacggcggcgaggtaggtcagaagaggagggatttgtgagcagaagcagatcagttctgcggaaatttgatggagcataatcttttgggggtagagggcagaaactcgtcagcaagttcagaaggcggaaccttgtcgacacatgatgtcgcatgcagaaggcggcgatagccgttggttcgtccttgccggcgagttcaggcgagcaccacaagccgacggtggaagaaggtggaaccgcgtcggcgtctcggcgagtggtgacatgcagcagaagccggcggtggcgaaaggctgatccttgccgacgagttcttttgctcagcacaagcgggcggtgcgggaggacggaggtctgttgaatggacacgagtgtgtgcagaactcatcaactgattggtacatatcgaagattcaaattggttgatgtctgtttataattttcctcttgtttgtgtgtttggttctgactgtgtgttgcgttctttggtcaggaatggttttgtgcaactgtgcattgcatggctactggtgataggagtgaagtgatgaatcgctctctccagaaatatgacatccatttccagaaatagtcacacagtttgcaacatgaatttcagaagctgcggagaacccccggcgccgcagaagttgttccgatcgaacatctaaccaaggagaacatttagccagttgtttaatgagcagatcatatggaataatggcttgctttctgcatgaccgttgattagtagtacgaactatctatagttatgtatgatattttctatgagagaaacgcgactaatatttgagttgagttttctgtaacttctactcgttggagtgaaataaaaataagaagttttccttcgtttttttttggctattttagcttattgtgttatccaaattctctattgtcatctttgtccgctatgccccatctttttgtttcgtagttgctgactgtcgtgtgaattggagcagtacaagttcttctgcttcttctgcggatgtagcagaacatggatcgtagttttctgcttgtgtttgtatttgggtttagagatgtagcagaacatggcgaacagcagaactgggagcagaacatgacttattatcgtccagcgtgttcgtttctggtgaaaacataaacgagagccaccaccacctaatacattcgcacctgctgcaggactgcaaatgcaaaatataaagaaaacgaattaggaacagaaacgatcaagaaaagaatccaaaagatgaaaaaataagcagcaaaccttagaaccggaattctccatatgctagagctttcatcgttatctgctacacagccgccggtgaggctactaatctgagctcagttcggttatgaaccatccaaacgtagagaacgattttagatcgataatgttctgctcttccttcacgacgggagaaatatcctgctttctcgctgtggataaacaaacataagtgcaaaaaaaccacccggatatatctcttgttagctcgtctccgatcaaatctcatatctacaaactagggaggctacgttcaatttttgaatctgctgtagaagataagttaaccaccgagaaaactaaaaacgggtgggaatattcgattcattagacccgttaacagtcattagcattatctagtgctagcgatcgaattgagggaggatagggagggagtagctactcccggtagtagtttctaattttcatatatatatgaattttttatttgttgggaaatttgtgaattgcagtatatatatgaatttgatggggtatactcaccctctctaagtgagaggtgaccacatctgctcatccaccctactccctcgaaccaaacaaaaaattagatcaccaaatccaccttcatcactgcaaccaaacgaaaaactgtatcgccacattcacccaaccaaacaaaaaactagattgccatatccaacaaaatatggatcaccatatcccatcctgtcttgaccgtgaaccaaacacacccttacttcctgcaaccgccgctccgatcactctcttcccctgttgctggttctacccgtggctcaattatgtttttttacccaacttgtcattattgtggattattattataaattgtacatggagcgttatttatgatctttatcgtctatttatatgtgtttagatgcttaacatatatataaatgtggtctatttatatgtgtttagatgcttaacatatatataaatgtgggcaatgctagaaagtcttataatatgaaatggatgaaacggaataagtactattttgtaatgttcaaattacagcaaacgtcacaccaattattttccctctgctacaaaatttttcacacttcctaactttccaaaatttgtttgcaatttttcaatcctaaaaataccttctttgtgcgaacatatgaaatagatcgatatttgtttggctactgtcattgctaatttgctttgaaattttttttttgggtccaaaccgtgtagttttcgccagaaaccaagcatttgcacggcttcgtcatatttcaaattgaattggatctcttcaacaacgaaaaccacaattcagacagccagttcttccctcactgaaccgaaaatgacactgccgtagaataaatccctcgcttaacgattatattacggaatgtccattgtaaaatctatatacactgtgtttctcggaattgatacccgcaaagggaagctcagacatcagttaaagagtctgtaaacaaaactttttgacgcagagcaaagatgatgctgacgatatgattttgtagtttactgtacaattatacaacaagagctcttttcgagctgtgagagtgtgagctactgagcttagtggttccgtagatttatatgccctctgatttcaaggaaaaccccatgaaccccactgaaacttgtaaggggccaaggaaaagccgaaaaggaaagtatatatatgtatgttactactcagttgttgcattttgcttctcttttttttttgtggtcagcattcacaacgaaatgcagagctagggaaacatctattgtcgggtgctatctttctaacattaatctcgttcattgcccggatcatttgtggggataggtgtatcctgtccatcaggtttaccttgggggcatcaaggattgccttgggtggagaacgtgcccattgcattgcccaaatggcgagaggccgcatgtagatgagcgacctgtagtgcccgtctatggtccagccttccggtgtttggaaccaatacctgcaacacagcaagaaaccccatgttatctatatcacaaagcaaacggtggttgaaacaagagagcatcaacaatatctaattagtatttttaatgaaattgtcagtgagaagtagaacggtattcataagggagtggtttaagagaggtgcgccagagcaaaatcgatgcgaagcaagttgcattgttgtgaattgcgaaatatgagattattcgaagaacaaggtagtgcttacccatatccttcttctgaccaaccagcaataaaaattccttcggcagtggtgaatccttgatgctccattccatggagcagcatgtttgcagcaacaccgtatgtaacaccggtccagatttcccgagattgcatgcatgtctcatccactttcccattaggagtcataccatttacagctcccaatcgtcctcctttaaccttcattacattgaattcaaatattttctgcagagcacttcttattttattctcatcgaaaagcgggggcaagcctgaagaagcagcataccactgccctgccagctgatccgcctgaatagatcggctattactgcttgtgccactgtcataattgaagtaagacccattccataacttagcctcatatactgctttcgcttgtatgaatttgagcttgtatttttcagcaaatggccgatcaccaagccgatgagccattgtagctgcagcctgaagtgcagcaagccagagaccgccacagtaagcactaattccgtgtacagtccaagcatcataggtttgatcaggaaacccatcattcattcgtcagatgagagcgcatcgacacgtgcacggtcagacagttgattgcagtaatagtcgcatgcatctgcactagacggtcaggncnccaagacattctgctacgcaaaatgagcatatccacctggtagacagcgaaagtcctgctgtatactctggagccacaaacttttggatttaagatcttctccatttgctgtgtatcagtgtatgttgtacgncattcatttcagtgccnatggacctatgtgttctnaggtcatgcggaacggcacctttgaccttgcgaattccagaagtaccatcagccaaaaatttcattcttcgtctgtcttcatagagaacagcattggcaaaatcacgttggatactcaactctattttgggaaacagatcaagcagagcaaaagaagcatagaaatgcacatcataggtgcaccacatgatgtattccactccttccaggtacaaaaatttgccaacattttcagggccattcttggaaagcaagtatggaattggctcttgtgacccaagtccgttggttgccttagccatttgtggtccatgtactgctgcatactttgacacactttgctcttcgccattagccaggtcaccaccattagtgacttgctctgctgtcagtttgacatggttatctttaactgattcctgtttagtgtctctagtgcccctttttgaagatttctgttgattagaaccaggacttggtttttcatcgataactggtggttggccatctacaaaggtgatgctaaactcaggtaccgcaaagaagtttcaagagtaaaaggtgcaattttaaaaattatcctaacgacatccagattgtaatttatgatgtacaactgaacaagcacaaaaaccacaccattacaaagttgaatgaagcatacctgtccaaacagtacccccagctaccagaaagtaaagctcattaaaaagtgtgaacttgtacctgcaagcaccatgaaaccccaaatattctagttaagattttgtttttctttgggagatttagatgtttactgccaaagttctttactgaagaagtagaacacatcagttcagaaagaaatatagaactaaggttgtaccattctggaagtttttcattcttgagtatggggttttgccacttctcaatctcctcttcccaaatcctatattctgcaaaaaaacatagaaggaacatccaacagcgtaaggtcagaaaccaaggaccaacattgcacatctgtccctatcacagcatcatttaactttgttgagaatgtgtgaattacgacagcaacaagtaattactgcattgtgtgtgaatgtgtacaagattaagatgtctaagtgact

SEQ ID NO: 31009 - DNA, 404 bp, Oryza sativa
  unsure (1)..(404): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattatattatataaaccaagggcttgctaactttgcttcgaaacccatttttcgtggcggccattttagatttctcgttggcggcattggctgtctgacacaaagcaaaggccagtgaagatcaagatcttcgctaccggttattgaccgccagcaaaaatacattttggctggcgttggcttaagccggccgccagcgaaaatgcatttttgctggcggctgtgttaaatcgcccgcccacgaaaatggatttggggaacaaaaaaannnnnnnnnnnnnnnnnnnnnnnnnnnnnnnn

SEQ ID NO: 31010 - DNA, 682 bp, Oryza sativa
  unsure (1)..(682): unsure at all n locations
nnnnnnnnnnnnnnnnnnnnnnnnnnnnnnnnnnnnnacctagggtcggagtcatgtgagatctaaaaatgtttgtgcggtgcagttgaatggtaccattgcaattgtgaatgatgactgcgaccctaggtctttcgagtaggacgggcagtagggagatatcgatgactattcatcactatcttccttagatgatgaaggcccaacttcattttataccgaggaagagttgcagaatcttaagaggacgaaagatgtcttggttgaaattcctattttaggtgattgcttacaatggatttagccatttctgtccttttaaattgcagtgaaaacaaagaacaaggaatcgaatatgcttgaaccattcatatcttcaacagataaatcaagtccatcaaaaccactctaaaatggattcctccaaaccattcattactatggagtttactaatagtaccaattttctaaatacaaacttgttatgttcatcataaaccacaatggtcatgaaattaataaacaaataatcctaacacatgaaattttctaagtgaacaatggaaattatttcttgaaagacacaaaataaatggggctagctgaactgccacggtaacgagctgggcgtggcagttttcagctgccatgtcacggagcctgacgtggcaataggtgctac

SEQ ID NO: 31011 - DNA, 477 bp, Oryza sativa
acttgcatgctagaaggactaaagaaaactatgaagaagcccatgaattattcaatgatgtccactatatatacatggaaaggaagaaaatctaccgtcttcctggagagactaatgacggcattgaggaagcatagctctctgtcacctgactctgctgaaggtcaactaatcttaaaggataagtttatcactcagtcagctgcagacattagaaaaaaacttcaaaagtctgacttaggcccagagcaaaacttagaaaccctactgaacttggcaacctcagatttttacaatagaggtcaggagaagcaggcggaacgggacaaacgggattaaaaaaaggccaccgctttagtcatggccctcaggcaagtggactttggaggctctggaaatgggaaaagctgggcaaattgaatgcctaatagggcttgcttccagtgcagtctacaaggacgctttagaaaagattgt

SEQ ID NO: 31012 - DNA, 1105 bp, Oryza sativa
caatgtcttagaggtaaaaattatttaaccactttgcataacttgacttatgcctaccaaacttctatttttttaattcaaaaggttcgccaaaggtgccgcaaacttgctgcaagattaggttacaggtcggttggattggacaacgtgtaccaaccgcgaagagtaccaccaccactacctcaatcggtgtgtccaagtactgctcgacactccatcaggatagaagagcgtgaacaagttggtggttcgtcgtcgtcacgcattccacaggaaaggggaaagggaaaggcacaggctccacctagcggcgacgacgaggagaaggaggagaaggagaatgagggctacatcgcaccagacgccgaggagataggcatgtcgcagtctccgatgcacctcatgcatcacagcccacccaatacaacttgtgatccactcggccagcgaaaaagaggtaaaatgagcttaccattctcaagtgttacttgatttccctcactttgttttttaaatgttttaaactttggtttttcaaatgtagatatactcagggcttgcaagctattcggcgccaacggaaaaagtgatttctatgaagttgatctatgtgtcatgtgttaacttgtttcacggacttttggatttgttggttgtatgaagtatgtgatggacttgtagtattgtttgatgtgtggaatgtgtgatggagttgtggacttttttcgtcaatctagttagcttgtggactatgcgatatgtgatttggtgtcaatatttgctgtggaacctgttttgtcgatatttgcattttttgcagactgtccaatgaaatttgttgttggcagggaggtagaggtcggcgccagctaccctgacgtcgtgctgggggggcaacaccagcaaatcggccgaggcagaaagcctcaggggtgggagggttgctggcaccgtgctatggggggcggcaccagccacccgctcgaggcagaaggtctacgggttgggggggacggcgccaagcacgcttgcgccgtgcttcggggggctgcaccagcaattcggccgaggcagaaggcctcgagggtgggaaggggggaggggc

SEQ ID NO: 31013 - DNA, 451 bp, Oryza sativa
  unsure (1)..(451): unsure at all n locations
nnnnnnnnnnnnnnnnnnnnnnnnnnnnnnnnnnnnnnnnntaagcgaactagaaattgggtgtgggcaagaacttcgggatgctgttggactgtccagacatccagaacgtgaccacgtctctccaacagatcgtccagaaggagaagaccggtgagtttgtccctcgacggcagcatgatgagctgaccgaagctttgagaactacagaacactccggtaggtcagaggacagtcgtgcatgacgaattggaaggtagggtttccacaggaagcccaaagttacaagaagcgcgatgcctacaaggccaagatgcgccaggaaatcacaaatcaagtcacacaacaagtcacccaacagttctacagtcttgccgcacaacatcctcaagccttccctgacctggttcctcatggtttgcaggggtaccgagctcgaattcgccctata

SEQ ID NO: 31014 - DNA, 487 bp, Oryza sativa
catgattttctgttgatgtgtgcaagcacgatttctgtagatgtacagcttaatccttgagcatgttttttttagatgtatagcttgagccttgtgttaatcgttaatcacttcctcatttttttaaaatctcaatctgctgcatctggaagtgccagtggaagtcatcatgtgggtgtgactgcatcatcatctacacctgaatcagcggtacctccaaccattgccacaggtacctcacaaacaattgagattgatgctgatgttaatagggttgatgacaatgatgagcgtcctgtgaaaaggaaaaaattgacatcagaagtctggcagtacttcaacaaggaaaaagtgagtatagatgagaatggtaagatctataaacaggagtgggcacattgcaaattcaagaattgcacttacaaaggtagatgtgagagtgccactggaacaagcggattttggagccatctgaaattacatcaca

SEQ ID NO: 31015 - DNA, 575 bp, Oryza sativa
  unsure (1)..(575): unsure at all n locations
nnnnnnnnnnnnnnnnnnnnnnnnnnnnnnnnnnnaggaagacaaacattattgattgcataataagctttacaatattgttggttgcgtagacctgcttgtggcatttccttgtttcatgctcacatagaagtcagtacacttcgtcgctaactttcttcctcgtctggcagtgctgatgggatgctttttggagcattgggtacttgcccagtttgttctagcttcctttactatcatggtggccagtatcattgcagtggctatgtgtcagaatggtccaagtgtacatactctacgacagaacccgtgcgcagtaaaaagaaatggaaaattcctgacgaaatggataatggttatcttacaaaggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31016 - DNA, 37687 bp, Oryza sativa
  unsure (1)..(37687): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggacgtcaggccacattttgccttattccgtcgcatcttcttcctcaagccccaaccaaacaagagtaaaccatgcgtagttgggggggctggatttcaattgaggggaactctgagccaaaagtatttctccatgcccttcaaaacctcaaacaaaggctggcatgcaaattggttctatgtacaaaaccccgagcctgcactccccgagtactcctgtctccctccagtttatcaggactcttggaactcacttccaatgggagaggaagccgctcaggcgcttgccctgatggaccgtatgctgaagctgaaggagcaaggtctgcaaggagaacagatcacccggcattttatcaagagccggctagctccaattaaagagagatcctgtacagccttcaaatttgatggcaaacatgacaccaaccgtgaagatcctgaatctcttgaattcaaggttatgaaggaaagaatgtataaaatcttctcgaatgcaattgtagtcagttattcgcacttgctgccagtggtgccatacaacgccttcaatccttctccaccggtatgtattcaaacatttcagcctttctcaaaagcatgcctttatctactgttaagctaattgaaaactcgaaatgttatacccaggaattcgctttgatgaagtcggatcctccaattgctcaacgccgatcaccccgctggcgaactggtcaggcgagtggaggaccaaaaattcagtctgacactcaaacaaacacctcgaaatcaatcagtcagtcggactcccgcaagaggaaattggttctgagtgatgatgaaggcgataatgctagaaaatctggcaataaagaggtgaccgggaaacaaccaagggaaaccaatccgaagaagaaaacatccagtcgtcccatgccgatttggtccgagatatggctggaaatggatggggattcggtccggtggttgcgtgaagggtttttgtgcagctcaggaggatggattggagtggatttgttaacccttgcttccgccggtgtgcttgcttccgccggtgtggttttgcactgtagcgggaaatggggaaagtggcgagagtctcggcggggaagacgaaacgacgctccgattttggcgtttatttcgctagggtatcgggagtactaatgggcctaggcctaaacagtacttcagcccagttttgctatcagcgtgattaagttgtgatccatagggacttaggcatttgtttttgtttcgtcaacacttgctcacaacagtatagcccaatgctgttaaaatcctttttgacgcagttagataattctttggaattactacgatgcaaataaaaaggtgcataacataaaagtgttatactaattttgtaggcctttttaggctgcaaaggttgtttgggttttcttgagatgactggttttaatacagtcatccactcggcatgttatatgcttattttgattatgtcatgagtcatagcctaggctatttagactcgtcttttatcagattttatgccacatttgataggtcttttgagagtttttactcggacttttatcatctgtgctgatttatgaacctttggagtgcttctcacttgggtttttctttatatttctttggcacattaaagcagtcggcgggaggtttaccagatgctgcatatgcttggccttgagatatttatcctggaatcctttaaagggtgtcgaaggcatattttttggcctaggcctaatatgtctgcagcccatattttcaggtgtggcctatcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttacatagctgccctactgacttttttatatagtcaaggtgttgtttgggtttataaagcagttgattggatataatatcattgctttttgccacgtaagtgtgcatttttattaactaatattatggctttggctgattatatattgtggtcattttccaggcggttggtaaatcgtttacgagtttatttactcggatgttacaccacatatgccatatattttcaggtgtggtgaaatcatgtgtcttttagggacttaagcacatctgttaaagaagtgtgctcatggtgtatgcccaatactttggaaatttctttattcacaacatcaagctcttctttatagctgttttgctatgtgaatttccaaaaatgttgtcaactttaggttgcacgcatcatattctgcaaagcagtcggtatatcacttggatcatattatttgggggattcacactgcatatgctatatattgatatcaagtcacttggttgataacaattatcaaaaaccactcggttggttggattatttattccttgactatatgcttagtttgttcaactaaccatatagtcgagggctacacctaattaggtgcatctagtcgatgcacctgattttttctatttttcagcccttcacagtctttgattatattactcgggagatcaaaacagatgaagctaaagcactcggattgtcttttcggattatgagagaagattattccgtcgactgtaaaggtctcaggggctactgtggagattatggataccccattcctacacggcatgtatatccgactgggtatggggtgtcatgtatagatagaatatctttaaaaggactcgggttaattaccaaacttgtatgtcaaggaaatacccgggatcctagtcggttacgattgtattttatctgtaattacctattccgttagggatatggtttgtactttgtaatacggaccccttcccctatataaggaggggtccgggtgcctctaggggcacgattttctcccagatcatacgatcaataatacactcggcggatcaatccccggacaggagtagggtattacttcttgattaagaaggcctgaacctgtataaaatcccttgtctctgaacccatccacttttctagcttgatagccacccccttttagtattgccaaaatcttgtttcgacaaaaaggtaaagcttgttatagcggcttgcgttctcgggattagtgcttacatcttcatgacactctaatcctgtttatataaatcgtcgagttatcatatatgctatgtaatctaggtcgatcttgctacctaacctcagcggctagcctctatcatcgaaaacagtcgacatggttagatactgacttcgaattagattacatagtgcatctaccatcttcaaaaggttgccatcgacttgtttaaattttatgcttctttctatgtttaatgttgtatcagttaagtttgatccattaaagcattacctggaatcgtaatatctagcttgtttcatgactgctactagagatactattggggtttcagccgatcttgcctgatttagttgtctcgttacttatatgcttactcgacatactgaatctaccctttatattaagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttggaatatagattatatatcattgatatctacagccgatcgagtggatctaactcttttctcgttacttacttcattgccgatctgacctgcgttacatcggcttggtgctaaatgatatgtcatcggcagtccagccgatgggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctaatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaatggcggcgccgcccaaggcctggaaggcggagtacgccaagtccgggcggtcctcgtgcaagtcgtgcaggtcccccatcgggaaggaccagctccggctcggcaagatggtccaggccacgcagttcgacggattaatgcccgtccgtatcctctccctccacccgctctcctcgccgacgatctttctccgttcagttgatgaatcttgctttgatctttagggtctgggagggtagggttttggtgtggcaggcatcgtgttcttgagggttttttgtaggttggtttggattctgagaattttctggattgatgggtgatcggttttcatcctgatttgcattgcgggtgtgggttttgtggtcatctgccacaagaatcttctgctttcatgggtggttggttttcatcttgatgtgcattgctaatgtgggttttgcgggcatttgccataagaatcttctgctttggtgggtggttggttttaaatcttgatgcccgaaaaaaatatgtttctgagggtaatttcgcatgattttgtggggtatgatcgaaccaatcttcttcgaatgcggagttcttgatgcatttggtttggtgctctgtcgatttgtcgatgatccgtcaattccagcatggggtttattgctgtttctaatccattatgcaatctatatgtgtaacgagctcgaattcgctagaggtgcttttgtgggcaccaactttgacatatgcaatttaactggtatttctcctaagttgtttgatatattagttattatgcggacctgccagttggttgtgctgttttaggcttttagcatggcaatggggcataccaatgacaatgttagtaatctagtgtgttcgctaatctgtttttgttcttatctgatgtgtagtttgcaaattataatctaggtattcgtttgcccgctttattttctagtttgcctcttgtaattgttttgtgggtgcatgtgtattataagtgcttacctgtattaggcaagataaaacttggaggggagtccttattctatttttcattttttatattgcacatttggataatgaatctttatttcttttggtcggatcaactcagtactcatgtggttatgtggactagacactcaaattatttcactgggaaatgtaggatcgtttagggcaacttagggggtacttttggatctgcatgccatttttcacctgaccatatctttttattttctgtgatggcccttattttttacctgaccatgttctttaatatggagtgtttataacgttgtaccttttctatgtttatagtaattgttttattcaagaactataactgtttggaacttttttttggtcatggtagattctcgatggtgcagaagagaaaactcgatggttatatgacatatctttccatatcaattttacgaattgaccacttccaattaattttagtgcccttttctctttttcagatgtggaaccatgccagttgcatcctcagtaagaaaaaccagataaaatcgtatgcaactttatcttttactgtttgcatgagtttcacgctatagtattatggtttattaatctttattgcatctattggaaatctgacctaactcaaagtgtcgattcttcatttcaaattagtgttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacggtctgtatcttttgatctattaattttttatatgctttctaattcgtcccttgaggataggaagttttatgccatgaaaattttatgtttgtactttgttgcttttcaaattatagtcatgaaaataacctcctcttgatgattaacaccttacagtcttatatgagcattcagctaacaatcatagataatcagaagtttcacattcttgaatgaaccttgatgcagcatgtaagaataattaatcataacatgtttcctattccttatagttactccctgggaaaaatactgtattgtccaaaattctgcatgttactttgttgttctatactttatttatttagaacatgaactttagcgctcactaaggatgaaatggatacccgacttggtcctagcacttgaacacttgtagctggggaggttaaatagcttccctaccactatgccattggcatgttcttttattttctgaacttgcatctgggaaatgtatggttctgatacgcagggacaccataggttcttttctgtaccctattccctgtggcctgcatcatgttgcatataatgcccaagcttttgcactggaattccaagtgaccagaaagcctaaaggccacagtttcccatttattttgtagttactctgctacgtgccactagcaagcattagaactctgaattttgtgttaagtttactttatcaaatgaagtaacctgcaaatgtattaattggaagagtatttattatgttcatatttcttattcatccacactcctagttgagtactcctaatgaattacaataattaccgtggagaattatatacaggaaaatgtttgatgatccagaagtactattagtcatgcacttagctaataatgtatgttttgaaaacatatgaattgtaactgtgatatggcaacttgtaatgtaaaaacatggtctttgtcttcactctaagttgtttctgtaatagtattattatttgtttgtctaggttcgtgtttcatctaagcttgaaggcaaaggttggtatcacgccagctgttttctggagatgtccccagctgcaactggtgagaatttctcaggctgggagatcctgtcgcatgaggataaaagagctgttcttgatcttgttaagaaagatgcccccagctcaggtaatgaaacatgggcatcaaattttcttcgcgccacttcgtaatctgacttgatattttgtattgttgtttctcaaggacaaacatcttctaagggttccaagcgcaagaataatcagaatgatatacacgactgcaaagctcccaagataatcaggagtatatcagaaggcacagcagaagataaagggaaagctgttgtatcacatgattccaatgctaattcttctgatcttcaagaaaagcttaaagagcagagtgacacactttggaaattgaaggatgaacttaagaagcatgtgtcaactgctgaactaaggaacatgctcgaagcaaatgggcaggatacatctgggccagagcggcatctattagaccgttggtaatattgcatgctatttgtgaaatggtttttaacttcctggcttcctgcactacattatttccatccaatgagtaattgatatttaaacaaactgcactacaaggatcccgcatataaatatatccttggccagttggccgatgctacttgatagaggagggtacgattataactgatgatgaatggtactagtgtacgaaatttgtcaggatagttgttccccaagaccccaattggtcatctatgtaattttttgtcgctagatttattttctgcttgctttctggatcccaaatcccagttgtaacatcctggttatagggtttgtgatactgatcgcttagtggaattcagaattgtcaccgtaacctaatgattgcacactatttgctttggttcttttgtaatctggttcatgtatacaattattatttccttaaaagtggctataccttttctttctaaaaaacacattttaaaaatttgatgtgtgcagagaaatttcaaagtcaggcagcacttaagatatttgttttcaggcaaaaattgttcaatagtatttaggtctgaattttttatgtataattcaaggaagacaaacattattgattgcataataagctttacaatattgttggttgcgtagacctgcttgtggcatttccttgtttcatctcacatagaagtcagtacacttcgtcgctaactttcttcctcgtctggcagtgctgatgggatgctttttggagcattgggtacttgcccagtttgttctagcttcctttactatcatggtggccagtatcattgcagtggctatgtgtcagaatggtccaaggtcatactctacgacagaacccgtgcgcagtaaaaagaaatggaaaattcctgacgaaatggataatggttatcttacaaaggtatgactatggctccccacccccacccccacccccacccaaacccaaaagaatatcgttcttaatgcttggtttctacagttgaggtaagcaaatatgtatgtatcttgcagtggttcaagtctcaaaaggctaagaaaccagagagagttcttccgccaatgtcacctgagaaatcattgtgccaatcaacccagcaaaaccgatctttccttagtgaaggactggataaattgagagtttctatagtaggacaatctaaagatgtggttgtaagtgatcttttactttttggtacagttatcctcaggttctcttgtgagttgtgttcgttaaagcaagcaccaattatgccatgaccttgctgcatgttgtggcatgcaccagacgccctttattttttccaatcacagttactttgcttacattgttatccagattgattcttaccatattatacagattatatatattatgcatatttgttgtgtggcttgttgacatgaaattggaaagtgctcaactgtacatgcttcatatatttgtttgtttaagtcaattccttgaagatagctagtttagtttgttaatttattccttgagttcctcgattatttctttaatctccaaaaattttaatccatggaatatgcagagtgaccacatttagattgcagagcaaaggttaggagagtgtaggttttttccctatgtacttgattcagttcatgttaaattcatgtcatttgttgaataatagatcaaattttatatgatctagcatgctgcttttgcatcaagtggtaagatagatttgcaattatttgcatgggatactgttttcttttattttttcttctctgctgatcagttattgggctatacatttttctttttcttgttttttggtttgtactttgtacattcctctaaactaatcatgtaatccaactactgtaggatggatggaaacagaagctgaaagatgctggtgccaactttaatgccacagttaccaaaggtttttcctcgtgttatcttttttttttctgaactacacaggatttcctcgtgttatccagaactggaactatcttgttcagacatttgaacctttcatatttggttacgtatgacattggaacctatatcttcacccaagtgggtgagcagtttgacaccaccccatgaccaaaagccaccactcaaattcctaaaattggctggctctcacgtatgtgtaattttagactaatacatgacacttaatctaactgatgttttgaaagtataagtaaaatgcattgtctaactcatgattttttatgggagagatggattatggatcacttatgtgcaggtgataattttatgttatctatctgactgtctctatttctgtaagaacatatgggcattgagccagtatttttgtgcagctgatataatgaactgagtcatgtgacttggtcattgtttcataggttaggtaagctcttagtgtttggtgaaatcttttcgcattattttcacatggaagtcttgcactgcagacagcagctgcttagttttatgtagtgagcttgagagtgagaatgctgaagtcaagaaagcaaggtatcacattttactttgcccttatccttttacacttacagtttgacctattgttttgcgaactactgtgttacctattgttttgcgaactactgtgttaaaataccattatatatgctacttcatttcaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacaggcaaggattttgctcacagcatttcttgtcaaattcaggatttgcacttttaggagtgattgtcaaggcatatttcatatgagtgatatggataaaccgataaaccctccagcaattttagtcaccaaacaaagaacgtggattgcttctcaaatccaacttcccggtcttcccttgaactaacagaatgatataatgctaaatttcccatggttgttaagttataatgttgagtcaagtgcaaccatataaaatagcatgaacattttggaagtactttggtctggtttggtttggtttggttttcattacatatgcccctgaagtcatagccctcgtctcttgttcaagcccaacttagctttggttgtcaatcattccacgatgtctcgtatacatatatgaatcacccgatctagaatgtcttatttactgccattctgcaataaaaaatgttggagcttgcacaaatttctgtttcctttcctctcaatttatgttcgggagcataacacactgttgaaatgagggggaacttttcttctgtagtattaccagttgctaaatttctgttaggttattgcaaataatggtgaccctgcttgccctacttaatcttttaacagntctctctctctctctttttgtctgtgaagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattgtatgttgtgggataatgtttttacctgctggatttttttcccctttttagtggatcatgtggattcaatctgatgtgtttaatatattgcaggactatggtgtaaggcaaggaccaaagcggaaagacattgacaaaatgaaaagttcacttcctccccagttgctggagctcatgaatatgcttttcaatattgaaacatacaggtgcgattttactgttctattttcaggttttgcatgtgcacatgctttgtttttagtattagaaaagaatttcacattattttgtaccagggctgctatgctggaattcaaaattaacatgtctgagatgcccctgggtaaactaagcaaggaaaatatccaaaaaggtgtgatactttgctcattgtggaactcattttgttgatctgtaagtccaaacatatcatgattctcttgcctgcactgcatgcaggttttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagtatgtgttcattaccttgtgttatattcctgtatattgggaagatattccatgactattcttattttttaaaatcacgacagttttaagtgaaatattttgctataaaaccttccttttgcaaaagaataaaggcgttctatgatcattgctgaaattgaaatgggtccattccacgcacagatcgtacatgacttgtaatgatatcttggcagttaggcatgttccataatgctcaaatggaatcgaaggaacacaaaattgttatttattttgtcatatataaatttggcttccagtaaactatgttattgaagtaaaaaaatgtattttcgcactactttcatttatggttcaagttctcaatgactctcattttgctatctagttggaacattttagaggatgttataataaaaaactaacatacctatggcatttttccttttcttttcctttgggtcttcacatgttctccttgccattagatacagtgctgttcttaaatgcaatgatatctcctgcatattcaaggaaaaatgtgttataactgtccaccgtttaaagggctgttttgggatcttggggtattttcattcttattttctttgactgatcagatgtatttcttattgccaattgtaactttattcagagacccaattgactgtaactttggtgcaatggtgcaggtgaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggtctgtattttcttctgtatacaaaaaccttatagttttttttttctcttttgtagatagtacaatacagacgattgtttctgttttcttctgtataggtattgacatgtcctctttttaaatcttttttgaaggagtggtcactggaattagaggaagtcttttcgcttgatcgagatggagaattcagcaagtactcaagatataagaataatctacataacaagatgttgttatggcatggtaagcaatctatccaagtaatgcaaacacatttggcttacgcaatatttgaaaaggtttttatactctcagtatttagtgccaaaatctaggtttgagatgaaacttattatccatgcgcagtctttgccatggcagtgcgtaggtgaacagagggttcacagtcaatccaacagttgtaaatgtttattttactagttcttcgtgtggtttactcgtgttgtatgttatgttgttatgtcagtatttaaaaggctactttttttgtaattgtactggagatctacttaacgtccctaagtaactctttccttcctaccatttgaatgattccatgattgcaaaacttaatttataggttcaaggttgaccaattatgttggaatacttagtcaaggactaagaatagcacctcctgaggctcccgtgacaggctatatggtttgctctttgttcacttcataaatggttcaactgtagcactggcaaaagattggttgaatttgattaagctattttcctttcaatcaacagtttgggaaaggcctctactttgcagatttagtaagcaagagtgcacaatattgttacgtggataggaagaatccagttggtttgatgcttctttccgaggttgctctaggtgacatgtatgaactgaagaaagccacggttagatataaagcctctcactaccaaaagagaaattctggttataacattaacttgaacttctatctttgctttgaaatatgatcctgctttaaggaattgaccatggcatttctttcctgatttttttattgtgatctatatttctttgctgattcataattataagaaaaagctcaacgagttactcgagtgcaattacttgttttttttccccatgtttatcttggcttggcaccacactcactggcttactgctggctgctgcagtccatggacaaacctccaagagggaaacactcgaccaagggcttaggcaaaaccgtgccgctcgagtccgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagttcagttccttacctttcacgaaaccttatctctggcaggtgaagatgcagtacttgttgaaggttaggttccatcacaagaggtgactagaagacttgaggtaggagtagaaatgtagaattaatcagtggaagtatctccatcgttatcagtagtctgtggtggctacgcttttgatgtgttagaatgatttatccagtagtttcaggttggtaggaggttatgtgctgctcgcgtatgatccgttttggggtatgttgcatgggcatcgcgcgagtggcgcaagtaaatcccctgcgcatgccatgggcatttgatagatgtttgcctaattttctgtggcaatgtgcgcatttggcatctctgtttagcttgctattttatcatcactcgcgttatttgtgcgttgttgcgttttggctatctttctttgtattttgattcgaggtctatgttaggatactgcaatcgaaataaactgaacagcattagtgaatagtgccgtctgtaggatcaaagatagaggcgtgtgactgtctagcggaagtaatattcttctatcctataagtaacggttagtctagcacgacaattcgatgagcatagattgcaatagtttttccccaggtattagtgatttggtaatctccgcttgttttgtgcccttctttcactctggtttgtcgtcgtccttcacccttcgctcggggtgctcccacttcctcttagagagatcacttgacttgatagccacaaagacacgttatgaccagcatttagcctcaaagtaatatttaaccatatgatcaacaatatatagaacttatcattcttgaggtgtggccgtcatgagtttattccaatcatattattagaaaacagtaggcaccgcacgtgaggctcaggcgtccacgggaactgccgacggcgcagcaggggcatgcaggatggccttgggctcgtgctcttccttctcctcgtcctcctccgcctcggcctcatacgcgtcacgttcctggacccagagctccgcgaactcgcagttcttgtactgctcgaaccacggcccgccggaagtgtagtggatggcgcgcggcgccgtcccggccgtgtcggcggggtcgacgcggttgtgccccacgaggaagttccacacgaagggcacctcgccgatgtcggcgtcgtccagccacatgaagcggtgcaggtacgcgccgctctgcgtgctcacggcctcgggcgtcagcgcggcgcggttctttgggtgggcgcagttgaagagcaccatggacgaccagttcttgcgcgggtacaccgtctgcacggcgccgtccatcttggtggcctccttgggcgcgtagtcgtggtgcacgcacagcaccgcgtagcgcgggtcggccatgcgcgccagctccgcgacgtcggcgacgaagaggaagtcgcagtcgacgaagagcgcccagccgcggtagccggccaggtggggcgtcagaaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaaaaatgtcttattttggatgtccagaaatgtttataatttgagaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttacaagctataaaaacaataattatatgaaagttttttttacaaatatctactgataccattttcacgtgtcaactcctaatattttagaattaactaattaattaatatttgattttaccattaattttaagacatcatctacttgagaatctacttgagaaacggatagtaataagtttaaagaatggtggtggttttgaaatcgggatcctctggattacagtttgtaatgcatatgaccaagagcagatcatgtcatgcgcttcggtactcaatagtggattacaataaatacagttcgcatgaataatgagcctctgcattactgcagaggatccagatctatggctttgacgcacgtttatgcatgcatactaattttttaaacctaaacatttgataaactattattaatagtgagattacaccagtaccaggcttattttttggtactaacctccgcctcatggaatttttttttcttgtagcacgcatgtaattttttttcttgtcccgagatggctgcgttgcctctcgtacgtttggatggatccgcgagggagaagcgtgaccctcgtggtagcatcccgatgatggaggagcgatgccagttgcttcccttgtcaccatcggaaaacaggtgtgtggtttgagctagggatgacaacgggtcagatcgggcacggcagagtaaaatcatgcctgaacccatgcccatcgtcgcttgtccaaaccttacccactagggttagcgggcaaaactctgtgcccgtacccatgcccgacggacacgggtatacccggcgggtacttaatggatctcatatgaatagtaactcgaaagatatacagtttaacaaagagaaataaaatcaacaatttaacaatttattagttatcaacaataatttgaattacatcataacttattacagtggcgaatccagaatgaaaatagaggcggtgctctaatgaccagtgtcaacgttgggaactagaatatatcgataagtgaaccatgtatatctcactatgtttgtagaaaaatctcacttttttagctctaagaccgtcaatcaaagatcattcatatttgctaatatgaaattaatggtgaagaaccacgttgtctcgttgatttcacacctctctctagccatcaggtctctgcccccatatataactacagctaaaataatttgaaatgtgccatatcatagcaactgtgactggagcacaaaacatccgagaaaacaaagcatgaaagcagtagtccaagtaccatctagtcattttcttcctccaaacggtagctagtcataactactgcagcattagtgacatagggatacttaggacctagtagatggagctggggcttgcgccccaacaagccccaatactaaattcgcccctgacttattattagttagtatcacaaatgaaccaagagaaaggggcataacaattaagagataagtcgaaattagctaatacatatgtatcgggtcgaacatgggttacccagaggcaaaaaaatgaaacccggttgttacccacgatgtctacgggtttcgggcggacgtgcccacgggtaaaaattcacacccacgcccatgcccattgggtcaggtatccgcggatacccggacccataggcaaaattaccatccctagtgcccacgggtaaaaattcacacccacgcccatacctattgggtcaggtatctgcggatacccgggcccatgggcaaaattgtcatccctagtttgagctatactcctagttaacaaacaattataggttagcctggtgatcactcgatcagatatactagtaccgcatatgccacctaccacacacgtacggccgcacccgaccgattgatctttaactgtgttgaggactcggcgacgacatgtcgctgtgggaccacttcgattgatcgatacccggttgttggtcagatcagtttcagcgtcttatcttgatagtcatctttaatttgatagctcgtatgtaggatcaaatcaagtgaactaagctagaggtgaatagtaggaacaccgaaaattagtttttagtgtaactaaaagttacgctcaaaatccgatgacgttaattaactggtatgaccggtctaatcaccctctaaaccactgtcatcgatcgccaccgctggtctagccgctgtgaagccactggtgtgaccaccgtgccctcacaggtgtgatcaccgaaactgagaaaaacacaaatcgaaaaactcttgaaactagatcaactttattgtttctaattgtttttacaaagtgcaacaacagtactactctctcaagtttcgactaaacttgaaatttatactaaactctattttttctctcaactaaactctcaaaattgataccaatagatctcaacccatcttctatttatccccgaaagtagcaacccaaaagccataaatccacattaataagtagtcctaatccactagggaacctacccatatgcacgtacacacactacgccagatcaattcatgtgacggaccaaaatatctcgtcacaaacaatatcacctttgacgggttaaataaatctcgtcatagatgaggctaaaaaaaatgacccgtcacaggtaaatagtatttacctgtgacgggtatatataaggacacgacacatgacgtttgtgacatgtccacgtataaacccatcattgatgagtacttatatgtgacgggttttaagtttgcacccgtcaaaggtgagtaacctcacctcagatattccatcaattttgacttataaataaggaaaccccaaccctcccccactgcccactgccccatctcttttctctcttctctcttctctcttttctcttcctccaccatcgcctctccccccaattgtgcaccagctgccgcggtctccttcccatagcagcgtcgccgcctcctttgcccgccgtcgtcctctaggagctcagggtcgccgcctccttcgcccgccatcggcctccaggaggtcgggcccggtggccttcaacatcgacgccgccgccacctcctgaccgccagtcaccagattcgactgccggtgccttctcccgcctcccggtcgctgacgccgtcgcctcccgaccgccggccttcaacactgacgccgtcaccgcctcctgaccgccgatcgccagatctggcccccgagaagccggatctggccgccggcgccttccctcgcctcccggccgccgacgccgccaagtctggcctccaggacgcggatccagccgccgacactttcgccacctccgcaacctcttcctcgactgccggacaccgcctctttcgccgccaaccgctgaccaccagatccgacctccacgaggttgtgggatgcggatccagcatccgcagcctttccttgactgccggacgccgctgcctccgccaccgaccgccggccgccggatttgtttgtgcttgatgtcgtttgtgcttgatttgctaatgtttgttgcttgtgtggatgtgtagtttgttaaaattgatatgggtacttgtgtgatgtatattgttagattgcttcatgtgtagttttttgttgagatgtatttgatttaaaatacaaagttgttgtatcgtgtgcatcttgagatgtatttgatttttcttcatttcgtacatttggggtgaggaacttctttttttctgggtggtttttgacatctgtgacgggtgggaattaaaaccagtcacagctgttttgtcacctttgatgagttggaaagagtcatccgtcacaggtgtgagtcacgtgtgacgggctatatttttctgcccgtcaaaggttttaattaccagtgacgggctttcacccgtcaaagatgaagtgtagtcattagtgaccactaatctctgaccaggactaaatccgtcaaaggtgagggttagaacccatcacagatgaccggatctggcctagtgacaacttatccctttacaattcaaactttaatcttcctacatttggactctttccaaatttgactctgcttttcattcgcacataatctctcttgtatgccgtatggaatcttcacaaccacgcgtattgttattcagtctgagcattccacatgatctcctgatcatccgaacattaacgtctcccaagtcggctttcaatccatcaccgccaatgttctttcgaggcatcaagacacacctgcacatgaatcaaataacaaaccatattcgagcacaagttatttcccaacttgactcaacattaagataaaacagtattacacacgtatagaaatcataaacatgagataatcgcgagtatccaaagaaaacataaaaccgactctaaacaaagtccaaccgatcttaccgtagccacaacaccagtctaaccggcacaccctagtcgatctgatcgcaagagccaaacaaaaatccctgttttcgtactatcactattcaatatattgcataacagaacttcaccaattatccaccaaatttcaaaaccaatataaatcacatatcaattgttcatcacagaatatataaatgaaaaacattgattttacacgcacgtctacgattcatgagctgccagcaacagatgcacatggaaatatagaaggaaaggatccggtcgatcgaagttttcactaaaacttcaaagtcgttcatgtgaatatatacaatcataaatcatgtagcaaagtcccttcataaatttatgtcatgatgatatatagccacgttgccaacgcactgtgcaactactatatatagtgttattacagccatttttatacgttttatttttgctatttatcattaattagttgaccttttttttctcttgtctgttattcaccccgactgtagtttagacatgcaacttaattttgaatacagataaattgccatttttgtttgctttattttttaataccctaaatttatctagatgtatttatagttatatagataatattctaagtgcttttgtatcactttggtgtaattggttaagttcaacaaaatctttcattatttaaaaagagtaaaatgtgcgggtggtctctaaagttatacatgggtgtcatctaggtctctaaactcttctcaatatatatttttggatccacaaacttatcatgtgtgtcatataggtccaaacgggtttcaacccactctctgtgcactgacgtgacatgacatgaagtatatagatgttctgcatagcacatagacaacaataaattgtttcaaatgggactttctttttttccccttaaagggatatcggcatatctacttttacgagcccacaacaaatcgggacctccacattcatgcatcattagattccccacccacatatgcactttattagcaaattataaactattttttcttacgaattaattatccgatatgtgatctgattgtattattaaatttattgcaattaaattttacagagagatcccacatgaaaatattttggataaaaaatattcgtaacagaaatatttttatatgatatatgaaacattgagttataaccgatgaaacatcacaaaatacttgctgaaacatccaaagaatagcacgtgtaacaatctaaaatgacccattaaagcatcacaaaatacatcccgagacatccccaaaaatagcacgtgcaacattctgaaatgatatagtgaaacatcagctacaattaaacatcgcgaaatacctcctacaacatccaaagaacaccctgtgcaacattcaataatgacatagtgaaacatcctaaaatacttattgtaacattttaaatccattgcaacaaaaaaaaacttctaaaagcaaatcatcaaaatatagtcatgtgagatctaaaaatgtttgtgcggtgcagttgaatggtaccattgcaattgtgaatgatgactccgaccctaggtctttcgagtaggacgggcagtagggagatatcgatgactattcatcactatcttccttagatgatgaaggcccaacttcattttataccgaggaagagttgcagaatcttaagaggacgaaagatgtcttggttgaaattcctattttaggtgattgcttacaatggatttagccatttctgtccttttaaattgcagtgaaaacaaagaacaaggaatcgaatatgcttgaaccattcatatcttcaacagataaatcaagtccatcaaaaccactctaaaatggattcctccaaaccattcattactatggagtttactaatagtaccaattttctaaatacaaacttgttatgttcatcataaaccacaatggtcatgaaattaataaacaaataatcctaacacatgaaattttctaagtgaacaatggaaattatttcttgaaagacacaaaataaatggggctagctgaactgccacggcaacgagctgggcgtggcagttttcagctgccatgtcacggagcctgacgtggcaataggtgctacgtcgaagccggcttgaccttgtcaatgccaatgattgccatggggcaccgttgcccatgccaagaccggtggtgtggcaaggtagtttggccacaccggttacaaatggcatggcaaaaaggttcatttttgaaaataagttcctgggaggccgttaaggttcatttatgttatgttgaaataagtgaaaattatttattaaaatggtctaaaataaaaagattccaccacatgccacctaccacatttttcgtgggatatactagcatccgacgccatttaattaatctaagcatcatgctcacattaataaataatgatactaattaccccgggactccaaccctttagatagactagttagaactagtgcaacatattaaaataattagaccgaagccgtggcatagatcagctagtccaatcaagtgaagcacaaactattcctataacacataactaataaagtagtatatgaactataaacactaataagtgcaaaagataattcctttatgaaactcatagtcttacaaagagagtaaagtactaagaacatacccgaatctccaagaagactatggaaccgaagactattctaagcttatctccactactaaagagaaaacaagtatatgaataagaaaactgctctctgagtgtgtattttgagagtgaaggagtgatttctatttataggctgcttatggcgattgttaagtcggtaatcaagtgcaaccgcctttgagaagaaatcatgagttgccacgtggaggatggagatgagaggtggcgatggtgttggtttgagtgacccatgcatgggccccatctctctctaccacctttctccaaggattgacatgtgggcctctaaggaggtgcacggtggtttggcctcactttaagtcggtttgagctgacttatggggcatcaatccatgtgctcacacatgattcaccggagatgtgtttctttgtatgccggtttatttctccttcactttattgtacaattactgcatccgtagtaattctccgagacaagtgaaactacattatttacaactaatattcatgtaagaaatattagttctccttttattatttgaggaaattgatggttgaaatcggtacttaataaccgtcaatgtaaactattattaacagtaatagtaaaagattacaccatactagacttattttttagccacacgtagcatggtacgtactagattcgttttaaaataaagctatttttaagtatagtactttgtcgtaaaaaagaagaaattttctagcccagtctctcatctaaaccaatgataacattttctatttgatttcttcattcactctcttttcttaatcattcaatcacaatcttactctaaccattaagacctatatttctaatagttatgtttatattaaaatacctatattttagaatattttagaacaaaggtagtagtgagagggattgttgcagcacgcatggaattatttttttctcatcccgacatggctgcgttgcctctcgtttggatggatccgctagggaaagtgtgaccggcgtgtgtggtgcatcccacgatgatggagctagccatgccagttgcttccctaccttgtcaccgtcagaaaaggtgtgtggttcgagctatacgactaattaactgaagtactgtaacaattataggttaccctggtgatcactcgatcagatctactagatcacaccacacgtccgcacccggtcgattctttaactgtgtagaggtctccgacatgtcggtgggaacaactgaccacatcgatcgatccccggccagtcggtcagagatcagtttcagcatcttatcatggtgtgtaatcagtgttatggaaacggaatacggatgtcggatgaagaagatactgacaaacgattaatagaaatacggatgattaatcaaaatttgacgaaaattcaatgtttgtgaatatgtaaatattgttatgcatattatagactcatatattgggaattcactacatataatacgctagaattaattaggaaaaggtgaaaacgatgagagctactatatatatagatatagaaatctgactagtattagtattagtgcattggaaaaatattctataaagattacgaagagaaatttccgctccctgtcgtccacgcgggcgcagggagcgaaccctagtcccaaccgacaccatcctcccttcctctcccctgcctcactgccgctagaaaccgcgcggccgctaggatggcagcgatagggctgaaaccccagcggtggcccattcttcggcgtgaggaggcggcacgcgcggcggatccaccgccgcgggatgtagccccctccccctgcccccgcggatggatctggtgctcctaccgccagatctgaccggagtgcactagcgacgacgtggacgatggcggagggacgacgactggaggcgctagcaatgggaggccgcgaggttattggcttgctgtggccggtaggaggcacaggagatgacgggaggagcgggtgacgactccagctgcccaacgggaggcgccgacgacaacagtggtcggctgatgggaggcgtgggcaacagcagcggttcaccggagggaggtgcgactggtgccggcggacgatggcgcgacacaacgaggagcggctggaggcggtggtggagctcctggtatcagcgcatgcgagcggcagtggtggttgcactctcggtagttgttgggggtggttgcggtcggtgaagcgatggccgatgtaggtcgcaccgggggctatgaggccaacccggcaacgggctaaccgctggtgcgcagcggtggagaagctgccgtgatgggaggacggaggcgacggtgatgcgactaggcagctggttgtgaacacgagcagcctggtcgaggcggcgacaatggtagcgccatgaggggtatgttgaagcctgcaacgagcttcctttccaatcgtttgtccttttgcagcgctggcttgccaccgtaagatggccacgctggacgggctagtgcagggcagaggggatccttctctctcaccattttctatctccaacccaacaacatggatggagttgaagcgcgatgggtgttgagattcttcttagatggctggccaacggtgaggtgtcggcgcagtggctgtgcatcgaaggtggattagcgggtggttttgctgaagctgacatgcactctttggcgcgggagagtataacaatgggtgaaggcctagccttcgggccggcaatggcgatgactgtgggcgcgttttccccttggggtgttgtcgtgttttctgtcctctcccatgggttcttcaggtgaaaactgttaacggtcgttatcaatcagtttcgaccgtcaatattaccaaaacaggagagaactagtgatgcttgcaatgcataaatatgttagaataataatattccactagtacaggtctactgaccttttgcaaagaatgatcataaagtggaggagaatcgacatcaacaccaacgataaatcaatcagacgatgtcgaggatcagacttatgtatgaatgggccaagaacacagaattgacacgatgaattgggccaaaattcacaagtctgcggagtggagcaatagaggaggccaccagccgaaattgggctggattgggccagccccgggttcggctgaacctggtggtttggccgaaccaatcctggcgccgttggatccaggttttggcgtggacgtccaggattgcatcccaatgacggttggagggtacttcggacaattccccttccacaaccgccatacctacctctatataaggagctcactctcttcacttcaacacacacctcaagcaagagctctctcattcctcttaagtttagtttagtagtatctagctgggggaatagaattagaataggaatcaggagtccggaagtcttcgaaagagttcaggtatggctctagtagctttcctttcctctttttgaagctttgtacttttattagaatactcttctaaatacatttctggtattgaaatactttccgagtatatgagtaccaactttacattatgttcttgttatactgaatatacggctagtttatctgggagatgctttggtgcgggtataatgtttctttatgcaattactctttgtcatgacgatggtattagagtagtatctagtagtttaggcgtggtgtctagattacgggatatcattatttggggttatatattgcggatgagaggtgggccgctgatggtgacagcttagtacgggtattcctccgcgcctatatataatcctaagttaatttcctaggggggtattcctctgtatttagccccggttggatggccatgacgggctgtcgtaaggaactcggcagtcaggggtggtttctcgaagtaccaggagagcatcggatatagggtattagctagtatatcaattaactagaatgtatgtatactatgtatattagaagtataggaattgattctctttctcttttctttccacctagcttagattatttattataaggatgagtagaaatgcttgtgtgccattcctcccttggattattttaacccctgcttagaatatgattatcacatgtaatatataaattattagttgagttctctctacatgatcttcccatgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcgttaagaaataccaacaaaaaccacgtcctggatctctaggacaggcggtgacgaagctattggcatcgtttcctccttggaggcgtcgtttagaagacttatttcttaggggtattgtgtgcttgtcctgtatttagcagtaagatcagacatagacgagtggtgtggatgcatattttcttttttcttactatagtcttccaagattatagacttgtgttttattcctactttattaatataaatgtcgcactatcttgtatgggttgttttaaaaaaatatatatggattatcttctgttcttctatttgagtggattgtctatacatttgtcaacaaattttcttctaaaattttgtcagatgtaaatatagtataacaatactataattacattctaactaacttacatgtaataactacagtgtaataactttcgcgtaattttgaaatcgttagatttgctttaagattggtgcaagctgagaagatatataaaagtcgcaacgcacacaagtgaggggatttggtctcgtgacctccgcttcatgaaaatagcaatgttatcgtaagatttttgaaagttgcatacaaattatactgtgttatatgcaagttacaatgtacgtaattacactaccattacactatatttacatttgtaaaaaaatttggagaatttgttgataaatgtatagcaaaactgctatttgagatatacatgaaacatcaaaatgaattttgagatcaagaaaatatggtagattggatttgaaagaggattagatggaaagaactaaccctaacaggttgcagcgacatcagaggaatttagaagggtaatcaacaacgtactggtacagctagcctttatactagaggacaacaaatatgctgggatagtcgttgtgggttggttcggccttttgatcaggccgattagacggaagcggccggggagattatcggaggtgacgggaattttacgttctggaatgattaacgaaggacgccgttttgcaaaaacgtgaccggcttatcaccatcaacgtttcaatggctgtatcaagcgttttccacaacactgtatgtaatcagtgggagtacgttttagacgtgctggtgctaccgaaattgcgactgctaccatcccggctgtacgtctttgatagtcatctttaattcaatttatagcccgtatgtctacgtcgtaattaattcatgaaaatcgatcggtttttttgaaccatgagctttcgatccaggcacatggaaatataaaaggaaaggatccggtcgatcgaagttttcgatataacttcatgtcgttcatgtgaatatataatcataaatcacgtacagcaaagtcctttcataaatttatgtcatgataactgcacataaggtgtagtttagacatgcaaaactttagtatacaaatagattgccatttttgtttgctttattattttaacaccctgattttatctaaatgtatttatagttacatggatcatatttttgtgtgctcagtgttttttttattactttagtgtaattgattgagttcaataaaagctttctaggtttctgaactgttacaatatatttttctggtctctgaacttatcatgagtgttatataggaccaaacgggctccaagccattctatacgctaacgcacacagacagtaatatctatcaaatgtgaacttctattttttttcccattagaggggatgccgtcatatatatttttagctctaaaatacaatacaaatagtattgaaaatctgtaaaaatttatagatagtattaacatctaccactcgaaaaaaataaagtctaagaagggccaatctacaacatcagaacctaaaagataagcgaacttttaccattcttgagaaggtaccaccactccacccggtgctagataccaagaagtaccttttagggcattggcaccgaatgcggtgatgagctggcataaggccagatttgaggcgtctcaattcattcttgatttgcagccgcggcgaggtacacttgaggctgtggtggataaaccgatagaagcaagggtatatgcgaaagttcaattttaccctctcacccacaacacctcctctctcgggagagcagtaccacccggtacaaagcaattctagctcttagattgtacgagatggatggtctagattagtaccatctccactcaaggatgataaaaactctcaaaagataaatacattacatgtacttggtcgtatcattttcatttctcaatgtgcgcattgatttaatttaggcttccatttttagatagtagatacgtactccctccgttttttaatagatgacgccgttgacttttgaacatatatttgaccattcgttttattaaaaaattatatacaaatgtataagatataaattatgcttaaagtactttgagtgataaaacaactcacaacaaaataaattataattatgggtttttttaataaaacgaatggtcaaacgtgtgaaaaaaaagtatattgtatcgatgatcaattttgaaaaaaagaagattgtaactatatatttagatctacttttagaaaatgaaagaacgaattaaccacgtagtgtggtccattaatctgcaccatctaggcatctattggtcctctccagtctccaggactcagctaggaaggaaagaacagagccagatacccagcaaacaggaggcaacaaaacaatttgctggagtacgagtcattcggccacaagcccacaacatgacgctagggccactaattcaccccgtgaccgtcctagagcaatgccatgtctcgccatctccggcgccggcggccggccagccacggtcgctgccgctcacgttcttcgacctcgtcttcttggacttcccgcccgtgcagcgcctcttcttctacgacaacgccgacctccgcgacgcccatgacttcctcctccgcgagcttcccctcttcagggagtccctggccgctgccctgcaccatttctaccccttggtcgggaagctgccgtgcgggatacgggagcgcatgtcgccgccggaggtcgcgtactcggatggctactccgtctgcctgaccgtcgccgtcagcagcgacgacttccaggacctcgccggcgaccacccgcgcgacaccgcgaggctacgcccgctgctgcctccgctgcccaagcatggtagctcgcaggacgtgctcgccgtccaggtcaccgtgttccctcgcgccggcatctgcgtcggcacgacgctgcaccacgccgtggccgacggttcaagatacgtgcactacatcaagacgtgggcccgcattcaccccctcggcgacgagcgcaggaaagcggtggtggtggaccacacgccgccgctgttcgaccgtggcgtcgtgcaggacggcgacggactccggaggccgtttatccgcgaccaccgggatctcgtggagtccggtgacaagcggctcgacgactgggacctcagccggaggccggacaccgtgctcgcgacgttcaggttcacggacgagctgctccgcaagctgggaggacatgtcgagcaggagacctcggcgcggtgctcgccatacgcgctggcgtcaggcnccgcgtggcacggcatcgtgcgcgcgcgaggcgtggcagcagacgacgtcgcgcggttcgggttcgtgaccgggtgcaagccccgcgtgagcccgccgataccgtcgagctacttcggcaactgcctgggggctgtgcttcgtgaaggccaagcgaagacacctcaccgcggcaagcgcatcggcggccatctggcgcgtgatcgcggggctcgccgagcaggggcgggcgctccgtgacgcccacggctgggtgcccggcgcgcgggagtacgcgccggcgcgcgcggttacggtggcgggttcaccgaagctgggcgtgtacgcgacggcggatctcggcgcgacgtgggggggtcggccccggaaggtgcagatagcgtcggtggagcggacgggcgcgctggcgctggcgaagagcggccgccgtggcgaccgggacggcggcggcatcgaggtcggggtggcgctgccgcgcgcggagatgcaggcgttccgcgcgttccacgtcgagctggtccggctgctagacgccactacccactagtgctgagtggtgacgcggcctcccccttgccgccagtgtaaaaaaatcgtgccattattccctctgcttcggtgtttctggaactgggaccattttgggaagcagaggtacggaaggtcctttgccttctgctgtttctgtttgccagttgccatgtgtccgtagtagactagtagtacggttcgtctactccctccgttattaaaaaaacaaatcatgagttttcgtgtccaacgtttgactgtttatcttatataaatttttttataattagtattttcattattgttagatgataaaacatgattaatactttatacgtgactgtctttttaatttttttcttaattttttacaaataagacggacgatcaaacactggacacggaaacctagagtttgtctttttttttggacggaagaagtattactctactactccattagtcccataatataatgtaggaacttaataccggatgtgatatttcatagtataatgaatctagacaccctcctgtccagatttgttgtactataaaatatcccatccggtattagattgctatattatgagacggaaggagtactagttactcccgttctagaatatattttaaagacctgcttgggagcaatcaaaaaaatattgacttgtaattttatttcgcccgtaattgtcgggcaccaaaaataaagtgaaattaaaacccgtgcattcatggtgtttgggaaggaacatcaagaagttcgaattctgatttgacgaaatagggtatcttacgaattcaatcaatggatcaaatcagcatgaccaatcgaggaatcaaatctgaacaaacaatttagaccaaaacatcaaacagaaatcgattggaaaaaaacaacaaaattgatccgatcctgaataaaaatgagctgttcgtgcattattcatcaaacagttccgagcacaacatgaaagagaaaaacaacagagagattgatgagaaatattggccaaaattatcaaaacgatatacactgatctcttctcactacccccaacgagaaatttagaagaagcagaagctgtactcagattgaaagctgtacttaacgagaaatcaaatcaagggcctctttgaagagtttctggcagctgtagctttttccgaaatcagaagctcatcaaaacagtttagcttttcgtttagattctaagaaactgtagttgttgaatccagaaaataaactagagttaggaaactcagttttttcatattctcaaaatctggctatgaacggaggtatttttataagacccaagactacatctagaagtaggtcgtttcaatttggagagagctgatgccaacagcatgcactgaggttgcgatgacgccagaaactgtgaagatgtcggtcgcatgtgagggtgagacggtgccggaaatgcagatcaacagtaggggctgatctacagtagaatggtcggtgtcaggcgacactgacgactttcggcaaaatctatagcaaaactgtttatctatatgttataacaccatgatctaaatataattagcatactgtgacaccgatagatatgttatgataccaattctctgatccgccactgatcggcagtcgagaagatgttgtagatgcagatcgagactgacaccatgacgagaagaggaggccaacgacctggacggattccggccgacccactgggcaaggtcgtagcggcggtgcatggagacggagctaagttcacggtggcggcgcgtggagccggagttgagttcacggggacaacatgtggagctaggtggagcggactgcggagtacggctgaagctgagaacaagcccgactttcgtcgttttctagtgtgattgataggagataatctatttcccggtgtaatgggcctctacgaacgaatttcaatctgacatccggcccatccaagcgcgcaatttcagtccggctcaacaaattttatgggcctgtgaattacacctgttttggaccaaatacaagccttccaaggaggttctaacttcaaccttcaaaatatatttttttctcaatcgatcacaatatttttatcattcaaattccacagttagatttttcttctcaactaatcataacattcttctatttaattccttcaactttcttgatactcatatggaacctaaaactcgtatatgttttggaaggtatttgaaggcggaggaaggtgacgaggagcggatgctacgaggtaggtttgggagaaatcgaaacgcaagtggagattggatagatacttgagctagagagatcagcaaaatggtcgggaagaagaatacagactctagagtaagagcggggatggccatccaaactactcccctccgtttcacaatgtaagtcattctagcatttttcacattcatattaatgttaatgaatctagacatatatatctatctagaatcattaatatcaatacgaatgtgggaaatactagaatgacttacattatgaaatggaggaaggagttgggtttgctcaggtgcacaactaacagcattatcaatatttcgttcaaccaaatatgtttcttaggccttttttagaacgcaagaatttcatagacattttatagtatttttcacgagaacaattcagttccccggaattcacaaacaaaaggctcaccttcggaaggtggccttgaccattaaaaattttaacgttcaaaacagtaagtttacctgcagcaagctttgtagttacagtgtctcaatttcaataagtttaccaggccacgatttctcctctcagggcccacaggaaacaaacggcaagatctaaaaccctacaatctaagttgccttagcattactacatgtactggcggtagttatcatatcaacttaacaactttagggtttttgaaatttgccatgcacccaaacccgttgcatcttcttccccttttttctattcactgatatgacacaacaataccccagttccaactgcacaatgataggcaaatgcaagtcaatggtttcataagttacagacatacaaggaaactggaccaaagcaccaagatgacacaaactgaaatttttacatttttggtccttttttaaaacttattttacaaatggccccttgaaaaacttattacaggaatgatcctttctggtgcaccagagtggctggcgccgtatttcaacatggcggcgccagccaccctggcgccgtgaccgtgccaccgtggcacaaaggcgagcgtggaagggtgacctggcaaaggggg

SEQ ID NO: 31017 - DNA, 1864 bp, Oryza sativa
gaaaaaagtccacaactccatcacacattccacacatcaaacaatactacaagtccatcacatacttcatacaaccaacaaatccaaaagtctgtgaaacaagttaacacatgatacaaagatcaacttcgtagaaatcactttttccgttggcgccgaatagcttgcaagccctgagtatatctacatttgaaaaaccaaagtttagaacatttaaaaaacaaagtgagggaaatcaagtaacacttgagaatggtaagctcattttacctctttttcgctggccgagtggatcgtaagttgtattgggtaggctgtgacgcatgaggcgcatcgggaagttgcgacatgcctatctcctcgacgtctggtgtgatgtagccctcatcctcctcctcatcgtcgccgctaggtggagcctgtgccttcccctttccccttccctgtggaatgcgtgacgatgacaaaccaccaacttgttcacgctcttctatcatgatggagtgtcgagcagtacttggacacacggattaaggtagtggtggtggtactctccgcagttggtacacgtcgtccaatccaaccgacctgtaacctaatcttgcagcaagtttgcggcacctttggcgaactttttgaattaaaaaaaaagaagtttgttatgcataagtcaagtaatgcaaagtgttaaatcatttttacctctaagacattgcgaagtgtgttctccgtatccttaccaccccttggagatcggagggcatgccccatttcattcacactcctaagaagctctctggactaaaagcatgagaagatgtatgttagggtttagggtgcaaataaaaatcactgtgacaaatgcaagaaaacttacgactctgtctctaagtggggcgtgctccatttgatatccaaccctagtccgaacgtcgtagggatgccgcccctcatcaaagtcgtggtcttcctctatgtcggcttccgtccaagtagggcgtaggaacagtctatatgtcctatgcagccaacgaaggtactcagtaaaaagatgattttggtgtattgcctcgatgtacctatcattctcccactgtcctccattcatcaatggatctattatgctctagcacccagtccttcaccttctttgttctcaccctgtcgtaccttcacaagtggaaggtgatgatatgtaaaatagggtcaaatggtgcaaaattgaacattgacaatgaaagcaagcaaagataaaaaatattacttgtgtagatcaactccagttgagatgtcctcaacaagacattcttgtctcttcccgaactatcgcatgacacggtgcggaaggtggtattcaactgcccaaaaacaaatcaattggcactagtacatgaagtaatcggagtctcgattgcataacgagttcagtgtaagacttgtagcctcagtggtgtggtatggtaaccactcaatctataaatgttgaatagttgtcgtaggttagtatctcaatcatagaagtaaatgacgaattagaagtgatagtaaagtacttatatgtgcaggcagtccatctcgttgatgtactgcttgtatgcgatatcccggtgagcatgtgcagtggctatactctcaaacaggtaggccactgtcttctctatatatggctcattgtagggccaaggggtaaagatttgcctccacttaggcctgccaaccggtagttcttagccacatccacatctgaatcaccagcacacaaccactaatgttggatgatggtgcctggcaacaacaggcctaaaagagctgtctataagtccatgccaacaccgttgaagccccaactaaaacggcccagatc

SEQ ID NO: 31018 - DNA, 1308 bp, Oryza sativa
ggcgaattcgagctcggtacccccatatgtgcaattccgaagcattgccaaacaaaggtctcgtcttctatccttgcccatccaagtcttctcgtaccaactcagtcttacttgcaccccctcaacgacgagaagaatatgtcacaaaattattcttaatgtaatgaggagacttgtttaggtgaagaacttctttcactcgtgaccttagcttccacctctccagtggtgagtggtgagatgaccatcactcttcaagatgtggctatgatcttggccctcccaatacagggacatggggtgacgggcaagacagagaatcctggatggcgtgcacaagtggagcagttgtttggcattgcactcaacattgagcagggataagggagcaagaagaagcataacggaatacccgtctcttggcttagccagaacttttcagacctggacgacgacgttgagccatggcgtgttgagtgctatgcccgtgtatacatcttgcacttattgggaggggttctttttctagatgctgggggtgacattgcttcggcaatttggatttctttggtcactaaccttgatgatctgggccgttttagttggggctcagcggtgttggcatggacttatagacagctcttcgaggcctgttgtcgccaggcaccatcatccaacattagtggttgtgtgctggtgattcagatgtggatgtggctaagactaccggttggcaggcctaagtggaggcaaagctttaccctttggccctacaatgagccagacatggagaagacagtggcctacctatttgagagtatagccactgcacatgctcaccgggacgtcgcatacaagcagtacatcaacgtgatggactgcctacagcctacacatataagtacttccactatcacttctaattcgtcatttacttatatgattgaaatactaacctacgacaactcttcaacatttatagattgagtggttaccataccacaccactgaggctacaagtcttacactgatctcgttgtgcaatcgaggctccgattacttcatgtaccagtgccaattgatttgtttctgggcagttgagtaccaccttccgtaccatgtcatgcgatagtttgggaagagacaagaatgtcttgttaaggacatctcaactagagttgatctacacaagtaatattttttatctctgcttgctttcattgtcaatgttcaattttgcaccatttgacccttatttgacacatcatcaccttccatttgtcaaggtacgacagggtgagaacaaag

SEQ ID NO: 31019 - DNA, 244 bp, Oryza sativa
tcacactgtcacccaggctggagtgcagtggtgcgatctccgctcactgcaacctctgcctcccaggttcaagcgattctcctgcctcagcctcccaagtagctgggattagaggcatgcgccaccatgcccagctaattttttgtatttttgtagagatggggtttcaccatgttggccaggatggtctcgatctcctgacctcgtgatcagcccgcctcggcctcccaaagtgctgggatta

SEQ ID NO: 31020 - DNA, 3718 bp, Oryza sativa
agtctaaatgcataatgacctagtgtggcaattaaaatcatctcattgctaggtcattaccccccttgatagtaaggcgaaactaaaaaataaactagcaaatttgatcgcccttcacctcgatcaattttaaaactaaagcactagttttaccgttttcttttcttcgcttcacgtcatcaaattttaatccatcgatagtcatccatgcgcacacatgacgtggacctaacttaaaatatatctcaatagcaacggttagtccacaattagctcttgtcattaattaccaaaattaacaacgggggactagatgcttcaactactagagtacggattatatttttcaaaacaaaacaactactagtgcgcaaaggtgttagctggatgcatcacattagatcaattttacttgtttggattattttggcccatgttcacacaaattagtcaagttattgtaccaaaatgagcaatttacgagttgttatacctatttgcacccacatcataagttcatgtatcatgagtgcaatttactcaaatatattatatgttcatacgatttcttttacgtttcgtcagttaaaactcacggcttgtttgggaactcgagagaagaggattgggagtttacatgagggaattgatgatgagattaagatgaaaatttgatttctaatctcaatatcttatttgatagaggtggtggaaattgataaagagtttagttaaagattaggtcattaatgaaaatggatagttgacatttgtttaggcaaagtaaagaagaaattaccaccccctaccctgatattagaaaagagggagttcattcctcaattcccctccccatcccaccaaaattttcatgtcactcaactatacaaaatagttaataatcttatccctctaatctcctaatccctcttaaaaactgcccccaactaaacgggccgtcaatgttttgtagtggatatccatattatagttagtattttttaaaatattgcatttctgtaaaacatttcacaaagtggactgaaatattttgatcaagtgatgaaataattttctgtaagtggtacaacactgttttgaacatatatcttttatcaaaatgtaatcgtgtgtgatcttgttgttaaaatttaactaaaagaaatttaattgtgcaattagatttagaataaaaaataatttaaagtttactaatatgtgcataggagagagctcgtaagagatggcttttacgttagttgtatacatggagatatgtcagacatgtgtgactgagtctgggagtgatgcagctagtgcatgcgctatggagacaaaagggagtaggcatcaaaaatttacattaacgaacgtccgatacatggttgtgcccatgctaatgttatggttgcggccaggggcaaatccaacgtggggtgctggggggctttgagtcccctaccctcgttggatcccaatggagagaaggtgaggggaagggggaagaagaggaagatgaaaaggagtagggggactgaacggatgaaggagaagatgagccctccctccccccccctcgaaatagatctatactagggatgaaaatggtcggaaacggtcggaaaaaccctcaaccatttccattttcattttattttctcgaaaatgaatcggaccggtatactcagaaacggtaacgatatcggtaatgtcggtatatcgaaaacggaaccgtcggaacgggaatctaccgatgtctgtcgaaagtcaaaaattcatgtcggaaatagcgaatcgtggtatcatcccacatttaactatgtatgaagatgaccttataatttcacccttgcatgatcatgctgccacaccccacacaacaccgttatatgatgattaataagttgacaataaggtcgacaaacaatataaacaaagttcaatgatacttcaacatcaatgtggctaaagcaaacaatgtggcttacatgataggattactgcataactaatattgtccgactttttttaggatatagatttgaagtcttcgagaacactgaacaccaagctcacaagctggcatggcttcagctgatcagctccttgtcaaacatcattcatcatttcatcatcaattgacatagctacatcgtcgtcctacagtggcacattgcataagaacttttatgttgacactgtataactaccattggaattaagtttcacgctagcaaagaaatgaaatttgtacttacctcaataaccaatttgtttgccataagctcagcaagctcaagatcaaccacaattgactgaatggcaacacgatctgaaaaaaaacaaatagaaatatattagtaaaatagttattgattgttgcacataaataaaatgtctaaactgttgtaattcttacctcttcttactccagctatccaatctttagtacaaatcaatgcttgtgccatttcagaatcaagacgactgcaatatggatcaacgacacggccaccagcgctaaaggccgattcagaagcaactgttgaggcttgcatagccagcacatcacgagcaagtaaggagagaacatgataagtatctttctggttcttccaccaagctaaaatatcaaatgtactttcatttgctttagtaaccttcaaagtttcttctgacaggtacttctccaaatcatttacttttgaagaagtgttatgtgtttcagcacgatatagatacttatcaagtgcactaacaaactcagttggatcttgatttgcatctggtgtatcaataggttcaaatgcattatgatttctaggaggtgcagcagaagcatagcagtcatacatgttccggatgatattgagaaattcagtaaccttaattggatgcatatcctagtgtatgaactccatgcaaaattgtactattctcatcttgaatctaggatcaagaaagcttgccacagcaagagcagtgttagacttattccaatatttgtcaaacttagcaagcatagcagttgccatccttctaatagtaatatcagaatccttgcccttactccaatcagtaagtataatcttaatgtcacagaatcctttgtaaaacaagtttgctgtaggatataaagtaccagagaaaagctcagtaagatcaaagaatcttttcaagaatgcgcgaattttcattgctttctcccactctgcagctgaagggcacattttctcatacctgcgccgatcataggatgtaagcctgtcaaaagcagccctataatagatagcatctgccaacatgagataggttgagttccaccttgtagaaacatcatttaatagtcctttggttgtgtccaacccactttcagaagcacacttcattaactcctcccactgcaacggagagccctttacagcattgacaaaggatttaattttctcaattgttgattcaatttcttgcaaaccatctttagcaaccaaattcagtatgtggcaggcacatctaaaatgaaaaaacaggccaatacatactaagggactgtgcttcttaagttcagaaattatatccttaacagcaacaaattatatccttaacagcaacatcatttgcagatgcattgtccaaagtcaaagaaaacattttcttctcaacaaaccatctcagcatacttgtagtaaaaccctcagatagtctaacaccagtatga

SEQ ID NO: 31021 - DNA, 8351 bp, Oryza sativa
gccatcttgcttctccggcaagggacgcgaagaggcgcgaggatgctacggctaggactagcaagcggcggtgtggcggcgtgtacacgtggatagcggcggtggcggtcaccggaggtagaggcggcacagagctgtgcagacagtgtgagacagcgagagtcgcgagacagggatgagtatgagaaggataagtgacacgccggctgacgccctagggtttttcttcccagcctaaatgcctaatgggctgctcctgctccagctatacaggcccagccggcttccttctttagaagtttgtcgaaaatttgacgataaaaaatggttaccgacaaaacggtcggaaaaaagcccatatcatttctactaccattttcggaagagattactattttcatttccgataccgacaattactgataccgactgaaacagtcggtgcaaaccggaaacggtagccggaattctcggatatttctgtgccgttttcacccctaatctatacgatagttgattccttagttctacttaaacaaggggatatctgaaggtataaatacaaggccccctagaaagagagggacgaaatgaaggcatatctacataaatccaatgtagaagccacaaaaaccgacatgagggatttagagctaccttcaatctcgccgagttcatattagaggaagaagactacactagccatcaaccacatgtgagagctccatgccgctaggccgatagggattagattaggtcatcccatattctgtactcgtgagatattaatatacaaaggcaacattggctttgcccaacaggaacagggctattacccatcaagtagtgggtccgaacctatataaaaatccatgtctaatgtcttttttacctcaatctcacgtataccctaacaccaacgatcaccattctctttgaataccataggcgggcatagtctgtcagcaataacttgtatgtaactaacaaataatggcgggtatccgatttgctagcagctttgcactgaaaaatctcaaggtcgtgcgcttgaatcctcttgcctgcgcaataaatctagcaaaaaccatttgataaacttggctaacatgcataaattgcatatgatgtatctaatacattttgttttattttccacatattcgttttggaggaattttaaaaaatttaaatttctaaagattaattcctataaatgctgttcggttcataaaaatgttgacatagaaaaaccaaaagaaaatttcctttcttacaagttgtcagaaaaactataggaaggttttcatccactcaaacctcttgaaaattttctatgggttgaagtgtgcatacattgttgatctttttttttctccaattcctttggaacgacttggcccttgctagccaagtcactttgacaccttgacccgattcaaacaagggttaattggatacatgccattaaaaatttgctggttttaaaatataccactagtattcatgtatttgaaaatatgccattgtaatttcacacatattcaaaagataccactacttacctcttggatgcattttcagaaaaaaaatagaccaaactgccccttttcccttcttcttctttcttcccctttctccttcctcctctcttccttctcagcggcgcgttggcggcagcagcagcagatgcggcgcggcgacgacagcagcagcagtagcagcatcgatgcggtggtgcggcgacgagcggcggcagcagcagcggcgtggcacagcagcagtggcggccgcggcggcagcagctgcaacaaaaggcggcacggcgacgagtggtggcagtagcagtagcaacatcgacgcggcggcgcggcgacgagcggtggtagcagcaacagcggaaccagttggccatggcgctctcggcgttcggcagcgtcgccgcggggctcgtggcagtgccggtcactgtgttcggcactggcatcgacgaagccgtgctcgccaaatcattcaagaccgatgtgcccacaatccagaagctcaaggtgaacctgagtacctgactccacccaacaagccctaattaagcacgcttgctaatcttctctcgccattgtcgagtggctgcagtagtagggccacggcggcagcaatgagctgtagcgacggtgagcggcggcatcgcgagcagcattaggagtggtggggatggaatgagcggcgcagcgaggggaaagagtgaggggtagaaaatggggaagagagagaggtagaagatgagagcattttcatccaatacatgcagaatacgtatctaagtggcaccactaagatttcaaacaagtagcagtggtatcgttacaaatatagacaaatagtaatgttatatttcaaaactgctaaaattttaatggcatggatctaattaacccttcaaacaatgccccttttcccaacccctttctctcgttttccgcgcgcatgtttttcaaactgttaaacggtgcattttttttaaaaaaagtttctatacgaaagtagcttaaaaaataaattaatctttttttaaaaaaaattagctaatacttaataaatcacacgttaggccatgtttagttccaaaataattcttcaaagttccaactttttcatcacattaaaactttcctacacacataaacttctaacttttatgtcatatggttccaatttcaaccaaactaccaattttggtgtgaactaaacacggttattgccccgttttccaggctcaagcagaaccagcgaacacaccgtccttttcttacagaaaaagcctgcaaaactgcaacaaagtagtcctccaactccaatccattaatctcaaccgcatgtaaaagcacattcaaaggtcaaaatatgacaggttgctttacatcacgtcagtttagcctttaatttaacgttatctgttcttccattcccattaatccgccatcaatatggagcttttcgttaatcaactccaaagctaccatctcgtccgtccgatcggtacggcgatcatcgtccaccactagatcgatcagtgaggcagagacctctcaatctctcgcgtccctctcgctctctccccgctattcttctcgtccagatctggacgtcggagcaccgcccaccgttcgtccccaccgcggccggtgcctcgccggcggccggctcgcccgcactgcctttaggtcgtaggagcactgccagctcgccagtgcggccgaagagcggcacgcactgccccctcgcttctcccctcctgccctctccgcgcacccgacatcgccgccccccacccaccacagcctccacggccgcccaaatgtcggacggtgaggagaagagggagatcgccgtctggttcctctccaacgcccccgccggcgagatccactacgtcgccaaaggcaatccccccaacccctctttctgaccctcgcaatccaagctgtacagccccgtgtgtttcgttgtttgattcctcttcggcgtgggcgcgcagatgtgcgagcgctgctgggggacaaggcggtgtacgagcccgccgcggcggaggccttcccggagcacaacaaggcgcacctcgtggccctcgagctccctgaccgcagcggtgatgtgagcactgggccatctcctctccttgccgacttttgccgtcgcgtgttctcacgtgctcgaaattgagtgtgttctatctactgtagggttgtgcttgttgtagctcgtaaatcagcggttaagacttagcaaatctggcttttaggtagtgattaataaatcacttgtggctattgtgtttgttactttacttttattaaattcagtaagctattggtgtttctcattggtatgtttatgagcatgagactataggatgatgccttaacactcgagggtgggtgcttgctggccagacattaaaacaatgtgtcctcgcgcgcagataattatcacaacttatggggagcttgacaagaacaattatctggatcctaggactgctcaagttgctacagtggaccatattaaacaggtaatgctgcagactttacatctgcttatcctggatttagttcttaagccagctatgcatatttaacatagaatcttttaaagtaagagaacatatataactactaaacaatggatggtcatcttaacttatggtctatgaactatatgaagcagtttcacgtctgtaatttaatatgcacagtatcttgagcttgatggtttgactattcttattcatttgatgaatattaattgagaaatggatccaatcacaggatattgatactgaactatctttcttgaagaacatgttacattgaatatagtccacatagattagtattgtaactgaactctgcatgtaaaagtttgatcccacaagtttctactttttttatttacagtgttaactgaggaataaattatgaccataattatgaattttctggacatagattaagttacctattttcaatggaatagcatagatgtaggtaaaagagcttttcattatacctcaaatagtacatccagcagcagctgtattaggcttcagtaactagtattacaggtttctgcccaatccattttgtattaacttgtgttacctctagacaatggctttcattctctaacaccgggttagattgagatgtttggttaagtatttgtttttgaaatgtctatagttttctttgttcatttgaaacatgatgtgtctgctttaatttaagtcaccatgttttttgttttacatgttaaaagaaatgtacaaaattgaggccagctgctgatgaggagcttccttcagcatacattgaagatttcaggtaccataattatgctattcttttccccaaatttcttgaactccacattgccttgctagtcaatttatgttctgcaccttttgttatgggtgcaggagtgccctggatgttgaattatccaaatatgttggtgaagcttatccaaaaggggtgtgtgctgtttattgtaccagcggaaaagatatagagggaccaggagttgattttcgttttgcagcagttatttctgctgctaaacgcagcccacaaaacttttggtatgttgtctgagtctgcattttctctgttgttacagatacttgcctagttttctctaatcttgaacttgtttatatgtccattttgtgtatctcttctatacattttagatccttattgaggtttctagaaaattttggcattcctatgagaagctatttcatattcaacttctggatcataggtttgcacatctgtgagtgtttaattctttattttccctttgaactaatcatgtgttttgtgggtaccctctttatcatcttcccacaatattatggtgtctttagtttttatgcagaaaagtttagaattgtgctttggctgaatccttgcttcacataatctgttactagagtcgcttaagtcctctcgtcatagtttgacatttcattatttattcactgatggagacaactttgtattgagtcatccagcaacggcaattggcgctcaatttggactctggaattcatagatggattacagcttgtcgaaattaaagggaaaatacaggtttgcttttacttagctagcgctaaaacatggttaattattgttattgtaattgaagttggtaactaagatacatgtgcatataccaggtaggtgctcattattttgaagagggaaatgtgcagctggatactaacatcgattgcaaggattccaccatattgcaggttagttcatacaatacctattttttttatcctggcatgttatgaacgattgatggcatctgcttcttttgacctcgtgcagtaatccacacactatttcatcgtttgttgttttgctgctttaggtttacgtgctaagttcattctactgttcaatatattttggagaaaattttctcctgctttggtatgatttgctactgagttttagagaattatatatacatgtataccctgtaaacttagttgcgcatgcataagtatgtgctctgcattcatggatgaagtacagtttatgttactgatagattttcatagaaccttaaaaaatttatatctgcgctatgcttaattgtgttgggttggtgcctgatactttgagttgttgtcgatattctattgatgcaaactgttaaaacaaacaaagttgaaattttatttatcctttttatttcctggggtgaactgaaaggatcaacttatgattgagtagattttttaatataaaaattgcacgggtaaattttgcccctatttcatttcctttttggttctggagtttttgcatgtgcttgtccggagcatttgtgtatgttaagcgtaatgttttgtttagagctgcattatgcttgcatcattttgcttgctttgtttttgcttgtttttaatcttcaccaggctgaaaaatgcgaaacccttaactgttcttttcatgtgctattactcgtgtttcagtctcctgaggaatgtgcagtatcaataactaacatcattcggcatcatgagtcagaatatttgtcatcacttgaggttgaaacctgtccctatttgtttattcaagcttatatgttaacataatgagtaatgccattcttttcacttgtgaacaggaatcatacatgaatttgtctgatgcaaccttcaaggtacaccaaggaggcagtaacaatttaagaatttgcatgatagttataatgctagtaaattttgttgctacttttacctatcctctgctcagttgtgtttactggttatatatgtgcacaggatcttcgaaggaaacttcccgttactcgtactcttttcccatggcacaacacattagccctcagccttacaagagacctcaccaaagaactggctataggaaaatgaagcttgtggaggtcagttcattagattagctttgatatggatttttttttatctccatgctatgtgttgttctgtagatcctgcaattcatatcctgtagccagcaattctcttgttttgatttctgggcttccacatatcagtgtaaatcaagaacatgcacttcttgtgaggaagttacatttcaagaatatatgatatctgaatgttgactgtgtcaactcatgttaactcttgctgccgtcatgaaacaaaccgggcaagcctaaatcgattctttgagatttgttgtatagaacattggtattatttgcttccgaaatagtggggtttcctgccaaaaattactgtgtttttacagccccattgtttcgcttattagcaaataaagaatcttttgtgagtaaaatttttatacttgtggctttagtgactcaaaagcaaatgctataaaataaactatgatgaaaaaaaaaaaccaaagaatcataatcaaaattaagtttaaaattcaaattttggcttataaacataagtataagaaattgcaggttttagggattagccatttattatcttttcactgccgccgaggtgctgagccaaatacgtcaccacaccattgctgctcgtacggacggtcatacgtcccaaaggctcaagcctaaacctccaacgatcgtcctgcacgattgttttacccaccatttgttttggtatcattgggctgggccatgatatttgcagcggtgtcaagcatccgacatcaacggcggctgcgtagattgcatatctcggctgaggctctgccgtaatttcagccccgtgtagctatgccgttaaaagcacttggctgaattcgaggttaaacagttgtgctcacagtatgaagttatttttgtgatactgtgtgatcaaacaattcagcatgaatgcattgatctcatgaaattgaaaagatatatatcctgatgagcaggatgaggctcgtagcaaccagcaagctaggatcacagggaacaggaaaacaatatgcttttttcccctttaaattcacaagatttggtctcacacaagttacacacgaatcaaatgagatattatcagacaagctcatcatatcgtacaacaaatatgtacaactccgaatatgcaagcagagacacgccagacggccggccggcgtcgttcaagcagcagcggtttccgggtaaggatcggcccaggacgcgtccgccgccacggcctccttccatctccggttgaatatctgcatctcggcgaaggatcgccgcctcaccgcgatccggccggccgacgccgaccacccgccgccgccgccgagcgaggggatgcccctgtgcatgacgtactc

SEQ ID NO: 31022 - DNA, 2862 bp, Oryza sativa
ccctccctcctgacgatgccaaggtagcgggcggggtcgaaggcgtcgacctcgacgtcctcgtcccacagaaagatgtagtcgtactcggccaccacgtcgggatggaggaaccgcttggcgaaccaccacttcgtctgccccgccgccgccacgtgcaccgcgcggccgtgccactccaggtcgccccactgctcgaccgcgccgtcgtagtggaacagcatcaacgcgaactcctcggcggggaacttggacaccagcttgtcgacggccgccttgttcttgatcccgacggggatcgccaggaggctcttcgacgccttctgccgcccgtgctccgggtcgccgaccatggactccatctccaggttcgactcgccctgcacgatgcccctcgggagaggctcgctacggccgccgccgccgtcgctcgacgcggctggcgcttcagctcgcttgtcgtcgcgcagcatcttgcgcgacagggtgatcttctcggctgccgccggtgaagtcgacgggctgatcgggcgccggtccttgtggtgtaccgtgacggccgcgccggcgacgaacaggaggacgagaaagacgagcgccgccaccaacatgtgcggagtggaccgcttcatctgcggccgcggcggcgacgagctcatggctgctgtcaagtaatcgtcgccgctatgttgcaccatgattgccatagagtccatgcattcaactttatactgaggatagggtcttggaggccgactccgaactggacacgtacgacgtacgcgacataagctgactccgaacgggatttggactactcttaagtaatcgactgataattctgtcaaaaaaaaatcgactgataatactcgccatcggtataccgatcgctcgattattatcgggtgctccaataacaaattaagcaactgctctttccactccattcatacgtatctcgctctaatttactttttttccctgagcttatttttttgctttgagaggtttgtcaaaataatctttctcctaaattatttatccaacatacgatttgattacaccgttatattcgttgtaattaaaatctttacattaagatatcacatgatcatattatgatgaaaaaaaatatatctttcaatccatcaacactcgatatttcatatgcaatagcaacatgttttcaatgtgtgtttcaccatgttttacaaaatttacccaactagctacttgcccctactctcacctctctctccactgcatccatccatacatgcatacatttatgatgctcaaaacaatttttttctcctaaattacttatccgatctagtccaatcacacgttgtatttcttttaattcaatttttacaaccagatatatattacatgattatattctaataaaaaaaatcatatgtttcaatctgttaacactcgatgtttcatacgcgatagcaacatgattcaatgtctttattgtgttccacaaaatttttaaatgtttcattttttttatcaaatataacttaatgttttaccgatggtcaactgaaatatttgaccgtccttttctttgacacaatcggacatccgatttggagtttcctcctaaattgactactaaaaattagaaaaagtaaattttattttgggtcaaatttattggagtttcatgatagaagtaggtacaaagtactgcctctgttcacttagagcgtatatattttgactgctcatttagaacgtattttgatttaaaaagaacatttggaatattttgaccaacactaataaaattacaagtatattaatttacttacaaaggtgaccaataaattctcacttcaatgtgttttcacacaatattgctttcataactatttaagatgacaaatcagtggtgaacgtttgcccttgaagatgttttggaatcaaaatatgcgttacaacaggcttgctaactttgttgctaaactcgtattaaaatttctaattctattatatgaaccaagggcttgctaacactactacgaaaaccatttttcgtggcggccattttagatttttgctggcggaatttgcagccgacacaaagcaaaggccagtgaagatcaagatcttcgctagcggttattgaccgccagcaaaaatacattttcgctggcgttggcttaagacggctgccagcgaaaatggatttttgctggcggctgtgttaaatcggccgccaacgaaaatggatttggggaacaaaaaaacacgcatgcagctgcccagccgccagcgaaaatacccatgtagccacccattagttcattaattttaaatttcaaatctacatctagattcgctgctcatttccaaattcaaacaccgaaatacaaaatcatcatcagcacagatcaaacatcatttacacaatcaaacatgatctacacagatccaaacatgtgcatcatctggaacaacatgcaaaaagaaaaagaaaaaaaaaatcaaatctagccgacggcggagcaaggtcgacagtggcggatcccgcctccccgcggcccggtggcggcggatccggcctccccgcgggccgccgcccgctcccgagcgccgccgcgcccacgcccacgcccgcgccgcctcccgctgccgtcacccacccgcctaccgccgctgccgcgcacccgcatcgcgtcgtcgtcgccacgccgaaaccgccgccgccaactatggggtgggaggagctagttagtggggatggatggcgccggcgccggtggagaagagacggaggagagacgcgaggaagagaagggagggaggggagctggagagagggggcgggtgggtggtggactggtg

SEQ ID NO: 31023 - DNA, 2056 bp, Oryza sativa
tctatattaatagatgatggtccatctatgcaagcggtccttctaccgccagtggttgcttaagtgggccgccagaaaaaataattgcattttccctaccggtctgtataacacaaccgctagcaaaaattatccatcttcgctggcggcacacataagtgaccgctagcgaaaatagacatatcttcactggcagctggtacaacgcgaccgccagcgaagatccattttcgctggcggtcggtgccccttaccccctcgttacaattttgctggcggttttggcatttctccgccagcgaaaatcatataccaatgccatgaaaaatcgtttttctagtagtgtaactttgttgttacttttaaccctacaaaatcgaatttggtagaattagatgtgtgtcgacggactatacccgcagacgatatttgtagagtatgatgatcgttggaaccagggtatacatgagattgaggcatatgagacgaaagacagagatttttatacagggtcagaccccttaactggcaggtaatagactaacagccatactcctattggttgaaaccggtgttgcttttatatatcagtatcatacaagttcaatatttgggatgacctaatctaatctagtcattgtcggcttggaggcatggagctctcacatgtagtcgatagctagtataggtttcttccttgaatatgaactcggtgaaattggagatagctctagatctctcatgtcgacctctgaaactcctacattgggtttgtctatttctgaattggcttgtattccgttgaattgtcctctcttctcctaggggttcttgtatttatagcgaagatcattttcctctctaagttgaacttgaagaaatataacaggatatagactaaggagaccttatcttccccaactaggattctaacaccttttatttcaggaagataatttccttctttatccgccgtattttcttaatcaaagtatatcttctcatatactattagatatatagtatttttgtatatcacgaacccatgtataagaggtatgccttatccttgacactagccatgtgttcttaaagtcttatcaaagtttttaaagtttttaagagtgaacttttgaaatttgataaaatatcaatattaagaatgtgtttattttgttgccctaccaaatttgaaagtgaagttggtaacaaagtgaacaacctgcaaaggattaagcaattcttagttaaaaaaccagttaaattagtggttatgaagcctaagataattgataagagtgcttaaagtgtacaaccgaataaggccttagaaattaaacaactcctatttttttttattttaatatataccctcacattatattggctttgttcggatgatatagttgcagtagcgttgcggctgtgctgtagccagctagccagcagttacatgagttgcttccatccagtattgagcagttgcttcttgcagctgtgtgtctgtgtagctgaatggctagaatgtataacataggctagaacgctgcaacaatggtctaccgaacaagcctattatgtttaaagatttctagctccatttttgttttttttaaatcactcttacaattttcagaataggttttttttcatggctatcttaaaaaaattaaggctcacgacaatgatataaacatgtgaaagatttcatttttttttataagaaacaaatcactacctcatgatgtaattctttggcaacgtgtaagaatgaagccggcaagaagcgaagctcgatggtcagcaacgacaggacacggctgctattccgcttctttccgctcggaccagcccactaccggcccactactgaagtgaaaccaccctccgccgccgccgccgctcgccgtagtcacctccgccgccaccctctcttcccagtgctacctccccgccccgccgctttgccgcctccggctgaggcgaatttccagtatccaagccagtcggacataagtaagggcggggaggaagccgtgcctgcgagtttcgacca

SEQ ID NO: 31024 - DNA, 3961 bp, Oryza sativa
ggcaagtttttcaaggtttcaatttccgctctcctccctgttaccctgcgcagatctgtcgtctactttttttttccggactgcgcaaatcgttaggaattaggatttctattgtgcgagatagatgttcttcgtcgtggagacctccagtcctccacacttgttgaagctgcgttgttgttgttgtgatgtgagctaggtaggcaggagatcgagggaatgacagtgccaccgtgttccactgtttctcgaggcatgaaattagaacggaactccccatggtaatgcaatcccttgcatagatcgacacgatggcctgtaataaattccatacatttgttaccagatcgtccaatcggagatgatggtttggaataatatgctgctctgtttattctcccatgttattcatggcttgaggggcatatatcatgatggatattacgggccttgtggacctcttcgcagcgcagcatcttgttcgtatgagttttgactctttgagtcctacactagtaactcataccacagggttgctatttacatcaatcgtgtttcctttgtgttaggtgatctagtgtttttctccacattttccacagtttgctgctattgtgcttgggtacaatgatatcaagaaaatgtgacctagactttttctgtgaataggtaaggataatatgaattgatgtagtaagacactataactaaattttaaggaaacaaataagtacttttaaggaaacaagtaactaacctgatcatctcattttgttaggaaaaaaaggtatttgctaaaggaatttccagaacttcttaacagcaaggatagtgcaaaggttttagaggtgggttgtgggaatggaagcactgttgttcccattttacggtaatgtcctccaaagcattgttgtatttagtaaaaaaatatctatttgtagttgcaaatgcaaatcgttcaatgcttattttttttgttatagagtaattaaacattgatgtaggattatagccgcaaatatatttggtactttggttatcaaagtaaataatctagacaaaataaaaagagaaaaaaaacaacatgcactttttaacacgcacactggtgattaaacagctaatggtcactagtttgctagtcaaattgccagtatgctggtcagacacatattctcgtgacatttcttacctgccaacgtgctgcataaaagaattgtacccaatacaaacaaaagtgatttcttgctttttgcttagacttcttggaattccatttccatgttaggcatgtgcatatttctcacttaagaaatcatccaatccagcacaaagtccatgaagtatacttcaatctccaccgatccagcataatatcaaagcaaatcaagcgatctccatgagatgcttttaatcgctcgttgccattggcatgcagctgatgtagtctggttctgaattttttccttgtttaactgccagttctgtactgtttaactattatgctttctagctcagagttggtttggaactttggatttgtcaagttcatgcatctttgaggataaagaatacttttgcctatgggcatttgaaaactgttgacacccagcatcaacaaatacttctcctttcaatttcttctgcttctgaagttatacataatcctggaatgtaaaattttctgtctttcttttctttctttgtttggaacatctgatgatttcagtttactatatcatactttttgttaactagaaaacttgttaaatttcattcttttttatttttcccctgaaaagactatttttggtttgccacttttccaacattctgttctgtgcatggtgctttaatcagtactagtgatgtatttattaaggaattttatcgcaaactggatagctcaataatgctatgaacaatcattgtaatatcttcattgaagtgatgcatattggatcaactttcaattagcgatgaatatgcaactcaagcactttatggattaacacttatggcatgatactctaattatgtatttataattgggcgagagcaaaaagaatagaattaccgctatatacaaccttttaggagcatacatatatgggatggaagttgcagataaacttcagagttgaacgtgcttgccataacttgaagtttatgtagttcatggtttaagtgattgcctcgtcataactactaatgatgacatcgttgctatctactctttctacagctctagtccaagcacaactgtatatgcttgtgattgtagcaaagaaactctggagaaggcaaatgagattgtttgcagcacaaaaggagttgaagtcaaggataggttccatccttttttactggatgcttcgaaggaaacttttccagattggttgttctgcaaatcctgtcgaagtccatgtgcgaaggatgttgaccttttactagtttaattaattgttttgaaattttcttttacccgaattatctactccaataatgtttgattcgatggtaccttttcctttcaggctcaagtaattgtaatatgatagaagaataccctgcctttctcagagacaatccatgttgtgttggtggtgtggattttatcactatggttggtagcactatctttaccctattttttgtcaaagcacttccattagcattataatgttgccatgctgtgagttctgaatgtatattgtaaaagtcaaacctccactatttatgctcttgtttacatcaagtttgtatgtacgcttttcagatattcacattatcagccataccttttgacaatatgctagctacactagagcgttgtgtatctgttctaaaaccaggtggccttgttttgtttagggactacggtaatgccctggccatactattgtattatatatcattgatcaataatcttgctgacatctctttattgtattaggactctatgacatgacaatgcttcggtttttacctcaccaaagagtgggattccgggaatacatgcgctcagatggcaccctttcatacttcttcacattagatacagtgagagaactctttcatgcctctggactactagaggtaactcggattgttttgacatgttctcagttttctagttactttccacctttctttgcccctgcatgtgcccctcatggtagcattcaatattttatgaattaaagatgtatgccttagtcgattgtttcgttccttgttagaacttctgtgcagatcataataaatgcatcagaattgctcttatcactattaaaattactttgtaccaaaccaatgtatcataatttctgtttcgctccaaaataatccacctatatatgattaaaatcatgagatatatttcaggcttctgtatatttgagtcatctgaaatttttacatttttgtccttttcgaaaacttattttataaatggacccctggaaaaacttattccgggagtggtcctttttggtgcaccagagtggctggcgccgtactccaacatagcggcgctagccaccctggcaccgtgaccgtgccaccttggcacaagggcaagcgttgaaggggtgacgtggcaaatgggggcgccagccactttggcgccgcccctcataccatggcgccagtcaccctggcgcacccctcctagggggccaagctctaaccttctgcctcaggcgggaggctggcgccacacaccccaagcacagcgccaggttggctggcgccggccccccacccacccccgaggacttctgcctcggccgaattgctggcgctgcccctcgaagcatggcaccagcgtgcttggcgccgctcccccaacccgtagatcttctgccttgggcgggtggatggcgctgccccctatagcacgacacaagggtgactagcgccgcccaccaccccccgaggccttttgcctcgatcgatt

SEQ ID NO: 31025 - DNA, 470 bp, Oryza sativa
aacaaatatatgaagcatgtacagttgagcactttccaatttcatgtcaacaagccacacaacaaatatgcataatatatataatctgtataatatggtaagaatcaatctggataacaatgtaagcaaagtaactgtgattggaaaaaataaagggcgtctggtgcatgccacaacatgcagcaaggtcatggcataattggtgcttgctttaacgaacacaactcacaagagaacctgaggataactgtaccaaaaagtaaaagatcacttacaaccacatctttagattgtcctactatagaaactctcaatttatccagtccttcactaaggaaagatcggttttgctgggttgattggcacaatgatttctcaggtgacattggcggaagaactctctctggtttcttagccttttgagacttgaaccactgcaagatacatacatatttgcttacctcaactgt

SEQ ID NO: 31026 - DNA, 756 bp, Oryza sativa
  unsure (1)..(756): unsure at all n locations
nnnnnnnnnnnnnnnnnnnnnnnnnnnnnnnnnnnatggatgactatcgatggattaaaatttgatgacgtgaagcgaagaaaagaaaacggtaaaactagtgctttagttttaaaattgatcgaggtgaagggcgatcaaatttgctagtttattttttagtttcgccttactatcaaggggggtaatgacctagcaatgagatgattttaattgccacactaggtcattatgcatttagacttgtgctcacatttcatctcacacacacaatctttttttttcactgggttcggcctgaccaggggcggtcagaccggccacatagtggcggtctgaccggcgtgccctggctagtctgaccggccacgaaacggcggtctgaccggcggcacatgcgcggtcagaccggccccctggaggccgggatggtgctgctcggggtggccgatacagagccgacggagccgtattcggtcagaccgagctgatggcggtctgaccgagccgaggccggtctgaccggccactcaacgtcggtctgaccggccaggccgatggggccctctgacagggctacaacggctagttttctagccgttgcagagtagcacggtctgaccggccacatacctccggtcagaccggcagagcacagagctgggggatttcgcccccaacggctagttttggttggtgggagtataaatactccccttccagcagcaagagggctctcttggcacccaattcaat

SEQ ID NO: 31027 - DNA, 1289 bp, Oryza sativa
ctcttgtctccttgtctcatttacctgttgcatttacatttgtgcaatttacatttctagagacatactagagatcatttcaccctaggattgctaaacattgacataggagtgtgatttactttcctagagatataattgagccactatcaccctaggtttgcaaaacataaccgagttgcttagttagagttgaccctcaccaagcctagcaacttaggttagttttgattaggtgtcatttagttttaaatcgcctattcacccccctctagtcgacatctcgatcctacaagtggtatcagagcttggtctctcttgattgagcttcaccgcctagagagaagatgtcgaacgaggtgaaccatgtagggaaggctcccatgtttaatggcacaaactactctacttggaaaattaaaatgtctactcacctcaaagctatgagcttccatatttagagtattgtggatgtaggctttgctatcaccggcacacccttgacggagattgatcaccgcaacctccaactcaatgcccaagcatgaatgccttgttcaactctttgagccaagaggagtttgatagagtgagcaaccttgagaccgcatatgagatttggaacaagttggcggagatccatgagggcacaagcgagtacaagaatgccaagcttcattttctcaagatctaatatgagacattctccatgttgcctcatgagagcgtgaatgacatgtatgggaggctcaatgttattgtgaatgatctcaaggggcttggggcaaactacaccgattttgaggttgcccaaaagatgcttagggctctaccggagaattatgagacccttttcaccatgctcatcaactccgacatgtcaaggatgacacccgcaagcctcttggggaagatcaacaccaatgacatgtacaagttgaagaagaaggagatggaggaagcctcaccttccaagaagtgcattgctctccaagccgaagttgaagacaagggcaagggcaaggtgaatgaagccaataaggacttggaggaagagattgcccatcttgctagaaggttcaatgatctcttgggaaggagaaaggagagaggaaggggctccaactcaaataggagaagaaatagaagacccaacaagacttcctccaacttgaggtgctttgagtgtggtgagaagggacactttgcttccaagtgcccttccaaggatgatgatggagacaagtcatccaagaagaagagtggaggctacaagctcatgaagaagc

SEQ ID NO: 31028 - DNA, 11465 bp, Oryza sativa
gctctaaagaaggatcatgcttctttggatgtcttgtatgaggagctaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatgttgcatcatctagcattcctacctcttgtgatgatcttgtggatatgcctagctctagctctagctcttgtgtttctatttgcgatgcctcacttgttgttgagaataatgagcttaaggagcaagtggctaatgagacaagagtttggagaggtgcttcaagggtaagaacactcttgacaagattttgagtgaacaacggtgcatccttaacaaggagggacttggattcattccaaagaagggtaagaaaccttctcaccgtgccactcgttttgtcaagagcaatggtaagtattgctccaagtgtcgtgaggttgggcatttggtgagtgatttccccgatggtaagccttctaagacatgcatgtttgattctcattatatgcttaggaaggctcatgatggtagcattgttgctagatatgtgggttcccctatactcagtggtaaaaagaatgccatttgggtgcccaaagctttggtctctaacctccaaggacccaaacaagtttggatacctaaaagagcttgatcttcttttgtaggtgaactaccgcaccggtgggagccattgggtgcttgatagtggatgcactcaacacatgaccggtgatagggctatgttcaccacatttgaagtaggagggaatgaacaagagaaagtgacttttggagacaatagcaaaggaaaggtaattgggttaggtaaaattgctatctccaattatttgtcaattgataatgtctctcttgttaaatctctaaatttcaatttgctttcggttgctcaaatttgtgatcttggcttgtcatgtgctttcttccctcaagaggtgattgtttctagccttcttgacaagtcttgtgtgttcaagggttttcgatatggaaatctttatttggttgatttcaattctagtgaagcaaatttgaaaacttgtttagttgtaaaaacttcattgggttggctttggcataggaggctagctcatgttagcatgaatcaattgagtaaactttcaaaacgtgatctagttgtgggcttgaaagatgtgaagtttgagaaagataagctttgtagtgcttgtcaagccggcaagcaaggttgcatgttctcatcctactaagagtatcatgtccacatctagaccattggagcttttgcatatggatttgtttggcccaacaacctataagagcattggtggtaatagtcattgtcttgtgattgttgatgattattctcgctatacttgggtgttcttttttgcatgacaagtctattgttgccgagcttttcaaaaagtttgcaaaaagggcccaaaatgaatttaattgcactcttgtgaaaattagaagtgacaatggttccgagtttaagaataccaatatcgaggactattgtgatgatcttggtattaaacacgaactttccgctacctactcaccccaacaaaatggtgtagtggagaggaaaaatcgtacattgattgagatggcaaggactatgcttgatgaatatggtgtttccgattccttttgggcggaagccataaacaccgcttgctatgcaaccaataggctttatttgcatcatctcttgaaaaagacttcctatgagctaattgttgggaggaagccaaatgttgcctattttcgagtttttggttgcaagtgttatatttatcgaaagggtgttagactaaccaaatttgcaagtcggtgtgatgaagggtttcttctaggttatgcctcaaatagtaaggcataccgggtctacaacaagaacaaaggtattgtggaagaaaccgccaatgttcattttgatgagactaatggctcccaagaggggcacgagaatttggatgatgtaggtgatgaaggcttgatgagagctatgaagaacatgtctattagagatgtcaagcctattaaagtggaagacaagccatccaccttcactcaagatgagccatctacttccgctacgccaagtcaagctcaagttgaagtggaggaggagaaggcacaagatccagctatgccacaaaggatacacaccgctctttccaaggatcacccaattgaccaagtgttgggtgacattagtaagggtgttcaaactcgatctcgtgtcgcttcgatttgtgaatattactcgtttgtttcttgccttgagccaaaacatgtagatgaagctctttgtgattcggattggataaatgctatgcatgaagagctcaacaactttgcaagaaacaaggtgtggacattggttaaaagacctagagatcacaatgtcatagggagaaagtgggtctttaggaacaaacaagatgagaacgggttggtggtgtgaaacaatgcaaggttggtggcacaaggtttcacacaagttgaaggtttggacttcggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtgtgtcaaatttatgttgatgacatcatattcggttttactaatgaggtattttgcaagtaatttggtgatttgatgtctaggggatttgagatgtccatgattggagagttgagcttcttccttggacttcaaatcaagcaactcaaggatgggacgttcgtgagccaaaccaagtacatcaaggatctactcaagaggtttggcttggaggatgcgaaacccatcaagacacctatggcaaccaacgggcatctcgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcatttctctactattggcttgtggtacccaaaaggtgctaaatttaagcttgttggctattccgactcggattatgccggttgcaaagtggatagaaagagcacatccgttagttgccaaatgcttggtatatcccttgtgtcatggtcatccaagaaacaaaactccgttgccctctctaccgccgaggcggaatatgtttcggcgggtagttgttgtgcccaattgctttggatgaaacaaacattgttgaactatgccatatccttcaccaaaaccccattcctatgtgacaatgatagtgtcataaagatagccaataacccggtccaacattctagaaccaagcatattgacatttgtcatcatttcctaagagaccatgttgccaagtgtgacatagtcattagccacataagaaccgaggatcaactagccgacatatttaccaagcctcttgatgaaacccgcttttgcaagttgagaaatgagttaaatgtcatagatttctctaatgtggcttgagatggtgcaccatggttgcttcttttgcattgtgtatatttgctctcattcgcacttatgctttggatttattgccatttggttcttcattgcagaaatggagcatgtcacattaagggggagttttgcactcttgcatgtgctctacttccttttatatgtgagcaaatcaactatagtggtgctagtagtattttcaaaatgtccaagtcaacataagtcaaaacttttgtaaaataaatgtaatttgaaaactatctcttggaaaatgtttcaaaagttttcctatatgttttccaagcctcacattgcaagaaaaatgatttttgaatgaaaatgccattttggccctcttttgaagaaactagattcttagttttggccaaaatgagatttatccccaaaatgagattgagaaggaatttgagaaaattttcaaaacaaagttggtagagaagaagatttgaaatgtttttggtattcaaacctattttaaaaaccaaatcattcaaaagttatttgaaaaccaatttggcccaaaaacccctatagaccataaaaggtcacctcatagcacttaagtgagttttgttgcaaatcatcataatcttcaaatattgtggatggttagcaatatttaaactcacacatttcaaaaattgctccaaaaatcaaatttttgttgaattttattgtgtgggggttgccggcttgtgcaagggctgtgcacagccggcagggggcctggcagtctgaccggcgctatatgcgcggtctgaccggccaggtgcggcggtctgaccggccacatagggccggtctgacgggccgaggtgggcccaggcagttttgccccttttcttctccatcccacacctaccttctcccatctcatccccattcacccccaacccgaaaaactctctttctctctcacctcccctcaaaccctaactctttcctccaccaaatcccctcagtttgaccgcagatttctctccggttacaccgtaagtgattctcctccgcttcctctctctattccatggattggtttgtgtttttgttgagtttttgattcatggcatggaaccctaggtgaagcacgaggtgttctttgatttgcaccaatagagggtagtttcttggtgtgattcaactccttcaaccggtaaatcactctccctcttgtgcattcactcaaatcgatctatttcaacctctagggttaagggtagtttcctcttttgttccaatcttgatgaaatatgtccaaccctttgatattcatgttccaatcctatgctatattgttccagcaaattttagactcaaatgtgtagatgtgaaaattttttggatgcttgaacttgtgggaggaggtctgcccggagccacaggcggtctgaccgtgggtcagccgccggtctgactggcgtgtgcgccctgtctgaccggccagcagcctcggtctaaccggccaccagtgagcggtctgaccggccaccatgggcggtatgaccggccaccatgggcggtttgaccggcctgatgccgtcggtctgaccgccctactggctgcggtctgaccatccctccactggatataggcaaattttcacctctccaaattggttctagaattattgctaatatcctatcatcctttgctttttgacagtgatgccttcccgcactcgccatggttgtcgtgcgcccactctggatcccatgagtgagcctgaggaatcgagcggagaggattacgctcaaagtgatgaagaggttgaggccaatgttgagggggctagtgaggaggcaagtggagatgatgtcagtggaagtggagaggatgaggatgaacaaagtgatgagatgaacattgatccctccatccagtttgtggtgaacatgaggaatccatcgcagtataccatcttaaggcatcatgatcagttcttgaggcctcgggacaccccggatccccattttcacaccgctttccagaagactgtgtatgagcaggtttatgcagggaaagcatttgtagagcataagtggatttcttggagagacatcaatgagactccagagtttgagagcttgcatgatctcttcaagactgttggcattgaccggattgtgaccctcaagcaagactacaatgaagatttgatccggcagtactatgctacagtgtgggtggctggagactagagtgagatgaagtggatgtccgacaccctccagtgttctatctctcgaaggcaattccggcggctcctcaacattcgcttggactttggagatgatttgcatgaggagcacactcacaatccgctctccatagactatctctctcagttctatgaagatggagtgcggtacacacatgggaaggttgccggcttgaggactatccccagtgtggttaaaaggattatgagagccactatcctccctcgccttggcaacaatgatgacattaggggggtggcttggcacgtcatcgatgcaatcattcagggccgtcagttcgacattgtgtctctcatgatgcaagagattgctatcttcaagaggacattcactcagggaatctattatgccccttacatcatgaggttgattcaagacaagcttggggctgctgggcaaaatttgaagaagcacaagcagtacaagccccgccttcagcctagagctccccgtgctcctaggacggtgccctcttctcaccctggagctagctcaagcccagcacctcctcctcctcatgggtatgatccaaatgcttctttcatcctcactatgcttactttggaatgcaacccaatgaatacttcaacccggtacttggggctattaataccttaagtgaaagcattcaacgcttgtctaccaggcatgaagcattgcatgaggatgttcgtggcttgcgcaccgatgttggagacttgaatgcttccatggggagattgcacactagagtgggtgcattggattctcgagtccaaatgttggagagcacccaagcttttgtatatcatcgtcgtcgtgatactcctaatccttcctctttggcgcttcctccttctcctccacaagaattaagacctttttggtacttgatgccaaaagggagagaaaaatgtccttaggtgtgctttatgtattgtgggttgggactaatggtagtgaggttagtgtcctcatatctaataggttaaggtggtttgagctatattatgtatgggtatgggctgttactctatattgtgtgttctttatcgttttgttgaactctatgtcatttggacccttcgtggtcttgtaatagcctatgtttatttgtgagcccttttaggatgatttgtgacttatgtgagttgaatggttaagtgatgtgaacttgtgcaatgatggatggtgtatgtgatactgatatatatgtgaccatcttatgctcatggatgaatatttcttgaagttcacattgagatattgctcttgtgtttgtgatatgttgaattgtgaaattgaaatgtgcattggctccatatttgccatttgtgattgttatgcacatgtttagggggagcttttgatttcctttacagtatatgtccatgtgttctatgtttgattatatatattcgtggtgtttgttatcaattaccaaaaaggggcagattgaagcatctaggccctcgttgttaattttggtaattaatgacaagcgctaattgtggactaaccgttgctattgagatatattttaagttaggtccacgtcatgtgtgcgcatggatgactatcgatggattaaaatttgatggcgcgaagcgaagaaaagaaaacggtaaaactagtgctttagttttaaaattagtcgaggtgaagggcgatcaaatttgttagtttatttttttgtttcgccgtactatcaagggggtaatgacctagcaatgagatgatttttaattgacacattaggtcattatgcatttagacttgtgctcatatttcatctcacacacacaatcttttttgttttcactgggttcggcatgaccaggggcagtcagaccggccacatagtggtggtctgaccggcgtgccctggccggtctgatcggccacgaaacggcggtcagaccggccctctagaggctgggatggtgctgctcggggtggtcaatacagagccgacggagccgtattcggtcagaccgagctgatggcggtctgaccggccactcaacgtcggtctgaccggccaggccgatggggccctctgacagggttacaacggctagttttctagccgttgcagagtagcacggtctgaccggccacatacctccggtcagaccggcagagcacagagctgggggatttcgcccccaacggctagttttggttggtgggagtataaatactccccttccagcagcaagggggctctcttggcacccaattcaattgcatacaccccttgcacctctctcacacacctttgagcttagtgttcatccattgtagtggttgagattgttctagacaagagtcaagtacatttgcttctatttgtagagctagtgtggcacttgatttatcatctccatgccgggtcattgcttgttactcttggaggttgccgcctcctagacggcttgtggaggagttgcccggtgacctctctaagaagattgtggaggaggcccggcgccggtttgtgagtggttttgagttcaccaccttcggagtgaaggaagaactaccctagtggccgaggcttgggtagtcctctccgtgggcctgctcccgtcttgcccaccccttgacgaagggggcgtgcggtggcttcgtggttgagcggtggagttgggctcgcctcaacggggagtaggaaactggcgagtttccgaacctcggtgaaaaatctcttgtctccttgtctcatttacttgttgcatttatatttgtgcaatttacatttctagagacatactagagatcatttcaccctaggattgctaaacattgacataggagtgtgatttactttcctagagatataattgagccactatcaccctaggtttgcaaaacataacttagttgcttagttagagttgaccctcactaagcctagcaacttaagttagttttgattaggtgtcatttagttttaaatcccctattcaccccccctctagtcgacatcttgatcctacagtagtgcatgcagcctacaagagattgtaatatagtatcgttgttgactgatatgtttaaaattaagctagtgtgctcaggtctgcacaagtacaaacaactgctagcgtggatatgtctcactatgattatttagtactacacattagatcaattttgcatgtgtgttgttttgtactaggttcgtataaattagacaagctattgtattaaaacgagcaatttacaagttgttatacctatttacactcgccgagcaagtttatgtaccttatttttatcgatgaaacatttttttgcacgacgcatgaaacatcgttcgaaacaacacacagccaaacgtcctccgtcggatgagccggacggtggatatgggctaaagtcacaccgcaactagacagcggacccgccggatcctaaaaccctacgcctcccgccgctggccacccacggccacagccgccacacccaaccttccgccgccgtcgccagccagccagccatggggagccggctgggtcgccgcgtgatccacttcgccaacctccccctcaagctcatgctccctcccgcgccgctctcctccgtccaggagttcgccgtcaagaccgtcccctccgcctccaaggtcgacatccgccgctgcctcgagtccatgtacggcttctccgtcgccgaggtccgcaccctcaacatggagggcaagaagctgcgccggggccccttcctcgccgccaagcccgactacaagaaggcctacgtcaccctccgcgccccgctccccgtctcccccgacctcttccccattgggcttgtcctcggcgagagggagcgcaaggccagcgccgccgccgccaggaggaaggcggtggagggcgccgaggtggaaggggagggcaaggggaagcactggatggaggatgagaaggtgggcttctccagggccggccgcggcaaggtggtgtacggcaaccccgggaggctggggaagaagaggaatggaggtaccaaggtgaaagacagagccggagaggaagtggggaagttcccatggagcgggacgcgtcttgctaccgagaagaaacctgctaggtgaggcgttcggttcaatctacctttcttgattaactgatgtttcaactcttagcaaattaattgtagttttgttcatgtggaattgattagtactacagtttctaacctttattaatgttcaagaacggtcttttggctttgttgaagcctgagtagaatagtagaagaaaccaggatgatgcggtccaactcttagcaagttagttatttttttgttcatgtggaattgattagtttctaatctgtgttactgctaaagaacggtcttttggctttcttgaagccttggagtagaacagtagaagaaaccgtgataatatggtccaaatcttagcaagttactattgttttgttcatgtggaattgattagtttctgtgttactgctaaagaacggtcttttggctttcttgaatcctaggagtagaacagtagaagaaaccaggatgatatagtagtatcagtgccaaatttttgtgtttgttgctgggggaaattgcatattgttgtaatcatactaaacgagcgatacagatggtgatctagaaatgatattttagatgtacactagccaagtgccgtttgttgcaaggaaagcacaattttctgaaatgtggagacttgctcttactatacagtatcttgagaaatatataaattaacatcctattagtgttaccatcagaaatttatcccgttttagttcaaggtgttctggtgcaaaatgcattttgcatgtcacctcattgctgcttcaaggttcctctaaaagaggatttaaaagcattgcaaattaaaatttgtataacttgaaaataattgattatttgaaaccatgcacagaatgactgttcatcatctcaaccattggtcatctttcttactttctgatgtatcgatgacatcgaaaagcagcagagttatacacataatttccaattttcctttaactactctcttataggttgcacaaccatccctctattggagttagctaaatgctaccaatatcttctctatgccttttctgtgcaaacttttaatccttaatttctaaatcccaagtcacattattgaaaagttgcacttgttaatagtataatacagcagtacaaatgttcattcaaagctaaccattcatgcatatttcaaagattcaatcctgagaagaaagggaaaaccataccgttcataaccatacttttatttagaaacc

SEQ ID NO: 31029 - DNA, 21376 bp, Oryza sativa
aagtagttgctttttgatggtcacggtttcaggtagtatcatatatgttataattagcttaccaagttagattgcagctgcagtacagtaactgaaagagttctgaacttcatgccatgattgtacaaaaatgacccctccttcatatatcacctatgacgaccagcgcttagccctaatgcagtgaaatgaccagtggttttattgatctgcaatatattcaccttttgataggaaagtttgaagaaaaaagaacacaatgggggtgaaaacaattcttcattgctatttacttgattgcacgcagttcagatagagaactgattaattgagcagaattccataaaacacctatatggcaaaggaacatgagcaatcccagaattcaagagcctggtaatttggacctcaagtcctcaactaaaaaggaatatatgagcaatcccacaatcacaagataatttacacaaccacgttgctctgtgatgtatttcttttttatctgtagaggtatgctaagtagctcaggtataagttctcttcctttttgttacataccaccacccagccttcccatcggctgccattgctctttccaagatcacatccagtaagcctactattgaccaacccaaatttgcggctataaaaggacacaataatatgagttggatgaagaggtgaaatcatctctcaatatagattaatgtaaaccattgcctccgatatcaaacgacaacagatgtacgttttggttccaaaccatttgttacctacctcgatcatatggtcaaaccaaaaaatgcttcaaattattaaaagctagaaccatgcaaagttgtcaacttattagtatgtcatattgctatgagaaattgaagaaataaacactaatgtacaggaaggtgtagtggcaattttaaccagcctaccaatgcattagggttctcatagatttttagagaattcccattggaaaggtgcatcttgatcagtattctgtatccaaggctgaagtttgtttcatacttgctcctccttttttagaaagggcaactatgtcttgcttaagcttcatacaatcatctgtgaatagaagagcaaccaataccagtccacataatgtttgcagcatgattctcagaagcatcaagaaagccatcactgaattttacctaaagcactgacatcatgctgacacaccaaaaattgttagaacgcactgtgctgaagatgtgtctcagttctgactggagaggacacaagtgcatcggctaaaggatatgtgatgatacccatgtgagcatgtaggttagaaagatgacagctaattgagcacgcagggcaatggaggtgatatccatcataattcatagaagacaatagatgccatctaaccctcacagacgaaggaactttaccatggaaacacggcagtctcctctgtcatggaggcctaaaggggaagggggagtgtgtggaggatgggagcgcagcatcaggcccatgccagtgcgcatggaggtcaggagtgcaacattggctctcactggcgcttttgctggagagctggtaggggaggggggagtgggcatcgggcggagctgcagattctgggaggggaaggtgttgtttattgaagaatgggagaagagtgcgcgtgcctggcaagtcaggagtgggatagcaaatcatggttaattttagcaacatataatagactcatgaattgatttcattgcaaccataaggttttttaattgtagacccaaaaccagaagccagcaattcagaagtaaatcagtagctctgcttcagtctgctagagatgaagtgtgggaatttttttcctgttttatctacgaaatgggtgcaatcaaagtaattttaataaatagaaatatgggacataacttggttgaattgtaatatgtaagttccttgaatcatgaaggatggatgtgaattgcttatatgttgtggttcaatctcacgctgatatattttttatcaggaaacagcagtatgcccccaagaagaagggcatagtcctgaagcagaagtcatggaagggatccgtgcatcggcaaccaaagaagaaggtggaagcttagaaccttgagtcgctgcattgcgatcatgagtgcactgtgccacagagcaggacgcgagcggtagatccatgaatcacaatgccagatcagtcttgtttttcattcacagaataaagagcaatattttggcatatgtatggctttggttactttgatatctcaggcttggttttctgacacatgaggccaggaaggtgaatggtagtcaagtttgtgccaacctgttactgatgtccttagatttcttttgagatgtctatttgtcatcaatcacaactgagtatgtacaactgatgcctcctcattttttttttgttcttgtcaattacatatacctgttattcccgtggattggtatcatatgctgtttctgaggctcatgtatcagttgtttttgcatttcaattgtcactatagaaagaaaagctgcattctttgaagttgttcatgtgaatccatttggttgaaaaccacatgttccactcgcatagtccgcctgtttatgttttagatggattgatgtccaaaggaaatgcccaacaaaatttgaatactagaaggtttggcacaatgttttgtttagtagttatcgatccgttccgcttattttaatcggataacttcagtaatttgtagtgtagaaatatgcagaatttaatatcgtttttctccatatcaactctgaaaagtttgactgaatctgatcataaacaagaagtagtggtgagaatattcaacacctaacttccaaatccttcttaataaactgttaagtgcacctttggattggaggattttcataggggattgaattccttaggattttattcctatatgattctttggattggaggaatgttaagagcaaggatttgtggagaagaatcgggatgaatggggatagattggattatagtagatgaaataacaaggaacggtcctgaacctaaacggcgcgacgctctccgtcgcactgagaaggcaggtcgatgggcactaagataaatcttgatctaatgcctaactgacctgtgatagaatccctccttatatagatggaggactacttaatctaatcctaacaaaccttatctaatcctaacaaaccctaatcctatccaatgagtctaggacgcccggtccaaagcccatgacattacacccccctttttgagcagctcgtcctcaagctgcagctcaccctgctggactcaaacgaagtaccataacctaaacgaagactctcaagccttttacatctcagcttgtaaagagccctaaagaactaatactgctgtcatcatgtacatggacaggagaacgccgtctagaagccttgaacggacagttaggctcaagccgtggccaagcacagcagcatgcctctcaccaaaacccacgtgcccagaccaacagcaaagggagaagcagcagtttacttgcatggttcatggcccaaaacatgaggaagaaccatctatgattcatgggccaacgtggaaaccaaccagaccagaccagccagcccaactggaagaagacagaaaccctatccttttcttcacgtggccacgccgacagcagcgatgcagccaactgcgatcgaatcgcgagcttctcgagccagcgctcggactcggagcgatctgcgccgtccccacgcctacgggggagccaatcgagtgcacgagcggggccatccgcgcgaagggcacggttcgccagcagatcgtgccaaacctggcgcccgaagaagccgctccgcttcccatggctctgctccaaccgtcgccggaatttgcgcctcccactgtggaaaccgattcgcatgatcgcatcgcccggaaatcgcacggatgcccgtaccgtgctacgccgccatggaagtggaactcgcagtcgtctcctctgcctccgttgagaacgccaataaccacggcggcattgccaggccgaacagcgaggtcgagttccggctaggcatgctctccaacgaccttgatcccgccttcttgtttcaagggttggcgtcacaaaagtaggcaccgctgcccttgacggtgtgtcgtcggtcgccctgagcttctcccgggtggtctccaatggctcggactgttgaagcgccgccaagagcgaaggaggaagactccatctgacagctgttaccggtgacaacccaaccggttgtggtgcctgtaggcacggtgaaggatgtcgtttcgccgtggtggtcgacggcggcttgggcagaagtggcgccgttgatgccatccccagcaccacgccaccaagtcttgtttccgccgagatgagtggcataactcctggcagacgaccgcgagggatggccgcctttggctgtggcaggcaactcatcctcctcctcgagttggcgcctcgcaaccgctgcttgaattcgtgctgccgtggtcgcaggaacgtcatggcctgccggtcggatcgttcagcagctccgagagacatggcctgctcggctgatggagccgccaaagcctggagttgtgccgccaagtccatcatcttcgtcgagatcttggcaagatcttcgctgatgttgggaaccgccgcgatctcggcacccatgggcacggaaccgaagctctgataccaagttgtcacgagcaagaattatatgaagaagaatcgggaagaatagggatagattggattatagtagatgaaataacgaggaatggtcctgaacctaaacgacgcgacgctctccgtcgcactgagaaggcaggccgatgggcactaagataaatcttaatctaatacctaactgacctgggataggatccctccttatatagatggaggactacttaatctaatcctaagaaaccttatctaatcctaacaaaccctaatcctatccaatgagcctaggacgcctggcccaaagcccatgacaagtaacaagatttgtaaaattgtatgaaatgatattggtacatctttgttccaaaggaaaataagcataaggtaggtgcttttttttatttgataagtccaatgcactccctccctttatctatagctttctcttttttcctagataacttgggttataatttgactagttagacttatatattggttcaactagatattagatgtaattacttagttatgcttagaaacattagctcattaatgggataatttatacttcactatcacttatggttatatttaatggtagctcacgatggtcaacgtgttatgataattaattataaactaaaagttgattaatggagagttgtgagcacatgattttgatggttgtgctcatgacaattaaggaccggttcgcgagctactgttgtgaaacattaaccgtgtcaaccacaagccagtatgggcaacgactttaccttttgtacagtgtgtttcattgcgagacaccagactgtaaagcggcgataagtccgtaggctcgctggggagtccatacctctggctcttgagggggtgattatgatccaggaacggtgcactgttatgaattgtgttatgtgaagggtaatgtcacgatttccctctttgtagtgctgtggtggtacttcggggcatgacaacatgtgtgaaatcgtgtcttgtgcgtacagtggtacatctctggctagagtaaaattattcgaatagccgtgctcgcggttatgagtgggtctaataatgttttgattagtctcacactactcgttaataataataatgtgataattgatgataattagtttaacttctggtttggaatggctaattcctgatttggaggtttgatctgtacgaccggggttggttgttcaggtttggcagggcctatgcagcaggtatgttgtatagcattggattaatattgataattaattactctactattttacaaattttgaactctttgctaaatgatgcttttgcaaatgagtcctacatcatgccattctttggtatcgatccctatgcacttgcatatttgctgtgtggcttgcggagtattccatgtactcaccttgcaataaacaccaaatctcagttgaagaaaaaggatctagaaggagaagacctttggtttagatcccagttgagctgcctgtgggagtggagttggagcttcgctagattttattttccgctgcagttttcttggtggtgagaactaagtgcctcttatgtaagtatttatcgctttgcttattttgatgaatttgtataaattgtcagtttatgtaccttagctgatttctagacgaggatttaatgcacaaattagtttggaaattacttatgaatttctgggctgtgacatcttctttgctatgagcaagttgagctggtttacctctaacccgggagatgatcactggcgtgctcttgagcgagtgatgcaccatttaaaaggtactatggacttggagcttcactatactgggtatcccgcggtactggagggatatagcagttctaattggttctctgatgtggatgagatcaaagctattagtggatatgttttcacactaggtggtgctgctattacatggaggtcttgtaagcagactattttgacgaggtcaaccatcgaagcagagctgacggcactagatactgctgctgttgaggtagaatggctgcgtgatctattgatggatatgcttgtggttgaaataccggggccggctattcttatgaattgtgacaatcaaatggtaattttcaaagtgaatagttctaaggataacatgaaatcgtttagacatgtgaaatgacgattgaagtcattcaggaatttgagaaactttggggttataacattgaattacatccaaacctggcagatcccttcacgaagggactatgacgaaatatgatagacaatgcatcgaaggagatgggtttgagacccatgtgagttctactatgacggtaacataattatgtgattggagatcccgtgaattagaccctgggacgaacaagctattatttaacttgaggggagtaccaatctaaaccatctctaactgaagttgcatgtactctcatgagctgcaaggcatgttggttatgtcttaataagttctttaattagcgaagatgctatcctgcagaccattcttgaaagaacgcacctttgtgagctggagtggtcgtagtctatggagattttggatgaattttctaggaagcttactaagagagcaaggagtatgacttatacgctccacacgagggatagtctactgacggtctagtacggtagtaccacataagactctaagtgaaacttgcttgcaaaagacttgcaattcaaggcatagtccattgttcaagttgtaaataagtgtagcttagaattctaggtggatattcagccttaattggtctccatcaaaccgctggtatataaacagtacattgagaaaaggcaaatctcagtgggattttgagatttggtgggggattatttgaattaatagatgagccttaacccattcaagattaattctttggaaaatcataaaagcccacatcatgggatggcatgcatgaggaatttagtgccaccttgcctattctaggagagggagacctccttataagggaagatgctttcctagccacttgagacatgtgaagtggagagaataggtggaacacacgtacgtgctcgctcgcctggcctggaaattcggatttgtttttcggaaacactccgaatattccggtacgtgaaacgacgtggagtccggatatgttacgcggtagtacggttacgtggagtggagattgtgcatgcgtcctgatatctctatataagttgagccgccgcctccacgcaacacacgtgaaatcaatctagggtttgcctcctcctctgtactgcaccgtcacttgtagtctactccatcccgctcaagttgagccgccgcctccatgcaacatatgcgaaatcaatctagggtttgcctcctcctctgtactgcgatcgggagagcaggtctccggaaccttcgccttcgatgtcctacaccgggagaaggcagcaataatgtttttgggaagtgctttacacgaccgctccttgttcatccacaacggctcctcttcctcttcgctcacgggttgcgcaccatcgttaacgcacggtaccacgagtccttcccgctgagcagccggttttgcaaatcccttggtacgccttcaatatgtttcgcatattcgatctgttcatgctataatgtctggtttacatgtgtagattgtatgatacgattatgttagttatggaataaattaaattattttgtgcttataaattcaacaacatatggacctgttcggcacgcaggtgcagcagccggctgcagccaacccactgtgtttttttttttttgcttcttcactgttcctgcagccggcccactgcttttttttatatatatattttgcttgcctcacagttcctgcaggctgcagcgcttaatattgtactccctccgtcctctaatataagagattttgacatcttatttgtactgtttaaccattcgtcttattcaaaattttttagaattattatttattttatttgtgtcttactttattatccaaagtattttaagcacaactttttgttttttatatttgtacaatttttttaataagacgagtggtcgaacatcagaagcaaaatatcaaaatcccttatattaggggatggagggagtataaatatataacaagcatcgctattttagatagtgtggtgtaaaagcatatgtataagtagtatacatagtttagaaaataaaccatataaaaatggtcatgtcacatttcagtcaatgtcgttattattatctaagacgagtgaagccaaaaggacatttactatattatttgctactactttatgcgtgcatgtttaagctccaatcgagtcctgattctttaatttacacaacttttattaactttatgtatacttgcactgccacagcttgatgtagttcattacgttccagtttccaaatattacacttgacgttggcctggtttagttataacttttttttttcaaacttccaacttttccatcacatcaaaacttttctacacacataaacttccaacttttttcttcaaacttttaattttagtcaaactttcaattttagcgtgtaactaaacacaaccgttgttaacaaattctacctcccaattaggccgagtttaggcctggtttagttcccaactttttcttcaaactttcaatttttccatcacatcaaaacttttctactcacataaacttttaatttttctgtcacatcgctccaatttcaaccaaacttttaattttagcgtgagctaaacacacccttgctgtttggtccatcctctgtatatattgtgaactgagctcgtacccagaccgattggccgtcggacagacagcaaagccagtgtctcggatagtctactatttaaatatttagctagctgccactgatcttgcccgaatgtcgtcgccacaagtagcacggaccgtagataatgcattttcgttttggggagtgtgtggtgtcatcactcatcagtatgggatggactgccgctttcacatgacatccctatacaagtacgtccaaaaatggttcccttcgaatctccacgatgaacatgcatgaaaattggtaacactagttaataattaattagatcataaaaaaactggagatatgcattataagaacgatatgacaacgttgccattataaaattaagaacatactacctcggttttcaaatatataactttaataacttataaatttgaatatacagttatctagctagaaatgcttatatttttaaatgaggagtgcttttttttaaacaaagacagatataataaataagagaacagatgacagcaatgctattaattataagaacaaggaatataaaacctgtcaaaaagaatttcgtacttttaaagaaaccctggagagttgaatgtatactgtacctggccaaaaagctaatcctgcctgcctgcctgcctgcacgtagacaaccatgcacacatatgcttcctgaaacaatactaatagaacaatatatatacggccggctctttgctggtgcagcatcatcaagattcacgcacgatgactacacttgaaaaccgatacgtgtgccgtgcggcacacgtgaatcttgatgacgctgcacccgcaacaagtcggctcagctcgcatccaccgcgcgcgccgccatgacgaattggcgacggcggcggcgcgcggcctgttggattcccgaccctacaacgaacgggctgtggcctgtgggggcagcagaatttatagggcccgcgcgtgcatgcaccggcccggcaacatgacggtgaagtggggacgcacgtgcgctccatgcagcgcctcctcgtgaccgtgaagtggaggcccatgtacgtcgtacgtacgtactctacgttgcggcgcgtacacacgttgcggcggcggcggcgctggtctgtctgcatggcggccgtttagcccgcgcgggccgtaccgcgctatctagtggcgctggcggccaaggcacacactcgcggacagcaggtttcatatctgcgttttgtcctaggtgcatcgtacatggtatagtcgcaaaagtggaacaaacccataattgaaaaatagagaagtaagaagaaggattccaattgctcgaaaactcatcttagcaaatgtagaaattcagtacaatcttacaattttttttaagataatggaatagaatatcccagcctttactcaaaacgagctacagccaattattacaaagttacactaaaaaaaagtgtagttcaacaaaacattgagaacacgcacttaaaataaaaaataacccatctaagataaggagaacacgttattgaagtctatttgtaaatctccaaccataattgacaaaaagttgcataactgtcgtctcaagcctacggcatgcaaccttcataaactcgccatcttcatcacacctttgtagctgagcccaacaccgaagccaatatgttgccctgaaaattacctgtatatatatgtggtacttacttaaagaggttgtgttaaccaaagacaatttagtaagacggaattggaatagtagtttaagatgttgttttttttatgtaaaatgagaatattcaacatggattgccattatgcaaactttatatggagagcaatacaatattctttttgatggttggtttttggggtggataagaaaaggagtaagcttgtacttgtgggagcctctgcaatatgttgggctctgtggttgagcagaaaggatttagtttttgacaagtacaatcttacatgatgggcaatatttaaaaaggagggggactgcaccggcactatttgccaaaagcaaccaagtcgctgttttgagttacgttgatcattagcggcgtcattaccgaacgaatatcatgctgtatgatgcttcgggatggtactctgctctgaacagagaggcgaaatgatcaattttttttcctctcagttactcctgatcgaattattccaccattgttacaggttacataagaaacgcgagcaaattacaccagctgaaaaacaaaatcttgcaacatttctgcgggagatattttgggacagcacggcacggtgcaatcattcccgggggggaagaatgatcaggttgggtttatccggtcgctcatggtcggttggaacgagatgacaggcgacacgaacggcggacggatggatgcgagagcgagagctggacgaactgaccgatcgactgacgtacgcatgcagcacagcaacgtcctcgtgtacagctcaggaaacggacggcaagatggacaagcgaaagctctagctagccgatgcgcctctgctcccggcaggggatggaagccgcaaaaagattggagattggaggaattcctcgcggactgtggactggagtcccccggcaggggaggatggcgtcctacgcctatcattacgtttatcatcagctctccttttttttttaagattactagccgccgagtggccatacgttacaatatgggaaacatgttcacactagctgtaactcattgctcataccatgcaattgatgtcagctctccttttttttttaagattactagccgccgagtggccatacgttacaatatgggaaacatgttcacactagctgtaactcattgctcataccatgcaattgatgtcaagttgtagacagccgggagaaaaagcgaaagcttgctcgaaatgatactctataccctaagagcaagtataataggaggctgtaagtcggctaaatactgaggtggaggaaatacgaggagagagaaaaagcgggctgtaaacttacagtcgacttgggcataagaaccaaaaaattctatgagagacaagtagactctgtattaattataaatagctaactattaatctattatatgtgtgggttaagaaaagtctgcaaagaactttatagccaacaaatcggctgtattattagccttactctaaccctagcttaagacacattcccaacttcacttcatcatttttaacgcgcatattttttaaagtgcaccttataaaaaagttcctatagaaaagtttatttaaaaagaacatattatccaatttttatagtatttttagctaattcttaattaattatgctctaataggtcattctgttttttgcgctgtatggatttgttttcaaccataggtaacgaatacaacttaaggatggttgcaaagtgatgaaaccgggataaaacgaaatggatggtctatttgattggtgcggtaaattgattttttttaaaaaaataacaaatagtttactaatgtggtctacgggagtcagttgaatgtttgttttttaaaaaaggtatgtttagaagcatgaatgaaataatctgccattcagccaggccgggcgatcgaactatattcaacagttccaattggggcctaaatcacaataataattaataatgattacaattacatttgagacacatgattgtttcatgaaacctcaaattacaaacgttatgtccgacaaatagatgggattacaatcaataaatgttcaatgagaaaaaaggtaaatcctcatatatagtctagaaaggcaggctaggtaaaagccttatgcacaaggtcgacatttacttttgagaaaattcgatccatagcacaggaaaaaagcggtaccaaaaaatagcacaagaatttttcgctttcgatcagaagcacaggcaccggttttttttcgccccatagcactttcgtcaggtttggagttaccagcgttagattgaagtgtagaaaaattttgttagacccatttgcccttcgtcttcctcgccataatctccgtcatctcgttctatcgggtcgtgcccacaacgacggcgccggagccgtcgccaaacagtgatgcggcgacgatccccgtccccaagccacgccaccgccgtccccgtccccagccgccgcgccaccttccccgtccccagccatgctgccgccatccccgtccccagccacgctgccgccatccccgtccccagccaccccgctgagctgaactacgctagcgccgcccaccatttgcaacggagaggaggaagacatagaggcgccgtcgccaaacaacgacgcggcgacgagggtgtcgaggtgtcgacgcagcgatgagggtgatgccggcgcaagatcgagctccagaactgcccaggcaactccaccatgctccagcttgacaacacgcagttcctcacctactgctggagatcacgacagagcagttcttcgtcggcatcaccgcttgccgcctcaactgcctctccggcagctcatgcgtcgcctccatggcgctctacggcggctcgagcctctgcttcctcaaggtgtccaacttcgtcagcgggtaccggtccgtggcgctgcccagcacgtcgttcatcaaggtctgcttcccggggatacccaacctgcccctcggcggcggcggctcgctgtagagcagggtgtctggcgtccgcaggtgggtgatgctcggcgtggtgtccgggctggtgctgtgcgagtgagcgttgtggtgtgtgttgtgccggcacagcccgaagtacggcgccgtgtaccacggcgtgatggcgaaccggacggtggtggcggtgaagcagctggaggggatcgagagggggagaagcagttcaggatggaggtggccaccatcagcagcacgcaccacctcaaccttgtccgcctcatcagcttctgctccgagggacgccaccgcctgctcacctacgagttcatgaagaacagctccctcgatgccttcctcttcaccgacgcgccgggctgcaagatgtcgtagccgacgcggtttgccgtcactgtcggcaccgcccgtggcatcacctacctccacgagaagtgtcgcgactgcatcgtccactgcaacatcaagccggagaacatcctcctcgacgagcaccacaatgccaaggtcttcgactcggcggcaacggcgagccacgcgtccacgttgttgaagagtgcgcgccgcagctcgctcggcggtggcagggagacgaggcggttgcccggcacgctgatggccaccgcaccgccatccacgaaggagcggaagatgagacgtggtgggaacgtggggaacaaagggcaaatgagtccgacgaaaattttctccactccgatctaacgccgttacttccaaatacgatgaaagtgctacggggcgaagaaaaattagtggcctatgctatggatcgaaagtggaattttttttgtgctattttttggtaccgctttctttcctgtgctatggatcgaattttctctttacttttagaaatcatccagctagagtcttgttagacaaaagattacatatactagatggtacaccggacactacgacaatacccattattccgggcggttggatagattatcccctgtggtcgcccggcccgcctgcagctcatcgtctgggaaaatctttattttcgcgtgcgggcgggccgaccgcacgggataatcgattatcccctgtgcaataaggccaaccgcatgggataatctattttcccgtgcggtcaaattaagtggcccgcacgggataatatgttaccccccacggctagcacgtgctagccatctgggataacctattatcccgtgcggtctgtataatttgacctcacgagacaatagatagaaaattagccgaaaattagccgaaacatcaaattaaatcatattacataaaaagtatagtgtttattacaagcatcccccacgacaaatacatccatttagtccatagcatgttgcctctcccactctcttagattcttgaatttggggtccgtagcaagttcgctatgaggatcatggaactctcctaaatgattgcagatgtcgcggcgaatgaaccggcacaagtccacgcacaagttgataagtgttttctgatcgaaccggcttgcactataagggatactcgggagctacgaaattaaaagacaaatgatttgtgttacagtcaggtttaatgaactatttgcaatatctaaggagagtttaatgacttacatctgtaaactcagttgtatctcccattgaccctgagcatctcgcacacgtaataaccgcataggttcgtaaaactaggttgcttataacactgcatacacaagtggacacgtcagaagtaagaagtgacaatcgtgatgtacgtactgaataaatgctgacataccggccagtgtccccttatgtacagtttctctctacttggattcttaacgtacccgccacgtttcttataacggccgtgtgctctacaaaaataaattaattaattatgataaatctactttaatgatctttacggaaagttggaatctttacggaaattgtttcgaacttacaagttcagcaagcataggaactccatgtacgcgtccttgtcatagtccgccggatcaagaactacaacggtttggtccgttggatagacgaggaatagtatgtagtgttcgctgtgaacacggattatgaaattacataagacattttcttgcgctgttattaatatgtgaacggaaatatgtcaaagttgcttacccaaagtggtaggggaccatgatgactcgtttgtcggagtgtgcgagaaatgaggtggccaagtaatttcccacctcagccatctttctcttacgcatacgctcgatgtaatcttttttctcctgaggtgtcttattctttagtaccgcactatcctccgatatccgcacagtgtgggccgtctcgcaaaccatcgttggatttacgtaaccgattaaggtccccgttctttgagcgtctacccattgtgacatgaggaaatttggaagttagaataactaacaattatattggcacacattggaataacgaagtacatggaatgcttataggcaccacgcaccgacgagattgatatccattttatccatcttaaagagtgcgtggaggtccttgaaactaaaggcgaagtttgcgttaggtccatccttgaaagcgccttccgggacatgcacagtaatcatcccgagacctaactcacttgccctcaagtaccactcatgcatcaacctcattggccatgggagttcacacatcaagttgaacggcaaaaacggcttgccatattcatactccttaggcacttcattggaggtccaagattgcattttgtcagcaagacctacaacgctcttctgtgcgtccgaatactgatcatgtccaactggctttagcggaccccctcgacccttgaaagattgcaaaaccatccgcgtctcacactctgccattttctccttgttgtatgtggataccataacgggtatgagcttgcgggcttcataggtttttggctgctcctttgatgtatctggctgtggaggtggcacatgttcgtcaaggggtggagcaagataggactgaggagcaggagacggctaccgaggtagggtagttggggagttaggtgctacttgttgtggaggtggagaaggacctctaagtggtgatatctgtgggagtggagatccgggtggggtagtgcagatcggaggggacggcggtgcaggaggtgcagacgtatttggcaccgatggagctggtgtcatcgacatgaactgtccagtgaggatgatgtcacgacgatgccagagtatgaactggttaaccgcatccctgagaagttcaatcccctctggtgttgggatgtcaagctccaacgacatctggtcgccatgaacaagtgcgacctgaacacttacgtagtccgccggaattaggctgttatggaactgtctccccggtatcgccaatccagacgcaacctccttcgtttttcccgctctccctatcggaacgacaaagctgcacggtgtcggaccagttatactatctactgggtaggttgtattttctaccgacccgactgagcttaggatctgtgtcgactgcaaaccatgaggaaccaggtcagggaaggcttgaggatgttgtgcggcaagactgtagaactgttgggtgacttgttgtgtgacttgatttgtgatttcctggcgcatcttggccttgtaggcatcgcgcttcttgtaactttgggcttcctgtggaaaccctaccttccaattcgtcatgcacgactgtcctctgacctaccggagtgttctgtagttctcaaagcttcggtcagctcatcatgctgccgtcgagggacaaactcaccggtcttctccttctggacgatctgttggagagacgtggtcacgttctggatgtctggacagtccaacagcatcccgaagttcttgcccacacccaatttctagttcgcttatctaggggctgcacaatcaaaggtttgccttcggccgcaaacttttcctccgtagttcgccatttcttctcgtgaccggcgcatccacttgaccctaacctgtgtggatatatgttcttcttcgccaggtccgacatcttcttcctcctttctagagcttgaagcgtcgtcatcttggccacgaacttgtcccactcactgctgaaatggtgccccattcttcaaatggagtcttattcttctgaacataattggtgttcatgtccgacttccattgtcgccaccgatgggcaattgtttgcagtgcaaatttccggccaagtgcctccgactcaggcggataaatacggtgctcctgcagaccttcccacattaagttcttgatgtgaatgctaacatgcttccattcgtccacgttgagaggcccatgaagccttgccagcgcgccgcatgcggtgctaaacttcacccttacatgttgcggctcgacgggtttgccgtcaacatcgagagcagcaatgtagtacgtctccttcggcatgaggttcctgcccttctcgccacgctttttctttggacaagctcccccactcatcgtcgtgtccgttcgcggtggtcccgaggtcgttgtgtctgaatcaggttcaaccctgacggcacttagttttgaccgacgacgggttgccatctgcacggttaagtcattagaccgctacatcggggaaagtttaattccaaatatatatttcgacaggattcagttattaccgcctgctcgataggaatataatccgggtcatcctcaggtctttcatactgcaattgcgctagttctagctcaaacgagtcgctcggtgtgcatcacgattccttgctcgacgtcggtaccttcccggcatcttcttcgtgttggggattgttagtgacatcggttctgtgcccgacggagctgtcctacccattaggtttattgaccgtcggttctgtgcccgccggagctgtcttgcccgacatcttcgattcgcgttcttacaatttaatattcgttcaaatccactaaactatcataaccactaaactaaactatcatattaacagcaaaataaaaacatgttttgatcacatggctagctcgtgtgttcaaatataaacctctaactcctagctgcgtcgtcctcgtggacggacctaaagcatcgacttccttaaggcagttcgttccgaccttaacaaggttccacttcctgctttcgtccaagacactcttggaacaatgcaggcgacggaaccttgtatgggtcggaaagaacggccttaaggaacgtcgagctcctggtccatccacgaggccgacgcatgtacgagtcagaggtctatctttcaacatacgtgctagcacattttatggatgaccaacgcatgtcatatgttgacgaaatgttctgtttttccaatttgtactagtcggttgcgtccagcaactaaaccgactagtagaacttggcaaccagaacacttcgtattatagcagcatgataacgtacgaactacacacctcctatatctaattttaggagattggtaaggaaagcaagatcggtaaggaacgtaagatgggtaacgatttcaagattggtaaggatattcatcactatgcacactatgaaagcatatggcctcagttttgctcagcaattattcatcatgaaccccaagtgtagatggtctgttcttatgtgcaaaaaaaacaagtgaagtgcccccccaaaaaaaacaagtgaagtgccccctcaaaaaattcacaagtttagttgttctgttctcaagcaaaaaaaaaaaaaactgaagtgcccccaaaatatttcacaagtgtagttgtgctgttatcaagcattattaaacaagcgaagggcgcccccccccccaaaaaaaaaaaatcacaggtgtagtgttctgttctcaagcaaaaaaaacaactgaagtgccccccaaaatatttcacaagtgtagttgttatgttcttgagcataaataaacaagtgaagtgccccaaaaaaaacttcacaagtgtagttgttctgttcttgaggataaataaacaagtgaagtgccccccaaaaaaattcacaatatgatctgttcttaagcattcatcattggccatttatcaccaacaaaaaacagcccacatatatcagccacaagtataaaacagcccacatatcacccacatataaatcagcccacatatatcacccacaacaatcacccacatgtatcaaccacaatgaggcataaaacagcccaaaatatacagtacaaacaagtgtaaacagcatatatgtacatcacatatatataaacatatagaagcaaaatatatttcatcatgtatatgcacaacatcagcaggggcataacagcatcatttgcaaaattagcaaaatatttcagcaggggcatatatttcatcatgtgtagaaaaaaaaacagcccacagtgacataaaacatccatctatcccatgtagacatacatctatttatcacaaagagcacaagtcctatatatctatcacaaatcatcatcatctcaaatatcatctatccatcacaaacagccatctatctatcacaaatgtcatcatcatctcaaatctatctatcacaaacaaccatctatctatcacaaatatcatcatcatctcacatatcagctatctatcacaaacaaccatctatctatcacaaatatcatcatcatctcaacatcacaaatcaacatatcattcatccattcaaccaaatatcattcattcattcaaaaatttcattcaacattgcatctactgcatgcatcatccactgcatcattcatccattccactgcatcattccatccattaccattgcatcatccaaaaaaggaggggcggcgaagagaggggtacctggatcgaggaggcttggggaggaagtaggaggcagccggcggctttgcggggaggtggccggccgcggcttggcggcgacgtggccggcggctgcttggggaggacgacggcgccggcttggggaggatgacggcggcgtccttggtcggggaggccggcggcttggcggtgctcttgacgccgagggggggaggtcggcgaggcccgcggcttgacgttgctcctaacgccggcgttggtcttgaagcctgga

SEQ ID NO: 31030 - DNA, 1745 bp, Oryza sativa
gttttggccgtcggtgaagaaggtcagcggcgtcggtggaggaagaagaaaagtaggcgccggcgtggggggaggagaagaggaggagaggagcctattagttaataactccaatttttttattaaaaaaatcataatttcgatgggaatgtatatatttgctatagcacaatgcaatatagttaattatttgttatattcccatctaagttatagttaattaataattataattattaatatcacggtaaacaataaattaatattggtttgggttaattaaaccacgaattattcaaaacacaaatatagattaacaaagaattaaaacagacatgaattttattcgcatctaattattcatcgatatgattaatataaataaaatattggaccataaaataaattcaaaacgacatatagtacggataaacatggataccctatctcattcgcaatataagtttcatccagtaatcgtttacaaaataggtagtacacaggatcgacatctcactaatgtttgacaattttggaaacaccatccttccgcgcggacaaaaacaaatcttcgtcaaggcttgtctcaacttccttgatccggtgatccggttaggaaaatctgtaaacaaaaggacgtcgtcgtattggttgtaatctgacacgtcttcaatgctatcaatgctaacaatgttttgctttcctggtacagcaatggccatcttatcatcggaagggtcattgacatagaaaacctgagcaacccgctcagcaagaacccacggatcatccttgtgtcctagcttgctacgatccacaaccgtcaggccgtagtcatcgatgaatacgcatgttgtgtctctgacccattggcatcgtagcaccgggatctgtatgttaaggccatagtccagctcccaaatgtcttgtatgatcctgtagtaagacttcttctcacctgatgcgtcaaacgcctccacccgaactccgctgttctgagctgcgcttttcctgtccttgaacatcgtgtaaaatctatatccgccgatgtcgtacccttgccatgaggtcacaaggctagttgggccatttgctagcctgcgcaaagttttttcctccagcgaatcacccaacggcagatctttctcctacaaccattcaggaaatttccatttctgttctttacaaatccaaatgtccgttcttctagggttgcaggctcttatctcgttcatgtgttcctgaatgtacggctctaagatggcgagctgttgcaaaacactgctatgtgcttccactacatctttgaagtcctcatcgtagaaccttttcttgcctacgatccccgtcccagctaaccggccctcgtgtaaagggggggtcacaccgatgggtttggcgtccttcatgtaatctatgcagcattcgaccacctcctcagttgtgtacccctctatcattgatccttccggatgagctcggttacggacataccctttcagcacggacatgtacctctcatacgcccacatctggtgtaggtatagtggaccaatctcgataatctgaggtacgatgtggacaataagatgttccatcatgttgaagtaagctggggggaaaaacatctcaagctggcatgctgtctcgattgcaaaagttttgaagggggcctaactcttcaggatcaaaaaccttctgtgatactcgattgaaaaggtagcacaactttgttatcactaacc

SEQ ID NO: 31031 - DNA, 861 bp, Oryza sativa
gttctctactgtattgtcgaataatctggccttcgcacgccacctatgcctctgaggtaagaaccgacgatgacgcatgtaaacacccttggttgacgaggtgaggtacttgtacgacgtcttgtcgatacatatgaggtatccgaacttccccttaaactggcccgagagcgaaaagtttgcctgtaagtcgttgatcgtaacgaatatgatggcatgcagagtgaaatgttccctacggtactcgtcccacattcgtaacccttcctcccatagttcttgcatgtcctccatcaatggttccagaaacacatctatgttaatcccaggctgtcttggaccttatataaggacagacaaaagaatgtactttcacttctggcaaatccatgtaggcaagttgtacatcgttagaagaactggccaggtgctgtgtgtgctgcttaggtcaccaaacaggttctttccatccgtgctcaatgcaaacctgacatttctcgggtcctttgcaaattccgggtgtagtgcatcaaagtttttccactgtcgagcatcggcggggtgtcggatcttaccgtcaattttcctaccctcttggtgccatctcatcaactcggcgtcgtctcggttggaatatagccgcttcaggcgatctttaactggcaggtaccacatcaccatcctagaaatctttttgttctcatccaccagtgcatcatctttgtcgaccacctctccatcggaggctccgttgcccgtcttgtatttactcgtcccacatgttgggcaagagtctaaatccgcgaattccttgcggtacagtatgcaatgattttcacatgcatggatcttctgaacacc

SEQ ID NO: 31032 - DNA, 531 bp, Oryza sativa
gctcggtccccctaaagatcaaagcaagattcatcaactgaacggagaaagatcgtcggcgaggagagctggtgaagggagaggatacggacgggcattaatccgtcgaactgcgtggcctggaccatcttgccgagccggagctggtccttcccgatgggggacctgcacgacttgcacgaggaccgcccggacttggcgtactccgccttccaggccttgggcggcgccgccattccgccggccggtgcggctggtgcccttttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttctggggatcctctagagtcgactgcaggcat

SEQ ID NO: 31033 - DNA, 328 bp, Oryza sativa
agcggcggcagcagcagcggcgtggcacagcagcagtggcggccgcggcggcagcagctgcaacaaagggcggcacggcgacgagtggtggcagtagcagtagcaacatcgacgcggcggcgcggcgacaagcggtggtagcagcaacagcggaaccagttggccatggcgctctcggcgttcggcagcgtcgccgaggggctcgtggcagtgccggtcactgtgttcggcactggcatcgacgaagccgtgctcgccaaatcattcaagaccgatgtgcccacaatccagaagctcaaggtgaacctgagtacctgactccacccaa

SEQ ID NO: 31034 - DNA, 600 bp, Oryza sativa
cggagtttccagtgagccgagattgcaccactgcactcaagcctgggtgacagagcgagactccgtctccaaaaaaaaaaaaaaaaaaaaaattaactgggtgtggtggcaggcacctgtagtcccagctactcaggaggctgaggcacgagaattccttgaacccaggagccagaggttgcagtgagctgagattgcaccactgcactccagcctggcaacagagcgagacttcatctcaaaaccaaagaaagaaaaagaaatgaatcattaaattcatctgaaattttggataacacagcgagactccatctcaaaaacaaaacaaaaaaaacataaagcaccgggcacagtggctaacacctgtaatcccagcactttgggaggccaaggcaggcagatcacctgaaggctggttcaagaccagcctggccaaaatggtgaaatcccatctctattaaaagtacaaaaattagccagggatgatggtgtgtgcctgtaatcccagctactcgggaggctggggcaggagaattgcttgaacccgggaggcggaggttgcagtgagctgagatcatgccattgtactccggcctgggt

SEQ ID NO: 31035 - DNA, 490 bp, Oryza sativa
  unsure (1)..(490): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatggagggagagagaagaaaagaaagaaggaagaaagaagaaagaaggaagaagaagaagaagaagaagaaaggaaaggagctatggcttgtagttgcggctgcacccgtgccgttcgcaatgcatgcgtcaagtccgtcgttcaacgcggcaaattcatgttggcagctacgcccattatgcgtcgacatcactgccccttccactagttttggtaaatatacgtatgcaggccatttacggataaaaatnnnnnnnnnnnnnnnnnnnnnnnnnnnnnnnn

SEQ ID NO: 31036 - DNA, 497 bp, Oryza sativa
  unsure (1)..(497): unsure at all n locations
nnnnnnnnnnnnnnnnnnnnnnnnnnnnnnnnnnnnnnnnnntatcctctgctcagttgtgtttactggttatatatgtgcacaggatcttcgaaggaaacttcccgttactcgtactcttttcccatggcacaacacattagccctcagccttacaagagacctcaccaaagaactggctataggaaaatgaagcttgtggaggtcagttcattagattagctttgatatggatttttttttatctccatgctatgtgttgttctgtagatcctgcaattcatatcctgtagccagcaattctcttgttttgatttctgggcttccacatatcagtgtaaatcaagaacatgcacttcttgtgaggaagttacatttcaagaatatatgatatctgaatgttgactgtgtcaactcatgttaactcttgctgccgtcatgaaacaaaccgggcaagcctaaatnnnnnnnnnnnnnnnnnnnnnnnnnnnnnnnnn

SEQ ID NO: 31037 - DNA, 953 bp, Oryza sativa
aagtgatttgtcatgtcctcactcccaagtcctttaatcttgttgacaagaatcatcatcctatcatacatctattgtgttgtctccttgtcatccatcacaaatcttccaagccttccttccaataattcaatcttggcctcacgaacggcgggtgatccctcatgagccaattgcaaagtatcccatatctccttggcctcctctagttcatcaaccttgttgaactcctccggactcaaggcggagagaattgcattggaagcttgagtattgcgatggatgagttgttcttgctccgaagtgagcttcatgtcatcatggggtatatcaataccggtacaaacaactttccaaatacttggatgcaaagagattagatgcaacttcatcttgtgcttccaagcggcataatatgtcccatcaaattgaggagcacgcccggaaggcacggagacaaagttgtgagagggaatagtaagtttgatgtaatcaaaaggtatagtagctcccttgggtggtggagttcccttgctgcttgcttcatcttcttttccattttcctcgttctttccccctaagtccgacatcgtggatcactcaaagcggtgaagcttgaatcaagagcacctcgctcttataccaattgaacgtgcagagatgtagcctagaggggggggatgaataggctttcctgaaattttctcaacaaaagcaacggttaaattgacagggcccggaacctcctggtgatgaacaccggaacttcctagcagtgatgagcagcccggaacttccggagttcttcagacaggaacttccgggcaacagagaaaaacgaaatatgagaagtataacaggtcctagctagtgaaaatcaggcacagggttgcacaagatgaaaatcacaagataccagtagattcaaacacagatcaggcacacgagagaca

SEQ ID NO: 31038 - DNA, 6992 bp, Oryza sativa
ctcagcacaagaacttttactcacttacctcgtgtgcttgtggaggtgagaaaaccttcacaaactttcccgggacatccacaagatctttggaagctcacgggcgacgcctaaccatctagaagaagatctccaagagtaataagcccaagtgacagcccacaaggtatccaaagttctcaatcaaacctaatcttcaagccatctccaaaacactcctacactctcatctaatctctcaatctcacaagatagtctctagatttgagtggaggaagcaaaggaagcttgggagtggctagaaaaccctagaacatgaatgaacagaagtggaatggccaaaaggtgacctggggacgaaattcatatatataacggctaggtgacgtcatctagccgttactcacaagtttgaactggaaacctgccaggaggttccgagcaaaagtgccaggaacttccgggcaacacttaggaaattttttgcaaataaacggtgcccggaagttccggccagaacctccgggtagccctttctgtcccggggagaaaatcatttttcaaaaatgattccaaaaatcttttgacttatggatatgactaagagcactttgtataccctagaaccacacttgaaacccctcttaatagtacggtttttcctaaactcaatttcgaaagagaaaaacctagtctaatcaccttcggtgtttttcgcacttaggaagattcaaattgggggggggggtctccttgcattcttagtcatcaaaacttgctttaggactgaactcctatgaataaacttgataaacacgttagtcccctttaaccaccttgttattgatcaccaaaacccaccagggggtttaagtgcatcttcaatctccccctttttggtgattgatgacaacatggttaaagcaaacaaaaagataatagaatttatattttgggtgatgagagaagtgtgaagctccccctaaagataggcatataaagaactagaaatgaaaacaatatgcataggatgaaggaaagctcaaaagaaacctcacactacccttatcaaagaagagatgcagatgaaagtgcttgaatgatgagtgatgcaaaaagaaagactagatgacatggcaatcactcaaaaagatgaaaagaacacatcatcacatcaaaatgcaacatccatatggtctaacttactgacataaaggataataaagcatctaacagtcattacatccaaccataatagaatacgattacatgtccatatagagagagataatagagaggaaatctgcctggccggaacctccggatcataggacccggaacttccggccaaatgaccagacaacagtcaaggcagcaaaaaggatttaaatgacccccttcaattcacaatttctccccctttggcatcaaggtaccaaaaaggcgagaaactatgaagagaagaagaggatcactcatctccatcagagggaacaatctcgatatcgccggagagatgagactcatcggactgagcagcggtgtcaccctcattaacatcagtgggggcatcctcagcagctgcctcagtgtcaccctgatcaccatcatcatcatcatcatcatcatcatcatcatcatcatcatcagaatgggaagattcttcattgaagaaggtggatggaccttcaccgacaacgttgcgggctgcctcataagcctcaaatggatcaacatagacctcatcctcagaatcatctgacacttctttcccagcctctcttctatcttccttctaacgcctttcgatcttcttcactttcttggcagtcttagcacacatatagaaaattgcctgaagtgccttcttgatgggagaagaactcgaggaacttggtggggcactagtagaaggaccagctgaagtagaaggaatagatcgagggaccactggagaagaggaaggtggagcacgagggcgaaaaggattatggtgcccatctttgatgtagaataccccggtgattgtctcaatcatcttcataatgaaaggagcatagatgcaaccccgcttaggctcaagaatggtgttggcgatctcataccaaatcaatttcatcacactgaagggaggttgattgtagcgcatgcgactaagaagatgagcatgcttggatggcaaagcagtagcatctccaacctttggaagcaaagaccaacaaaagatggagtacaacaccttatagttgggatgcaatccatgagtagatcccatgcaagtcctaggagcatcctttgcatacatgaacttggtcttgatcatggggaggggtgcttcactatgaatgttgggcctattgagatcctcatcatctaaccccaacatctcagcaaactgtgccatggaaatcttgtgcctaacaccctcagtcaaccacttcacataaggggttcccttccttgtagtaccaaagaatgctgtcgcatagaactgtgcaatgacctcctcattccaatcatactccaaggcaagaatatctccaagattcttgttgtggcacacttgcatcacttggttgaacacttcattgttcttcttcctcatgtaagcccaatcaatccacttcatctcaaccactggattttctctagccataatcattgaattataccaatccaattgagtgaaagtcctgaaacgaggatcatgtgactcctcaggccgagtctctggatcaatcaaacggtcccttctgcacttggcaagctgatgaaggtagttggacttgggtcttccaatgtggtgcataggagtggtgtcaaatccaagagtcttgtagagccgaacaggattctcacgagatccaacagggaaatcatgagatgcccttccagccccagaactgcgaccaccacctctcccacgacctcttgtattaggagcatcacatccttgaccactgtcaacatcccgaatctgaactagacggttgctggattgcctggtaaacctagaagaagtacgagtgccgctgccactgccgccctcaaccactttctctttacccaaacaaccatgaggaaaccgaataggaggactctcatcaccggacacatcctgagaggctttctgtcttttctcacgaggcatagtgcttactgcaacaggaatcaacaaattggagtgcagtagttaggcaaaatttgagagaatcaagaatggcaggctggctggatagcgcccgaaggttccgggtgcaagaacactggaacttccggccggcaaaaaagaggaacagaggtttcaaaaatagctagtgcatgtgaacaaatcctatagatcggtgatctacaaggtagcagaaacaagactatccaagtggttttcttcctaggttcacagatttagagatcggggcaaaaacatgatgaaccaaaagagaagatcaaaagtgctaccttgagagaggaaactgcgaatcgatcacagaaagaacctcccagccaccaatgtagatgaatccacagagaataatcgaatttgattggaggaaagagaaaatcaccactcggggcactgtagtggcggctagggctggcgtcggggagggagaagaatgaggagagagactagggtttctaactccccctgagaatatatactcctcgacacccgaaggttccggacagggaggcccggaacttccggcctgacagataaagagcagtcaggcccaaaaccatggtagaaacaaggaatcaaaaggaggaatagaggactatggacatgcaaagacttgtgatgtatataaccagccaacaagcaatcagtacaaaactatggtcgatatacatcacaaggagaagataaaaaacaaattttcgcaataaaaggcactcaaaggaatttcgcaaagattttcaaaaaggtttttggataaaaaaagggaatgtttgagctgtattcctggtatcaagaccatcttctacacaagaagtgatctcaagacacaaaagctcattttttttagtgacatatgtttggctataaattagccaaccacccatcacctaatgttgcgagaatctaagatattgagcttactcctaagctcgcaaaatctttgctcatctaaaggcttggtgaaaatgtcggctaattggctctcagttctcacatgggtaaggcatatgtctcctttggtttcatgatctctcaagaagtggtggcgaatatctatgtgcttggttcttgagtgttgaacgggattgttggctattttgatggcactctcattatcacataggagtgggatcttggtgaagttgtagccaaaatcttttagggtttgtttcatccaaaggagttgggcacaacaagaaccggcggcgacatattcggcttcggcggtggataagacaatggaattttgcttcttggaggaccaagaaacaagggaccgtccaaggaattgacaagtcccggttgtgctttttctatcaaccttacacccggcataatccgaatcggaatagcccaaaagctcaaagtcacaacccttaggataccacaagccaagattaggagtatgaactaaatatcttagaattctcttgacggcaatcaaatgacactctttaggctccgcttgaaagcgagcacacatgcaaacactaagcatgatatcatgacgagatgcacataagtaaagcaaggatcctagcatggagcgatataccttttggtccacacatttaccattgtcgttgatgtttaggtggccattagtaggcataggagtcttgatgggtttggcatcttctatcccaaacttcttgagaatgtccttcacgtacttggtttgagagatgaaagtgccctcttgtgcttgcttcacttgtagcccgaggaagaaggtcaactcgcccatcatatacatctcgaaccttttagtcatgatactactaaattcttcaaaaaagaggcattagtagaaccaaatattatgtcatcgacataaatttggcatatgaataaatcactcttaaattttttagtgaagagagtagtatacgcctttccaatttcaaaaccatttttcaaaagaaaatctcagagacattcataccaagctctaggggcttgtttgagcccgtagagcgccttgtggagcttgtacacatggtttggcaactttggatcctcgaaccctggtggttgctccacatagaccaactccgagataggtccattgagaaaggcactcgtgacatccatttggaataacctgaaatcatggtgagcggcataggctaaaaggattcggattgactcaaggcgagcaatgggtgcgaaggtttcaccaaaattgagaccctcgactttgatgaacccttgcgcaactagccgggctttgttccttacaaccactccatgttcatcttgcttgttgcggaagatccacttggtgccgatgacattttggtcgggtctctccaccaacgtccatacttggttgcgagtgaagttattcaactcctcttgcatagccatcacccaatccggatcaccaagtgcatcttcaaccctggttggttccaaagaagagacaaacgaatagtgttgacaaaagttagcgacacgagaacgagtagttaccccctttcttatgtcaccaagtatgttgtcgacgggatgatctctttggacagtgtgatgtattcttggatggtgcaccgaggggacctgagcctgatcaggatgctctatagtgccctcggcatcaatcccatccacttgtgccgtaggcacgccttgactgtcctctgcccggaacttcctggcaaatggacccgaaacttcctggcctggggaggtccggaggttccgatcatctggtcccggaacttccgggtcaactgactcttgactcgatgtagggctattggatgtcaatgacgaaggttgatccctatcttcttggtcatcctacgtctcgactggtcgtatgtctccaatggccttagtacctatagcttgacttggatccacatcacctacaacatgtacaacaacttgctctccttgggagccattagattcttcaaatgtcacctcccttgtaacttcaacaatactagaggttttgttgaagacacggtaggcatgtgcatttgactcatagccaagtaagaatcctcgtccaccttaggtgagaacttagatgaacaaggcctcttactcaaaataaagcatctactcccaaagacacgaaaataggaaacatttggtttcttaccactcaagagctcatatgaagttttctttagaattttgtggaggtataggcgattgatggcatggcatgcggtgctcacggcctccgcccaaaagatatccgaagtcttgtactcatcaagcattgctcttgtggcttcaataagagttcggttcttcctctcaacaatgccattttgaggaggatcatagggggcgaagaactcgtgcttgattcccacttcatcaaggaatacctccacttgtgtgttcttgaattctcctccattgtcacttcgtaccctcttgatggtgagatcatagaggttttgggcttgcttggcgaagcgcttgaagacatcttgagcctcactcttgtcatagagaaaatacacccaagtgaagcgggaaaaatcatcaacaatgacaaaaccatacttgttacctccaatacttatgtaagccacgggcccaaataaatccatatgtagaagctcaagagggcgtgttgtagtcatgatgttcttgataggatgtggattcccaacttgttttccggcttggcaagcactacacacacgatctttctcaaatgtgacattagtgagcccgaggatgtgttccccctttccaagagttgcccaattccgcattccaacttgggctaatctacgatgccatagccaacccatggaggatttagcaatcaaacaag

SEQ ID NO: 31039 - DNA, 977 bp, Oryza sativa
ctctttcttaagagcttgcatagcatcaatattagtagcataagagttcaaatcaatattgtaacacctagcacaaccattgctagtagaagggttagaagaattagaaaccacatttggttgagaggtgctattccaaagagtgtcaaattgaacttcaagatctttatgacttttgtctaaattagcaaatttttcttgaagagtttcattgacattcctaaggctagctaaagaaccattagccaaattaagctcattagcaagttgttcatttttagcacattctttagctaagctctcctctaaggcaaggtttcttttcttctcaagaataagcaattctttttgcctttcgagtgattgttctttactatccaaagctctcattaacttagccaaatgttgcatatcgggtttgctaaagctcttaagcacatcatctaattcattatcactttcctcatcactagaatcaacatcaagagaagtttgagagggcttctgagtcatcaccttgcggccttgggccataaagcaagagtagtggtaggagtcgtcgtcgtcatcactcaagttgttgaagagatgctccttgcttgaagaggatgacttgaaggcgacggtagcaacaccaccttctccttcaaccttgtcttttgacttgggcttgggcttgacctcgggatcttcttcatctccggagtaccacacttccgccatgtgtgcctccaccacatgagcacgctccggcttcttcttgcctcccttagcgttagcttcatttgacttgggacaatcggcaatgaagtggccatattcgccacaattgaagcacgctctctttgatgcttatttcccttgtcatcatccttcctccctttgccatagccactcttgtgaaaaaagtgcttgaatctcttgacaataaaagccatttcttcatcttcactttcttcacaacttgactcttcttc

SEQ ID NO: 31040 - DNA, 27631 bp, Oryza sativa
  unsure (1)..(27631): unsure at all n locations
nnnnnnnnnnnnnnnnnnnnnnnnnnnnnnnnnnnnnnnnnnggcacttggcatcaactcttcccttcctaaacccgaatccccgttgtgaaacagtgcggcagtgtccgtggccggccaggcaacggggacgacccgagcaagtgtaggccacccaacccagttgcaacgtgtaggaggaggctaggcattgcacaagaggccatggtagagaggaggacaatgccggctgctgtagctcagcgtagggaggaggtgcggctgctcgacgtgtcgaggaggcgacggggaggaggacaacaggtcaggtcaacgatggcggtggtggctcgatgatcggagacgcaaccatcggcggcttagcgcgggaaggtgatggtgtcggctctacgtgggaagaaggtgccccaggctcggtggaaaagaaggcaacaaaggtgcggccggtttatgagagaaggcgacgacgacgacagcttggcataggtaggcaatagatttgcttgacttgtttgttttttcaagatgtcaattttgaagcaaatttttgttgatatttatgttaaaattatcatattgggtaaaagtttatcgaatttgcaaggttcatgtgctaaatgtgggcaaattctcaatcatgaacaaaaacaggggaagtttgcaacatgagtaagggtattgaatgccttctcgctaaagatttaacatcgttaatctgtccatcaaaagtagggactaaatttatctttatttcaaaaaactatgggcaaaaaaataaccctaaaatactgggcaacatcaatattaaacattaaagtaggggtaagaatgaaattgccccaaagagaaaaggttatatgatttccatagaggaaaacacaggaaagaaataatataaatcacatgaatacggatacaaaataaggaaacacaataactgtaaaaggatggatgtttgcaacgtaggaattttagtgggtgatttgattacatcttgttaatcctcttttagtctctaaccaaaatatgtatcattacttctttaatcctcaatatccggtggtaggaggaagcaatagctgcctgagctttgccagccgtacggcagcaacgcgagaaatcacatagcttgcacgcgcgcaattagcaggatcgagccatcccgtgaaaccggtgttgccacgtggcacaattcttctttcaattgtttgcatggaatttgtattataagatataacaagtttattattgtatcccttgataagctcgcgagagcgggacaaaaagggcatggacttcctatgctcattaatttgggcatcctcttcagtacaacactagaaaataggcgcgtcctttgacgcgctagctaattttagcccacgtatattatggcctttgtttggcactacttcagatttaagattatctttcgatgaattattttgttcccatcctagataaaatatataattttaaatcactattatttatcatacaaacttcaaatttaacttttgtctgagatatggcgttgtgcaaacataatctataaactcttacgttttaagtgctccaaattgagccgaaactactaatgttgtccaattagaatccaaatatagtgtttttgtgtggcacaatgccaattcttttctgaatcacctatacctatttttagcctcgctaaaagctgataaatccattttttccttaggcaaatatttttggtaccttgtatatttttattcagcttattatgaaaaccaagcaattggacacttattccatgtgttatctcatgtttttatgttaccaaaacaagtacccttaatattacaaattaaaaatgagtgtaaccgagggcagcacatagtatgtacggtgagtgcacatatatacgtttggcatgatgtgacatttacttgcatttgttatttgatattttgaaaaataaattatcaattgattgactcatcaataattttggtttttaaaaaggaaatatgtgtgcacaagcctagggtgcataataactaatatatacacaccaataagtttggtatgtgaataaaatcttgtgatcatctaaattaaatatttttatatataccacaagcatagacacaaaagcattcacctatttggactggactacatgtgcatgtgtggttattgggcatccaggtgcccagttagactcgataggcctgcgacagcctgccaaccatctttgcagttgcagccttcgacatctgtggttgaactgatgggccgctcggtgctccgtgcgattcctcgcgctgcttccccacgaatcgcgactaagcattaattttagctggacacgtgtcgacgtataaatgtgtttccaatcggaccaatcaaatggcagcaagcactgccagctttagaataatagattacgagagtgaaagaaaaagaaagagaagactggctagatatatatgagaatggtcgaacaaatctatcttccatttttatcattacttttttctcgagaatataatctgaacagatctattggatattggagatgggattgtcgaaaaagaaatataatgttaaggtgaaaattcgtatcagaaataaagtattataatatcacatacttaattataatacatgattatattacttcatatcatttatagtttatttagcacatatatatataaccgaataatgtcataatattatattatcacataatatgatactagataattataagttccattaatataaccaaagatgcaagctagcaagatagactcgtacgctcatctgtaaccagcccacagtgttcaattctcactcatctacttcttttcacaaatatttggtacgattatgtagagcttgggctggagatgtctttcggaattttcgccggaattatttctgttaaaaactgaaactgtggctgtttgtttgttttcgtcaaaattttcgctaaagaaaagctagaacccaaaaaaatagaagttcatgcaccagccgggaatcgaacccgggtctgtaccgtggcagggtactattctaccactagaccactggtgccttgctgtccaaaaaggagaattaggttttaaacctaaaagacaaaacatgtgttattagatgtgggattaatttgattttgctgcacatttgtgaatgaaggtttaatatctttcatgtgatggttcccagcttctcaaaatacgtcgttaaattataactaaatctgttatctagtactatcaagactcgtgatagacgtatccccaattcaattgaacttaattgcatatatccaaatatcataaatgaaaattggacttattttgttacctcaatggctcaatttgaaggcttatctcaggatccaattcacggaatcgattttcatgcattttgccaaaatatcttttatttacagccgctctagtaatatccttaattatgacaatcttgggcataatcccccaacacaacattgcatcgaaaaaattaaatgtatgagtgagcgtatctcaactgattaaatttcttatggtagaatctgtctactcggatttaattaaattgtagactcgacacccttcagtaaactagatgaaaccctgcgtgttgctgtgagagttctatataataatagtataaataatacttccttcatcccagaatataagtatttttagagttgaacatggttattaagaaagtagatagaagtgaatagtggagtgttgtgattggttgagtagtggaggtaggtgggaaaagtgaatggtggagagctgtgattggttgggaagagaatgttggtggagaagttgttatattttaggacaaattttgaggggtaaatgttgttatattttaggacggaaggagtatataagataactggatgacataacttcatcaactttatataattttcatctttgattgaccattgaaaaaaaatataaataattaagatgacatagtttatgataatttaaatcattcaaaagcagaaataatgtgatatggctcaataactaaggaaaacgaaggaagataatatagattgatcatccaaaagcaaaattaaagtgatatgacttcataggagaagaaacgaatgaagataatttgaatcatagatcaatcatccaacggctaaaaacaattgaagtaatgtgacttaatgagataaaagagaaatatcattaactacacttagtgtgaatgagctttatagatatgtaggtcatccaacaaaattcataagagaaaaaatgaagataatagatcaatcatccaatggttaaaaacaaatgaattgatgtggttgtatgagagaatggagaaatagtattgactacacttagtgaggataaactttatagatatataggatgtgtgcgtgtatttgagtgtatgcgtttatatgtgtttttagagaaagctccaaagttaattattgtgtctgtgtacaccctgattgttgcataagccagaacaagattggccagatgcctcaaaggatcgatccaagctctcctttttctgtggaaaagcatcaaccttttttcagggcaccagttaagctagtactacctctatttcacaatgtaaaactttttagcattacccatattcatttagatgttaatgaatctatatatatatatatgtgtgtgtgtgtttagattcattaatatctatatgtatgtggacaatgttagaaagtcttacattttgaaacggagggagtatataagaagccaagccatgcatgcacaatgattgatcatgggcaagagggacagccataatgcgctgctatatagccaccggctttactaatattaatatcctctcgagtcgtcgtcagagccgtcgttgccaccggatgcatgcaggggctgtttggtttggtgccacacattgccacaccacatgttaggcatgctacagattgttagcttagcgtttggttgcttgtttcagttgtggcaagccacactttcttatttcatgggtctacatgtcatatactcattttctagccaaacattgccacacttgtggccaacaaattgttggccacactttgtttgccatgccacacctatggcaaactgagttatggcaatgttaggcaacaaccaaacagacccgcagtacgcgatctcgatctctctttcttttttttccaaaagagcggttctattttcgcgctccatggatcgtcgcttaattgtcaaaagccagccgttgatgagtggagtagtagtgagatacatgcagctgtggttcctacctatcatggattcgatgtcaagatggatgctacaatatgcaagtcatcatcctgatcaaacaggggacaatggtttttgttggttggtttgtgtgtgcacagtatccagaggtcagaaatatataatcacattttatccttattggaaaaaagtctatgtttggtaattgaatttgctcaaaatatatttttcacttccaacacagaaccaatttttttttcatccttagcttttttaaaaaaataataacatccataatatattttatggtgttttaaacttttaatcggtatgaaagtggtttatccctaccatgaacttcaattaggtaatttcataggggatcagccatacaacattcgataatttacttgaagatcagccaaacaacattaaaccaaatataagtatatagcatatttgaaatgtaattaaattataactacacaataattactataattgcaatctagtttatacataacttgtcaaaatttacccccggaagttgtggctaccttcacaagctttgaagccacatgttgtgggtttgactccctcccaaggatgacttgcagtttttttccttgtatgccgcccaaatctcaagacaatccggtggtcacaaattcaaaagtttgggggagaaaaaccatcgaatattttttagctactacttccatttcatagttgtggccctaaaagcaacatatacatcaacaaaatgtgcacagaaagaatatgaacttaaaaaactcgctttgttttcaaacaaaaaccgctaaaaataatacagtatgttgtaaagtgttaatttttcgatttttgaaagttttgggatgaaaaacaaccaacttcaagcaaaagtcaattgccaaaaaagagcttttatttaccttttaataaggggggaaagctgaaaaaaattggatagattgacaataatgtgctgttcatgagaagaactttaattcaacttgagagttttctattataaatgtatatagatcaaaccccaaaataaaaaaaattaagcatgcagaaatcacatgcagtacataactaattggatgtgtcaagtgtgttgatcaatcacaatcacaaaattcgaatggttaattctagacacgtacgaattccttagttagcatgactatagattgtgatgtgtgtggggcctaataatcggaaggtacttgttccaagttaggtagtaggtcactgtttaatttccagctcgatctacagtgcgtcaccaattaagctagcctcatattctcctctcgtaaaagtggtcgattgtcatattccacgttcatcattgatcattccctgggttcgttatttgcagtcgtacatggtttgtagtacctcacaaccatataattggtatatatggtgtgtgttgtggattggttccacatgtccatatactccaacgtaggagtatttattattaactcttttgtataaaatgagaatgaagcttagggtgcatatgaacttaacaacacaaggaagcgcgtgaaaattaacaagaaaattaatggaaacagaccttgtatactttggtagtccatccgtcctaaaataatttaacttttgtatataaatcaattatgttcagattcaaatacaaaagtttacttattttcggatgaagagaataattgtttgatgtaatcactacaactatttaattcataacatttaattaggaaacgaatgaaaacttgcaatagttatgttttcatttcttatcaatagacaaatgttttgaatcccaagataatgcacgagtagtgattcctttggttcatttgactttcaaacattttgtcatgctttagaaaagttgatttatttttagacggagagagtaaatgaatagtgtaatcacaataactatttaattcaaaacatttaattaggatatgagtgaaaatttacgcgtggttatattttgatttccctcaatcgacaaatgtaaggaaccccaagacaatgagccatgttatataaggacagtgattcctttaaagttcatatgattttccaacattttgtcatgcttcgtagcacctctagggtcaatatattctttggtggcctttcagctacgcataaatttttggccatccattatttcggagtatcttcagccaggcattaaggagataagtcccatctagacaagctagttcgatcttatcatctacgtttagatggtcaagatcttactaatacatcatatatagtcaaattagaacaaaagagaaaagctgagttgatatatattctttgttccttcttttctcttcttcaatgccaaatttcgcgctcaacacactgcaaagtcttctccttggaatctcactggacatatataagcaccttgttgcgtgcaattttctctcgtaaatatgacgaacaaaactttgcgcacaattttgacttgaaagaccaggttgagaagtggaaggagtatatttttgaatggatggtaggagtatattttgcaaccctaattaagcttttacaaaagttttaaagcgaccgtgcttgatctccaaattggaagctattcaatttttaagatatatatatgtatctttggtcaatatttagagttgtttcgcatgatgtagcatcaagctaaacaaaaattggctgaatttaaagaaatttggcaaacatgaaaacttgtcccaaattacagagataaaatttttttaatttctttttttagggggcaatagaaaggaattttctgaaaatttcaaaatgtaaagcaacaataaataaatattggttaaatctaaacaaatttttataaactcagaaatttaatacgttttgtgatgatgatatcctagtagggaaaaataccctttgtttcgaaattgcagttcaaaatatagaaccctggcctaagttaccacagggtaaaagtgtcatttctaaaatcttctgtctccatttgagcaaaataaaataaaataaaatattagccgcaaattgtaatttaacaaattgcaatcaaacactttagagcaaattttgccattatatactttttgtttgctcattggtaagtgaaaactaacgatggcatggccactagagctagccagccatctctctgtgttagttttgctatagtcgattaattaaggagatgtaaaaactatttattttcgtagtttccttgttgttaactattggaattcatgtattagctactccctccttccgaaaatataagcatttttagcatagtgacaagtcaacatttttaactttcatcgcaaaaaaacatttttaactttgactattaataaaaaataaaaaaatcaattatataaaattgatgttactagatttatcattaaacaaactatttttatagatattgttggtcaaaatagtatctcggagaccgtgtcagggtacaaaaatacttatattttgggacggagggagtagcacttagagtactttaatttgtatatactatacgatcatgcatccacttagggcaggacgaagactgacgacatcacaattttgcacgctttttctgcaaattaaggtggacgaaaagacgaatgaagttaattaggaaaagatgactgaccggctgccgttcaaagagggttaggcagcaccaagcacctaagtgctagaggaactagagcaacactttcaggtctccccttatttactgaatgaatggactatatcaaagtcgcaattttagaaactagtatatatatgtaatatcccatgcatctcacgaattaattaaccacttgaagatattttactaaaagtgtcggaatgtcgttctatatacgtctacacattaatccaatatcttgaacaattgtggaatggtcatcctagctatacccaaaattcaccattccctgtcactgttctttctaaagatttttgcatcacgagaaaagtgagattttgtttttgatgggtgatcgagttaggtgaaggccggccgaaagaacttcaccagctcagggaatatttatgtttcagttctgagtttcataccgaggcactctttgatttttaggaaaaacaaataaaatttggaggattttaatcgtaagataaattccttggaatgtctttgaaacaaatgattgatttttttaatattcttataaaatgatcaatcttatacatattttggaagaaagttggcaagaacttcaatctatctaaaattttattttgagtatatgtgtttcatcctattcctctatttttccctgtgttttactgaaacgatcattcttgtattttttttctcttatgttttataatactttgttttgcattcgttttctcaatcatgtgtttcaaaagaagccctgaattctttttttttaattgtttaagctattttttatttttacttgttattttgttaatatatttattcctgtaattacgtagacatataatccactagaataatccagtcaataatgttttcaaactgcacaataatgtattgaaataagatattttgcacgtgcatgtgggcatgttgtttttcggccattccagtctgtactacaaaacaaggtaagcatggatgaggagatactccctctagtaaaaatatttgatatttgactggacggagtacttctatttttctttttgtttgttttatgttgttaagcctttcaaattaatgagcaggtacagggggcgaatatatcatctctactttatcaacagtggtcggccatggctttatatcatttgagagctggaactctcctatataagaacaatcatgtgtggcaaaatgtgtaatcaggtcagcgtgtgcagtgagctgtgtaggaggaagcaaaggaaagcaaagcaaaggtaggaaggaacaaaggcatctcagagaaagctctttgccagcaactcccacacactaatccttagctgcatcactgcatcctgaccttgatgtgcacaaattgccttctctgattctctccctgcatcctctgtctatatataagcagccattacaaatagcatgtcaccaaattacccaagctagctagagattacagtacttgatctcttatctctttccagggaaaagtttcttctataattaattagtagagtttgcacttgattagtaactttcattagaggcaaagttgagaagcatgggaggcacgctgcactacctgtctgatctgctgctgggtggcagcagcggcaagactagccacaagaagaagaggcagttcaacacggtggagctgaaggtgaggatggactgcgacggctgcgagctcaaggtcaggaacacccttgccaacatgaaaggtactacgacgtgaactctctgacacaatatataatggtctccacacaagccaaatttaattagtcaaaaaccaccgtttgcgaaagccaaaacgatcgactaggttaatttgtttcaatccaagaaaaaaagtgttcgaaacacttctacaaatggggatttaatttctgtgacgggttttggtttggaaccgacatatgtaacaattccaatgtaaggtttcaaactataacccgtcacagagatgtcaggttatgtacgctagctgaggcggtgagtttattatggagtacgtatatatatggacgcaggggtgcagtcggtggagataaacaggaagcagcagaaggtgacggtgcaggggatggtggacacgcagcgggtgctgcggcgggcgcagtcgacggggaagcgcaccgagctgtggccgtacgtcccctacaccaacccgtacgtggcgccgccggcggcgtacgacaagaaggcgccgaacgggcacatccgccgggtggacgccgtgctgccggtcacccccagccaggaggagcgcctcgccaccctcttcagcgacgacaaccccaacgcctgcgccgtcatgtgaaccaacatatatctatcatctcgatcgaaccattagcaatcggttcatgaactaaactagattaatactatggtgggcggataatatgtgatgtagaggctgagtttaattccattatcgaagagaaaaacacaatagttttgctatgaagatttggtgccatattttgaacttgtttctagctaccaagtgattgctaattgtactttagtatatgtaagtttatttgcatctctaataaaattttcttgaggagatactagaaggtatcatattctttatgtaaaattgtgtatcactaatatcccaagtactcgaaggtagaattttgtaccgctcccatccggccacgactactgctccctcttatacaaggggtgtggtgcgctagtgcgtgaaccagactgcgccggtggcaggagaggaggccgacaaggatgtcggtggtgggcacattgatagggtagcaggcgcgtctcgatgggtcagtgacggcgagcttcacggtggtgccatggttgcggaagagtaggaggtggacaccgcggtagtccaggaggaactaccggagaggaacgagaaggagaagccgcagggaatgccccaaaggcgacagagaggacagagtaagaggaagccaaggaggactggtggcaccacccactgccacatgtccatgcatagtgtctctctcgtacttggggtgttggtgctgctgggggtcatcgctagagctgcacctatcgcccacaggtcgcaagccgctcgtcctgaatacccttctcccgccctctgtcgcctctttcccggaatcaatgtctcagtcttcttccttctcgcttccttctcccttgtcttcccatatttcccctaggtcgtcaagggtggtagccacagcgtcaccgagctcatggtggaggattgatggtagcagttatatgagaagtggagctagcttaggcggccatggactcgttggcggagacgaccctcctgccacaaccggctccaactcttccagacccttgcctcctttgtagtgttccccaaccttcggtccctccttgcctcctttccccttccctcactgcctctcacttgcctctgccatcctgggcatgctgcacacaacctcctccatggtccatgaaggtgcacttccgaacaccggcacatacaccgttgtcattgaacacctcgcctcacggggtttgtggaccaggtgctcgaggtgtttgtagcaccctgaaattttcaagttttaaaatccagaaacaaaaaatgggaataataaagaaatgtttgtcaaagttcgttcatattggtatttgttggattttattttcttttcttttcttgttgtgccagtgcctcaattaaataaagtttaaggttattttcaaattctaaattcaattttgaatttagaataatgttcattaaagaaccatgattatgaaataatattaattaatgatttattttcaaataaaagtaaatgctatgtatgttccttaaaaaaactcttttatgaattaatatctctttaagcgattattttacaaatgaaaatttcaaattatttagtttctaaaaatcccttataagggttgattccctgattattttcgtaagcaaatactattaataaagtatttatcaaaaagtccaatttatgaaataaattccaaaccatcttttgttgaaaaacctttctaggaaaagtctgtttttggcccccagttttccctctttgacctttttctttccacttcaggccagcctagcccatccaaaccctaaccccatctgctagaagttgacttcacctcctattctttcgtctggccttccttttctctccttctgtctctcctatccggcccaagccaccgggcctgccttggcccagccggtcaagccagcctagcaagtagagccaccagccgctcctcgcagcgtgcagcgccgttcgatcgccgccgcccacccatataggcccgcatggccgcccttcgccggcaagccaaccgtcgcgcgccttccgctcctctcgccatgcctcgatgcagccagggaccactgcgctatcgccaaacctagcgagccgtcaagccgatgccgctctcccctgaacgtgcagagatgtagcctagagggggggggggtgaataggctttcctgcaattttctcaacaaacgcagcggttaaattgacagggcccagaacctcctagtgatgaacaccggaacatcctagcagtgatgagcagcccggaacttccggagttcttgagccaggaacttccgggcaacagagaaaaacgaaatatgagaagtataacaggtcctagctagtgaaaatcaggcacagggttgcacaagatgaaaatcacaagataccagcagattcaaacacagatcaagcacacgagagacaaaggcgagttttttccgaagttcggatcacacggatcctactctccgttgaggtgctccaaagagccgggtctcgattaaccccttgcctcacttatgcttcatcccagaagaggtccacagtcttcaactcaacacttctaggttgttttctagaattgagtgaccaccaagatccaactcacaattccttctagaaaagaccacaagtgcaagttgctctacctaggacaacctctgaaaactcagcacaagaaactttactcacttacctcgtttgcttgtggaggtgaggaaaaccttcacaaactttcccgggacatccacaagatctttagaagcttacgggcgacgcctaaccatctaggagaagatctccaagagtaataagcccaagtgacagcccacaaggtatccaaagttctcaatcaaacctaatcttcaagccatctccaaaacactcctacactctcatctaatctctcaatctcacaagatagtctctagatttgagtggaggaagcaaaggaagcttgggagtggctagaaaaccctagaacatgaatgaacagaagtggaatggccaaaaggtgacctggggacgaaattcatatatgtatcggctaggtgacgtcatctagccgttactcacaagtttgaactggaaacctgccaggaggttccgagcaaaagtgccagaaacttctgggcaacacttaggaaatattttgcaaataaacggtgcccggaagttccggccaaaacctccgggtagccctctctgtcccggggagaaaatcatttttcaaaaatgattccaaaaatcttttgactcgtggatatgactaagagcactttgtataccctagaaccacacttgaaacccctcttaatagtacggtttttcctaaactcaatttcgaaagagaaaaacctagtctaatcaccttcggtgtttttcgcacttaggaacattcaaattaggggggtctccttacattcttagccatcaaaacatgctttaggactaaactcccgtgaataaacttgataaacacgttagtcccctttaacgaccttgtcattaatcaccaaaacccaccagggggtttaagtgcatcttcatcccctatgtcgtgcgctgtgccctgctctactttcctcgtgcggcgcgcggccacctgaccggagccgcatgacaagacgtatgcggcacaggcgccaacgcactatggcaccactctaccgtgcaccacactatgacccgcatctcgtgcgtcgcgcacgagatgtcgagacacaggcgcagcgtcggcccgcccgcaccgcaccgcgcccaactccatcgcgcgcgcgcgcgacggcggccgtgagaccagccgccacgtcctcaccgcaagaaaacccgggagcttgagggcggcgcattaatggccgggcaggtggcaagtggtccatcaacactgcccgcggctatagatagccatatggcctgaggcccacggcccaccccaaagcccgcaattttggcctggccaaagcatggcacggcccgatagccgagccgtgcctgggctacaccctcggcacagtgggccagcccggcacggcccgatcaaataaaaaaatattgggatgtaaaatagacttaaataatcgtataacgcaaggcccaagacaagaggtatacaaaatagacttattttccagccatttaaacacagcccacagagttgagggaccaaaagtagactttttctgagaggaagcacgatgggccgtcgtgccttcgggccggcccggcacggcccgagtagtattgggccatgtatgccgcccgtgggctgacacggcccggtatgtcggtcgggctgtgccgacccaacaagtctcggcccaggcacggccgagcttgggccgggtcgtgccgtgtcaggcggcctagatggctatctatacccgtggccccgcgccttgcccgccgcccggtgcccccgttctttccccgctcctagtccagtgcccgcctggtcgaccgtaaatgtgcgtccatatgcgccgagctcacccgaccgctgcggcctcgtcttcccctccaagctgaccatgcctatggattaccgtagagaaccccttccctctcgacgtccaatttgggacctcaccagcattctcaccgcggtacctcgttcgccgtgttccctgccggtgctgaacccccaccgcaccatctctggccgcaatacttaggggttacagccctgtaacccttacgattctacgcctagtgatgccttgggcggtggaccacctgagccggcggatttcaccggaatcaactccggtcgccgccgctatgggagcaattgggggaaaagctattccggccatccccgacccccgccccttcgtgcgcatgtcctggtgaacccatggccaccctagagctccaacttcgcatcccccatgccttcgccatcgtcaccgggccggcgtccatggtgtccgcacatagtctgccgcctcacccaagccacctagctgttttgggcttttccaggctgcgtgctgctgtccacggacggtggggaaaccctagaacctaccatccccggccgcccctactttggtggcgcatgccgccggcgtgctcgcgcgcttgagagaaagcacaagaaagtaagccaggctataaagcttactttcctagaaagtcttccacctataattgagaaacccgaccaatagcaatggccctgtttagttcgtgaaagaaattttttggaggtcatatcggatgtttgactggatgtcggaaggtgttttcgtacccgaatgaaaaaactaatttcataactcgcctggaaaccgcgagacgaatcttttgagcctaattaagccatcattagcacaggtgggttactatagcacttattgctaatcatagactaattaggcttaaaagattcgtctcgtgatttccattcaaacagtgcaattatttatttaaagctccatgcatgtgtccaaagattcaccgtgatgttttagggaaaaaaattggtaactaaaccaggccaaacctaaccccagcctagataaatagtatagaggcaaaacctattattttaggaaggataacggatctaagagacgtacgggggtgtttagattcatgttgtaaagttttggcgtgttacatctgatatatggatatacatttgaagtattaaacatagactaataacaaaacaaattacatattccacctgtaaactgcgagatgaatttattaagcctaattaatccgttattagcaaatgtttattgtagcaccacattgtcaaatcatagagcaattaggcttaaaagactcgacttataatttacacgcaatctgtgtaattagttattttttcgtttatatttaatactatatgcatatgtccaaacattcgatgtgacatggtgaaaaattttgcttggggatcttaaacaccccttctttccaccatgcttctttattggagttgacttatagaggttggtttttgccttgtagcgagtttgggaggcctactgtctctggctgcaacggatcacggtaaggctccattcaaagaaaaagaatggaatacgacgaggcggtttttggcagatcacctagaatctggtccgactaataagtactggcaatcgatagtagaagttctttaaatcatctataatcaatagtatataatcaattttaatagtatagtcaactactgactccaaatcatatataatcaattcatacaatagttacatactacactattaataactggtcccatatatcatacacatattgtgtcttggagtccgtgctacagctggctataaatctatagctcgctgctcttctctctcctcttttatctccttaaaatatactccctccattccataatataagacacaatcacttttcttagatgttccataatataaggcatgtacaagcatacaattaactgtgacatcttctctattaaattactacttttttaaatcatctactctcatgttatctaattctattggatgcatgcattatatttattaggatgatccgaacaacaagatgagaataattatttgttggtctttgggttatgggtggttgtgccttatattttgaaatggatggagtatttgtagctggctgatagcctgctattgtatctgctctaagcagagagaagggagaaaaagatggaggagagctgacagccaggcaccacttaaaaactattgtgtgttataattaataaaggtgtcagggttacggataaggtataccctctacctttggatatacgtcgtgtattgatatggtatacctgcgcgtatacggacgctttctgtacacattaaggaaatccatcacggagtccacagatggaaggagtcctactcggacagaactgggtcgtcattgtatcgtgtagggtccgatatctctgagttttacttggtgactaactgacctgcggtataaataggacccccggaaggacctaaggcatcgaatctcacagctaagacaaccaccacagcctacgaagccggagcctacaggagccaagtcgctgggtgatctagttgaaccaactcgactacgatctcgtcggtatcatcgagttccactattccctttgtaatctgtgatttccatcgtataatctcatatcaactggattagggctattacctaccaagggacctgaaccagtataatccctgttttctgtttgcttgatgtcgtactacgtagatcctcgtaccagcgtactccaataccatctatatccggtctatgggtatctcccgtcgacaaaaggtgattaagataaataagtgtttaacatattagtttgtcatatgggccacatctattattaaaacttaaataaaatgatgtttaaaacctgtgtcacttacatgtgggcccacaggccgctttaaatggttaatttgaccaggtcaaggttgaccctggcccgcaagtcgttgaatcagggactttcctattggaaagcaagtgtattgtaaaagagaaaaggttgtgggtcccaccagtcagttatacaagatattttgctatacaaaatttattccaaaatatgagtaaatggctgaacaggaaggcttctctattaatttgatttaattcaaatttgaaattttgggaggccataactctctcattttaaatcagatttcaatgaaactttcatcaaaattcttctaaaatcaagaactatccattggcactggatttgaatttttgtcccttcttatagaatattgccctttgcgttagattaggaagactggtcgttaactagtcgttcgccgaacatgttactgttggtatttcttaatgttatagatagaatccgcaaacacatgaaagataccgatgtagcacttcacccgggagtattctaaggtatcaatttccacagggaacatatgtatcagctcttcaccaggttcatccaaggacacgaagcaaaaataggcaaatggtagggaggaattactagtgagagacagtgtctacggaaagttcaatttaatcctaatgcgatacttcgggcactggccagcccgctgctcctagatatggctctactgcgtacccggacaggaaggactttagtgtaattgagggatgtcaccacctctacacccacctcaaacctactgtagaatatgaagcaaccaccagaaattaactacccagacaccacgtctacgcagttaaaaactactttagcgttagctaaaactagagcaaccactatattttactggattatagttatcaatgatctcgtacgttgattaggaactaaccaagagataagtctcacaaaataaatcttaattactcagaatagtatttggattaaagcagagtaattaacatagtaaaagaaataagaagaggattaccgacagctcgggaattcctcggacttcctctactctactctctcccttattctagtatacaataaagtacaatatagcctcttataatttagcttaagcttggagtgtgtgttgaaatgagtgaagtgagctctatttataggcaggtaataacggttatctgatgtgaattgacgaaagtgacctccaatcaccatcaggagtagagcaaatcaggagcgtccatacgaaaacctggattaaacgactctcaccagggtttggccgaacctggtctgggccaggtgacctccaattttggtctggttcccctccctgctctactttatccatttctccgagcatttggcccatttgatgatgttttgatgtagttcaaggcctactctttatatggataggattcctccttcacatagatctggatttcatcccaacattggcggtatattacctgcattcaaataaacaccaacacttgtggaatacattagaattaaaccctatcactatgttggatgttttatttcttctgtttatgcaggtattagcggcataaaattggcaattaataacatcaaatagtttccatacaataattaccccaacaattgtctatctttattgaatattgtaaatagacttgtaaattgaaatgcccaattcatgattggctgaacaaaatggtgagtgcagtgcttagggttaggatttctattcatcttctgtattaccatttcccctttccatgtgttctgttccgccttattcgttgttgcttgagttacagtcttctcgctatctccgcaggtgcatgagtctcgctatctccgctggtgcatgagtcttatgctcctctcatattttgcttattcctactcgtacatatatgtattatgtacttgaattggtgttcatatatagatgaaatctagttccaacgcaaataaatttttcttgatctttaataactattctctcctccgttttaggttataagatgttttgacttggtcaaagtcaaactatttcaaatttgactaagtaagtcaaactatttcaaatttgactaagttactaatatttacattattaaattagttttattaaattattaattaaatatatttttataataaatttatcttgggtcaaaaatattactatttttttctacaaacttggtcaaacagacttgaagcagttttactgtgaccaaagtcaaaacatcttataaccgaaacggggggagtaagtattatcatgacaataaataatttgttatcattatgataaatttatgaaatttagcgtaaaaaccaaagttatggaatttaactgtacgtaaaaagatattcctttcacaatatatttttcaaatacaattggttggcattttgtgttttataaacctccaaaatgtatcagtttataagaaacaaaacatccacgccactccactctttttgtgtgatctcagtcggtggcggatctaaaaaattgattcgttggtatcaaaacgcatctatcggtgtcatagtatgcttattatatttagattatggtgctatagtatatgaataagcagatcgctatagattttaccgaaagtcgtcgatgtcgtctgataccggtcctataactgtagatccacccctgatctaagtgagaatatttttaaaaaatatttctactgtaacaaagagaggttaggtgtgtcagggtagaataaattgttgttatgagaacacgtgaacagtgtgataatgtgattgaatatttgaatgggcacatgaattactactgttaattctatcagtatacacgtcaccttctcttgctaatgacaactcatcattctttcccacactttatttcctttctcattcatgcatcccctgcctgctgcttgaagggtctagaaccctctgctttttacggctagtatttaagttcgatcgaacggttaacattgattccatgtttttttttcttaaccaatccaacggctattatttcatagatgattgtcgcacattcttgtctcattttgagttttacttttcaatagtgaagattgtaatgacacgtgatggcatatgagtgttcgcaggagtgccacgtgatatgttagaagcgtttacaggaagttcaatgaatttttattctacacatactaagttttttttactaaatctttactaagaatcatctcaaccatttgatttagatagttggaagttatgaaaaatttagatgcacttatagcgtgacacatcagtgttgataagaatttagtaagaaaaagttagcacatatagcctttttcatttttattatataatagatagatttgcactcacctactacaacaaaaactctccatattctcgcacactccccaaacattaacttgtaacattgtgactttggttacaaactgcttcaaattaactgaaatgttctttattgtaaagcgaactcatatccatggcttaggttcgccaataatttcatatatatacttcaaccttaggaattaaggatcgcgcctactgccagttcaatcaagaacgtcggatcaccgaagatgaccccgatgatggcacgtatgacaccggcaacgatcgtcaagaaccggtcaagccaccgccaccgtccgccgccgtcgccctcctcctggccggcggcaggctccgcagcacgccctccatcaccggcgagctcatcacctgcacgctccggacgtcggcggcggcgccgtactgcgtctgcatgcgcttgaggcacgcgacgtgcaggtacagcgcctcgccgtcgccgtcggcgtacgagtacgaccggtagaaccagaacctgcggccgccgccgcacctcatctccccgcactcggcgcaccgcctcgacgcctccttccggagctcgaagacgcggccgccgccgacggcgaaccgcgccggcagggacgcgcacgtcgggtggaggtcgaggccgaggccgccgtcgcctcggccggagcagtggtacaccaggccgcgcgcatgcacgccctcgccgcacgcgtcgcagatcctccgttcaccagcggcggtcggcggcggaggctccgggaggaggacgaacgtgcagcccgggaagaggcggtgctctctggtcgccggcgcgagggcgcagcacgtgtgcaggtcgaagttgcacgtctcgcgctcgcaccgatacctcgggccgtcgccgtgctccatgcatccgtcgcacttgaacttctggccgccggttcgcacaagcttcagtttgtgacccggccggtgagcagggtggaaggagatcgttgccggagtatctgggaacaggttagtcatggtggcttgctttttgatgctttcctttgttgttggatgtatagttttggaagtttgtcaggttttgtttaggaaatgtttggaagtttgtgacaaaaggggtagcatgatctgctcaatttataggcggttcgtttggttggatcgatatgtgctcataatctagcttcatcaggaagatacacagtgagtgacgaatgtgagaagtttatcggtatattctgtattagttaaattgttagtttttatatataatccatataagcgctattcgcagaagcaacttccctgcagctgttgcgagcacagtatacgacagcctgtctgtctgtctctgagagagagatcgatcatcgactggttgagttcagttttaaaatttaaaccatgcatttgatgatctatcgtcactattgacgtacctgtatggctgtatacgtaccactgtattttgcggagaagttagcacatgcaagatgttatacatcgcaatcatgtaatgtaactaaacaaaaaaaaacatttggagacacttgtaaaatcatgtgataagagtttataaaaatacggtgaatagtctctggacatggccggggtcaaaccaagcaggtgcagtcggtcagatcggaagtgttattgcggtctgaccaggcagcccgacggttagatcggtggagagagtcagtttggtgaatgttatagattgcttcatgtttatgacttctaaatggtttctatacatatgtgatattgttattgtgttaactaggtgaaaccccgcgcgctgctgagagagtttagtattataatactaagtaaaaataattttaaagatagctagataatataaacttacataagttgataattcaaaagtaaaagtaagttgatgtgactttatgagaaaacaaaatgaagagatagattggataaatcatataagggctaataacaattgaggtgatacgacttaataaaagaagaaaataggggagacaatttagaccatagataatcatttaaggacaaaacaattgatgtgatatggcttaatgacattagagatagagagagagagagagagagagcatattttaactaagttaggagttaggataaactatataggtatataagatattataaaaactgtttgagagacattgaaatagtatgtgaattatgtgagatgattatttaacatgcttgcacttgaaaaattataaaatttaatacattataaaattatagataatataatatgcttgtatcatatttaaatgtaataattgtttgtggatgatgtggcatctttgcatgttaagctttaaaatttagtgggctctaactttatagtaagagaggatgtgagttaagttggtaagaacttttactcggatatggagtttcattgttgttcgtgtgtgggtgttgttaaggctatgggagtatagccggtgatagatctggactagctagtctccgtagcactcttttattgtagtataggcttggtagaagatgagatctagatgataaaggatatcatgtgggatgttcaacctagaggacaatacatatggaggtgaacgtttgcatatgacaaacacgcagggttggcaatttcggagtgaaattttggtcatttcggaccactccgatacaatattatttaggccaaaatttttaattttttcatgaattttggtaatttttgttaaaatttaactaatttttttcaatttttttgaaattttggtctatcggtgacctctgatacaatcggtcaaatcgataagttaaaccctgcattaacatggtgttgtctgcgtatggaaaatgtagtcaattggattgaaaagtttggtaagaatggagtttggaattgtatgaggatgttgtttccttttttggtaggtttcttatgtgattagaagcccaagttctagtaggatctgtagctatcagcagccatgattcgggtataaatagaagagggaatgtggttagaagtatacgaacttttcgagagagaaaagttaggatctactttaagcttcaattctagattgagagttgagagagtagtgttttagatccactttgtaaatacatattcatgcaatttaagttgatctacttttaagggtttcatcaatttctgtttttctggatcctaatggtctgaccagagtacaacgagcacttagaccggcagcagcgaataggcaatgagtagatgaggaagccgcgatcaaaatggtggctagagagcggtcagaccggtggcttgcaggcaatcagaccggcggcatacctgatgaggaaatattgctacacaatgagttccgtatgtttttcgtttgtagaggtacttgcttgggtgaaggaaaagcgactgagcgtaaagaatacatggatgataaaaaagttgattagggatcaaaccaagatcttcctcaagtccactcctacctcaccacgtcacttttgaattatagaaggcaagactacacgttttggattcggattcgggcctcctgacagcatcaactttaaacggaccaagccgctgatttagaaggaatctctggacctgtgagtactttcagatagttttagttccacgtcaaaattcctaccgagttgtcaggaatctgcaaaacgagccatgtatcttattcagtccgaatctgatttgggtttttggtcttgtaattgtgtcgtgggcttggcctaagcccaagggggtatgcaccccagggcaaccctagaacattccaaatcatatttattcagtagctgttatagttcagagtggggttttgcttagattagttctgccattgcaatttcgccgctagatctttttgtgccccaaagtcgagtgcttaattattcatatgcaattgagttgctatctactttgttcttgcttgtgttcttcgattcgcatgcagggattagccttctcggcaagatcaactgggtttcggcatggttggtaaccaaatgagacgtggtgctgcgattgcaggactcggatcgtgttagtcggaagtcgaatcgtgtgtgttaagtttccaccgaattgagaattatcaatatttttgggagatcgggatgtagttttctcatcaatacttttggtcaaaccgatgcatcttcataaggttttagggttccttttattccgtaattttttttttggtttttagtgtttctaccattcaatcacctctctactaggcttagggtgtgtttgagaataaggagattggggagattgggaagatacgcaaaacgaggtgagccattagcacatgattaattgattattaactattttaaacttcaaaaatggattaatatgattttttaaagcaattttcctatagaatttttttataaaaaacacaccgtttagtagtttgggaagcgtgcgcgcggaaaacgagatgcttttctctctcaaatcgcccggaacgaacgaagccttagttattgtatttgatcctacaacacatttctataggtggttgtaaaatcgattctaaaatttggacatgcagtctagagacactctgtgaggtattttatgaattatctttgtactgaaaacacaaaagccaagacatcttcttgttacatttaagactgggtattcactcgaaaattataagcatccttccccttagtttgggggaatagggttagtggtgttagctaggaggctaaaaaatatatttgttgagaaaaaaattaagaataaagtaccaggtctaattaagtgcatatatacagcatatgtttgatttctctctctctctctctcttcttcaatgttggctttaaatccctacttttgccaagggaatctcacactactggaaaaagcatttttctaatgtggggtcttatattcgcagtcggacatggcccttggagcccaataactgcctacaaaaaatataaatcggggtgaagttcgctgcggaccacttaagcggcgcctgaccacttaagcaacgcctacgcaccttatgtggtccgcctgcaaaaatcatacctaccaaaaaaaatctagtcatccttatcctctcctctcctctccaccactcatttccctcccccctctctctctctcacttagaaaaaatctctcctctaccacgaccgtgcgccgccggctccccacctccgccgccggacggccctctcctcgccgccggcgggcttcctcctcggcgacgacgacgactgcgacgccggctctgcgcgccgacggctcccatcggccgtgacgatgaccttcgcgacgccggctcccctcctctccccacgtccgcgcgccgccgactcccttctctcccgcgtccgcgcaccgccggttccccaccttcgccgctggccggctccctcctcggcgacgacgacgaccgcgacgtcgcctccgcgcgccgacggctcctctcggccgcgacgacgaccttcgcgccgccggcttccctactcttcccacgcccacgcg

SEQ ID NO: 31041 - DNA, 1856 bp, Oryza sativa
ttcccctcctcgccccctccgccgccggccacgacgagtgatgacgacggcgccgatgcggcagctcggctcctccctctcctatgtggggcagtggacaaaggagagccctggccacggtgcccgtggtgaggccggcggcggcgcccgtggtttttttattatttttctgagatgattttcgcagcggggcccgcctacgaaaatgatctattttcgcagtcgacgtgttagcggcggtcctcctccccgcttgcgaaaatggttttgggccgtctggaaatatcgttttttctagtagcgtcaattttccagccagcgctcctactcaagcacatttctagtacattactagaagcaatatttgatctggtcgcttccaacatatttgatccggtggttacttttggcaaacaggaaattccagtcttacattggccaattcccaagccaggtaaattccttacttaagttgcttcagtacataataagttggtcgccatccagttcatcacaattagagcaacagcaattcttgtcctcttccttaatgtattaatagatactaagttggcatgaaaaaataaatttgtccctgcattagttattttttacacatatatattacctccagtaatttgcgcagcaacgcgtaaggtattttctattattcctatatttccaagcacgaaatcgacgtggaagctaggagcatatatatgctttgtcacgagaggtcactaactcgtcatttaatttacaagtcaacacaaaataagatttatatatccctctttaattttttaattttccatggtttaggttaacgctgtacatattacacgtagtcgttgtattatttcaccaacgactacgtagccatgcgtccatatcgattgtataagcacatctaatttagtcagagtacgttacacgctaattaattagggtagttaagttagaaaaaccgttttaggcagctagcctgttaattaaataatcaacctcaaatttttaatagtaaaacagattgacctaggtagcagtagaaaagcttcggatatgtgtattcatggtgcatatatacctcaactaacaaattccttttttctttaagttctatacttgcactttaatatatcctaccccacttgtatatgacctaataatttttaatcctaccctagctattaagaaaattttaggtttacattattataaataaataaaacgaaaaaaaatgtacactcgtactccctccgtactcgtagaggaagtcgtttatgacaatgtttaaatcaaacattgggaatataaatcatgaataactctcaagttgttgagtttgaaaatgtaaaaattatatgaatatatttgtcttgagaaatattttcataaaaatataaatatatcacttttcaataaatatttttatagaaataagaagtcaaaattgtgttttggagaccgtgtcgctgtccaaaacgacttcctttatgagtacggagggagtacaattttgtattctttaaagttttcacatgtttttcctttctaccataaaatacaatgaatttaaaattgactttttatatatattcatgtagaagttctatgggagcttttataacactagaaccgtgaaattaatcaaacattgtgtatatataatacgttgcagctatagaaactggatagcaaattaaagccttgctttacttcctgtaaataaaatttggatttgccaaatggcattcgacaaaaagttgagaaatactccctccgtttcaaaatatttgacgccgttgactttttagcacatgtttgaccgttcgtttattcaaaaaatttaagta

SEQ ID NO: 31042 - DNA, 8163 bp, Oryza sativa
ttgaataagacgaacggtcaaacatgtgctaaaaagtcaacggtgtcaaacatttcgaaacggagggagtatctttttagatttctctaccatcggatccatgccaagattattggtggatgggtcctcctctggctcgagcgagctcctcgtcttctctgttaccagtgatactccaactatgacagagtacatacatttctaggtgtagggttagtatcctaaatttcctgatttttgtatttgatcaagtattgggagtattatttgatgtgatagttgaatttaaatttgatgttctaaaatcatgtggatgttaggaattttagtaatcgcaatattgttggaattatagctttcgagaatattttgcaaagaatagaaagaagagtgagaattaggaggatttataagggatatgaactttggggggggggtagggggtttcaaattcaatattttaatccttcattattccatggattcgaggaaaggatttttagtgaggttttggattttaaatgagtttgaataatttagaaatgagaggaagaaacaagggatttcaaaggagtttgtgttgattgggatttcgaaatgagaatggaccttaaatttctagtaactcagggcatggactttagaatgggacattggggacagggtttgaatcttggattaatttggttaattttagaaggagtgggatcaagggaattttatggattttgaaatgtatttttagtagatttaaagaaaggagtatcatgacagggaaatagaaggatttcaaggaatttttggaatgactggatgtttggaattatttgaataaaaatttgggggaaaagataagaaggagaggacttcaaggatatttgaattcaatttaatattggaaaaccttgataatctaatagggttcaaaggagtatttcgttatttcagaaatttttcaatatataggatatttgaattcaactttgaggttttattaaaaaatcaaatatcgtatttttttaatttatttaagagagtacgtatgatcagtaaatccataaagaatgctgacaaagaccgctttcaactcttctcttggtcgttacgaaacctaactactccatccgtttcaaaatgtttgacaccgttgactttttagtacgtgtttgatcattcgccttattcaaaaaatttaagttcatatcatttgatttattgttaaatatactttcatttacacatatagttttacatatttcaatatttcataaatttttttaataagacgaacggtcaaacatgtgctaaaaagtcaatggtgtcaaaaattttaaaatggtgggagtaataaactacatataagaccctcgagcgagcatatctgagtattgacggatcgattggtttcaagccggccgtacgtacaattagaaatcacgacctgcggcaaagtcgtcgacgtcggtgccagttgacctgtatatcgaactatcaatatcccttcattttgacgtgtggtttcgatactactactccgtgtgctgtcgtttacctacgtaacctagacgtatacgacctccatttgtcccataggccataaaggaaaagaaagtccgcaaggaatggtaatcatgtcgtggtattctcggaattaacttgcagtccagcgaccaagaaactattaaatatagttttcatacttatcatatcgtatatatcgtatagaactacgtataaaaactatatattcaattgatggtgtattcaaattaaattcttatcaaatcacctcttctctttttattcacatatcccctagtttttattcttagttattgtgtagagatggtttcttacgttagaaatgatttcttctttttaccgctctttattattaactctatcgtcacatcatatttttgctttgtgacaatatattaaatgatgtgtacactagataatatggagagttaagcatgaccttggttctcttacgttgttgatatgtgggcctgttggaaagagtgcccacgtatcagtgacccacgtcatatatatacaaaataaagttgtgtaccacaatcccagtccaactctatgcccagacggtagagcagtcattggtcactgcatatgtagcagttagccgacggcctgacgtggtttgcacaagcgtcatcacgttggaattaatgcatactccctccgtcttaaaataggcaaaatttgctaaggacatccaaaaatcgtgtaattagccagtgggtaccgtaagatcacgaattcgctgcagggcagcaaaaaaaaagagtaattagctggtggacactcgagccattattttattatttccgaaggaaaagaggtgagagaatttttaaaatgccaagaattcccccggtgacgcaacaccttatcccgactgggtccggtcgaaccagacctaatcggtcttgtcgcctcaccacatagccgaaccacagccctagccggtgactaaggtggccgcggcggcgaccaagatctgcgacggcgagggcggcggcgatgaagctgtgagctgggcacggcgttgcactacacagcccaaccacaaccctagccggcgactgaggcggcggcggcggtgacccagatctgcgacaagcgacggtgagggcggcggcaacccagaccggcgagcagaggcagtggcttccgtggctgcagcggtcgagcggtgcagaaagatggatggctcggcttcatcctcggtggttcgtcgccgcaatggtgagttacccttatggaagtgcccaaggtgtgtgacacagctagaggcgcgaacatcgaggacaccaaagaatccaaacaagaactttgtgaagtgtccttaccttgaagatgtgagtatatgattttacggaacttttggtttacttctgtaggttgttgtcgagtgagttaattcaatgaaatttgcctttgtagacaccgtatgcgtgcagatttttcatgtgggaatctcagtatgagcagtatttggcggatggtcgcgtaggagtgggacatcagtcagggcgagaaagtcatgttgaagcaatggcatctatggggtttggggtctcagaattgaagggatgcaatgcagtgggacagattttagtgtacattagagttttgcaagctttattgctactattgatattggtaattgtcattagcaagtaagcaatcaagtaatgagtagttgataggttgtagtgatctgtgaaggcatgtcatttcttaatgtaatatggatatctgaatggaatttaattttctgaatggaatgcaaatttatgagttgaatgcaaatgtgtcttccagtgagaaaatttggcagcaaatctatacattggaatgaaatgtgtgttgtaatgacaaattttggcagcaaatctgttgaaaatgttgtcccaaattgtagctgtacaataattagtgagaaaatttggtagcaactatgtacaattcctgaaggcatgccattcctaaaagttaaagagccacacaacatcaaaatttggcaattacaggcaacaactttactgaatatgattcaacagccacacaacagcatttgattcaactttcatcagtgattacacaatccagcacacttataagccaatatggtcttaaacaaaaggcagacataacatggtcttgggtgaccttacacaaaaggcaaacattcaggaaacataacattgtcttaaacaaaagccaggttttgctacctctaaaacagttaagttatttggcattcttgcctctagtggtctggctcctagtgctaggactagcaacttccatgcttagtgatctagccttgctccttgtgattgggctactttcggtgacctctgatgtttctggaacatccaaatccagtgaccttgccatgctcctagtgtttgggcagctttgggtgacctctcctgtatctgcagcatgcatgttcaatgcctttgcactactccttgtgatagggctgctttggttgacctctgatgcttgggtacccatgcaaaaaaaaaagcagaattgttaatttacaaattgagcaaacttaagacaacacaatttttttcagaacatgaaaacacttacaaagctgctccaaattggtccgtggtaggatttgtaatagggttaaccacaactttctttactctcttcctcttaggctttggggaagctggtggtggggcactagaatcgtcaactggttcattacatgttttcatgatgtgaccaaattgaccacatctcttgcatctatgcttccttttccctgaacacccttcttcaactcctttgagcctcctgcttcttggtctgccagcagaccttttcaatatgggaggatataacttgaagccaacattcaccttttgccattgtgagttatctgtcattgggacaacaaaacctgcataagcacgcttgaaagtagccacagagtaatagtcactgacaaacttttccaattccaaacccctccttgaaatgataaggaaaattgcatgggtgctaggaattccagtcaattgccactttttgcagttgcattcttgggcaatcaggtcaagagtgtgcctccaagtctttaaatctctgcatgtacctccaatttctcctgtatggctgtgagcagagtacagcttgtaccctaggttcttgctcttagcatatatggctttcatgacactagggagaatctgtccagttaacttatcagctagccttttcctcacacttaacctctccatgatcatttgtctaatcttatccatcaaatcaacaacaggaagtgatttctcatgccttatccaactattgaaagtctctgctatattgtttgtgacatagtcacacttgctagcagtagagaattcacttctagcccacaggtgtttgtggaagtcttcaatccactcaactggtttagggcatgcttccatcatctcattgtagtgaagctcaaaaatatcgtgtctatatgccctagatgctagccacaggttcctttcaaatacttcaccactaaatctcttctgaaaattcttcaccaaatgtctcatgcattctctatgctctactccatttgtgaatactctactcactactgtatcaatcccttttcctgcatctgtggatatgaccaacccaataggtgacccaatagccaaatgcagcttctccatgaaccatgcccagttatctgtagtttctgaatcaaacaccccatacacaactggaaacatccagtagtgaccatcaatgccaattgcagatgctagttgacccctccacttgcctgtgagtacagtggagtctacacctaagtatggtctgcatccatttaagaacccatctacacatggtttcagtgccacaaacatcctgctaaatctgttcaccccatcaatgttgacatgttacacctcaacaattgaactagggcttttcctctccaattcagccttaaaattgtaagctgcagcaaaactatcttcccatttgcctagaatttcatcaagtgccatctgtctgccatcccaagccacaaagtaagatatcttgatcttatatttctcttctagtgtacccttcagagcagaaactccaattgtaggatctttccttagcttgttgatcacacggtctctaacccaagaatttttgtgtccatacagttgttctccaatccagctgtgctagcacaattgtgttggtatggaagcttctttatctgcaaatattaattgaaaagatcattttatttaacagattatgaccaaaatcaccatgcatttaaataatgtaaataacttacctgccatgttctgccatcctgtaatcgtgacgcatgaattctccacttgcacctcttagccttgcaatatgctctgtacctcctcgagtcacaatagggaactgcaagttcgacctcattcaataatgcatattatctaatgcatcttttaaaacattgaccatcttcaaaagttacatcaacatctatgttaagatcttccacatcggttatatgagctacagactcacattcctcctcatcgtcgacagctaagtcatcatcgtcttcgtcagaatcaggctcataatctggatcaacctcctcatcatctgacaccaaatctttatacttctccttctcatcagctacaccaacatactcaacctcatcattctcaccccaagtgtcaactagttttggtttcggtttcggagtgctacacttagtagaaggctgagatggttatggtgattgactttgttgtgtaaacaacactatgtcagtacacacattacccggtgcctcaatcgtgccctgctctacacaaggctctgtcctattctgtgggtcatcactcacctcaacaaccaaagggagcctcctttgctcccagtacaaatcacaagcatgaagtaaagcactgtcagatgctatctgagcaaatctaccagcatttatgtccaaaaattttacacttaattcctgagcaggaccatgtttaacctcaacatcaagatcactcatgagatcaatccaacatatcgtatctttgtctaacacccagttaattttcttagtgacatgaaattctggcctaccgttgtcagtaaactcgacaaatggaccaagctcaacagcaactctgcaagctgagctgccatccatcctatgggaacgcaacaagaacagagaggaagcaaataaaacaaatgcaaacgacatcttcaaccataaactcattccagtaagtcaggacccataaaattagaggaatagaaaagcttacccttcggggacctatgacacatctgtcagcaatggggatccggtggtcctcacacggagcggcttcttcaccgccaacttcttctgaggcgacatcaccttagtgtggtgcgacgccgtgcctagctcatagcttcatcgccgctgccctcgccgttgcagatctgggtcgccgccaccgccgcctcagtcgccagctagggttgtggttcggctgtgtggtgaggcgacgagaccgactgggtctggttcgaccggacccagtcaggataagatgttgcaccaccgggggcattctcggcattttgaaaattctctcacttcttttccttcggaaataataaaataatggcccgagtgtccaccagctaattaccgctttttttggtgccctgcagcgaatttaatgatcttacagtgcccactggctaattacacgatttttggataccctgtagcaaattttgccctcaaaataactcaacctatgttgggattgtccagattcgttgttctaggatggatcaaatctcatccttggttaagttattttgggatggagaaagcatgccggtggtcaggtcatcggttatactagtatcacatagcacacacctgcaagccagctaatttctccgaaggtagagatgcaaataaacgcaacacgtacaagtaatccctttttgagataatgacatgaaagcgattaatctactgctacgtgttcgtctaggtttcctggccggcagatggaatcaccttaaacaacttcaggtggcactataagtcaacgagaccggccgtgtgttggcggttctgaaattgctcaccggttgctgggttagtcaggtcatcacttatctgatactgataattctactgagaaagatttaattccccaaaaatttttccctaaaacatcacatcgaatctttggacatatgcatgaagcattaaatatagataaaaagaaaaactaattgcacagttatggagaaatcgcgagacgaatcttttaagcctaattagtccgtgattagccataagtgctacagtaacccacatgtgctaattatggtttaattagtcacaaaagattcgtaatgcggtttccaggcgagttctgaaattagttttttcattcgtgtccaaaatccccttccgatatccggtcaaacgtccgatgtgatacccaaaaatttccttttttccacctaaacacaccttgtacaacgactctacctgcagcctttctgtcgaaggaatggcgacactatcctgatcgaccgggaatatcccctactatggcg

SEQ ID NO: 31043 - DNA, 1313 bp, Oryza sativa
tggccgcctcccctccggatccagcgtcgcccggctgccgcggcgcgagcccgcctcccccccgccgcgcgagggccggccgcctggctggccgccgcggcgcgaggccgtcttcacctccgcccgaccgccaccttatgagggtcccgccgatgcacccggccgctgccgccgcttggccactgatagaagagaggggaggaacagaatggggagaggaggaggaagaggaagagatgggaggaggaaaagataaggttagggaagtgataaggaatagaatttattaactcctcgatctcgcgcacctcgtcctctccgccacgcatgcgcgcatgctgatattttgttccggtttaggctactaaccgggactagagataaatctttagtcccggttggtaataccaaccggaactaaagataatagggatttttttcccggtgttaccaactgggactaaaaatagatctttagtcccggttaagaacacaaaccgggattaaagataaaaaactagctctaacgttttgaacctagactaaaggtaatctttagtcctagtttttattgcaaccgggattattgtagattttggctgaccgaccaaaaatggtttctccatcagtgagataaggtgctttatttctttccttttatatttttcgccaattgggcatttttttcactaattgggccgttagagatttttttttctcttgctctgtattaatgtactcctatagttttatatcagtatagtcaagttacctttttttctgcttaatttgcgcgatgattgaaaatattccttcgacagctgtgaggaaacatatcttatagctatatactactgtagcggttgagtactccaattatatgtttgaatcctaatatatccttatttacatagatatggacgtgttttcaatttcagaatgatatatagtttagtgatatcacagatttacgaatttattggtgcaacagtctcttgaatatatgttaaaggagtgcactcataaatatatgtgtgcatgtattctatttatgccataagtaacaaaattcttctgtagtgtgtgtgggaagtatttttaacacctagtacaattgcacctagaatatgcatgtgatataaattggtaaataaaaatataaaaacaatattgacaagatatattgtgataatataagttaattagtacttacaaaaatatgcaactacaaaaatacactttgcatgtttgcatataccgtaaattaagtatgtaaccaccttgtccaatactatgatatgttcaccaaatga

SEQ ID NO: 31044 - DNA, 4091 bp, Oryza sativa
ttttcgactagaaatagggcctgctttggttgccaagttaccaatacaactgtaatagagtttatatccatgccattataactaataatttagttaggagcagatctaatatagtagtcttggggtaggtgatccacaacttttggcacaatgcttggcaaaacctaattgatgggagaagagaaaatgaaagaggggtaaggtgcaaaatttttgcagtgccgatgtgggcaattttatgtagaaaaatggccatcttggatcatgcccttcggattaaggtcggacggtgtacattccgcaagtgcatgaaagcaggggtgtatataggatatgttgcccttataactaatatttttaattattttcaggataatttaatttgcagtcagttttaagcacttatataaaactagtctctctgcatgcttataacttataagctactatatgcaacacaatggttaattattgtcatcgcacgaaattaattttaacctaaattacggcttgcttaaaagaaaaaaaaaaagatcactgcggaataaaatgtatcattttagttagattacaatgagcttaaaagtatttcagagcgaaatagttcagatggtttcgatgcttgtaggagtaaaaaaaataaaatagtaaaaatgattatttttctttgcaattttcttatggcggatccgcaggtgcatagactaagttttgactatggcatgagcaagacgtgatttttgccgacaaacgatcaatatgtcacgtgtacggaagagcaagtgccacatggtgatatgggagatggagacccacacgaaatagatcgatatgcttgtctgtcgttccctgttccatatgctgcttacgttttctgatctcacggatatactcccttcctgaataacaaaactcacacaagctacattcaaatttaaatccggccggtaagtttttttttaacggatgaaacgctcccttataaacatttgatttgatgtttaacataggattcgtttaaattttaaaaatccgatcatcaataatttcttaattagttagtttaaaaagaaatgaaagtggcataaacatagatttgtatgaaaagtaataccgtaatattctaaccttatgattttgtaaatccattgtaatacaaaaccgacagtaggattttaaaattttaaccaaatcttataataaatgctaaatatatgtggtcattgtattgttgtagaaagatagttatgggaaaatatgtgcgtacttataggggtgagtgtccatgcgtatatgtgagtgttgcatttatactagtatgactttttttatataaaaaaagatagttatgtattattagaaaaataggattcacatgataaatattccaagtcgacattaacgtcagcaactagcggacggcatggtaatttgacaactagaaagggtaagtgaatagcctccacaaacaaatctgatggatgaaatcagagagggaatagtcacacaaattaggagtagattccagctctcaaagacaaagacggaatttgtgggtgtatgcaatttcccacgatattaagatgcaacaaattaatgttacggtaaaaaaaactaagcagtcatgaaaaaaatcgacggcatgtgaggagaccccattgcgaccttggtgccactggacaaggcagaggccagtccactggctagctaggcagtggggattgtcttcagtattacagctgcagtagtagtggctaacaggtgggaccgggcccacatgtctgcgtctactactgctactgcagtactgcagaggatccatgtcccattgtcggtggaaggggacgtaagaaatattctccaaggacaagtgtaactatatcatttgaaacaaatatacatgtaaaaaatattatttatctttatttgtcaagatgattgacggtccaaattagtacttaacgaccgtcaacactaccgctgacgccaccgtaccactaccccgcctcatcatctatcctgaaggcatcaacagcaccgacgaggccccctcggtcggcctcctcccaatgggctaaagttaaggacttgttggaaggagattctaataccaaatattttcaattggttgccaatggtaaatatagaaaaacaagaatttttcagttgcaggatggtgaccatataataagtggtgatgcaaatttaagataccatattacaacatatcataagggttttgtttgggccatctgaggaataacatttcaccttagatgagcatagaagggatgatatcttgtatatgtctcaaatggaaaatgaagcattaacaacaaattttactaaaaaggatgttagagaggcaatttttcaaatggaacttaataaagctccgggtcctgatggattttcagctgaattttctcaagtcttctggaatgttataaaggcggactttttagatttattcgtagaattccataacagtccattccctaaatttcgctaaatttcaatacaattattttggtacctaaatccaaagaggccataaagatataaaaatatagaccgatttgtttattatatgtcagttttaagatatttacaaaggttcctactaatagaattattggtgtgtcccaaaatgtaataagcccaatgtagatagctagcttttatacctggcaagaatattatggagatggtagttatttacatgaaacgattcacgagttgcataggaaaaaacaaaaatggggttattttttagatcaattttgagaaagtatatgacaaagtaaattgatcttttgtacaacaaacccttacgatgaaaggcttctctactaaatggtgtcatttcttttattcaaagggggcgcattggtatcaacgttaatgatcaagtaggaccaaattttcaaacatggaagggtctaggacaaggtgatcctttatctccaattctttttaatagagttgttgatatcttagctttgctgatcaagggcaagggcaaatggtcaaatagctagagtagtccatcatttgatagatgatggtttgtctattttgcaatatgcaaatgatacactcatttttatggactacaacttagataatactaagaacaagaagttactaatgtatgtggttgaaatgctctccggtcttctaataattttcatatgagtgaattattctgctttggtgaagcaaaagaatgtcaagaacaatactctaatatttttggtgtcatattggaacttttcttagatatcttggcattccgatgtatttcaaaggttaaactatatgggttgaaaagtaatagaggaaagaattgaaaagaagttgagcattggaaagggaaatatatttttgtgggaggaagattggtcctcattatatttttcacacataatagcatatatattttatattttattattattaaatatattaaaatggcaacatagttttaaattaggaaaaagtatgaactacccagcccccagaactatcgcagtcgtccgaattaccccccccccccccgaacaacaaaaccggaaattcttcacccccaactatgaataccggacgaattaccccctcgacccaatccacggtggttttggtctacatgacgtacacgtggcagtccagtcagcattctatttatgaaaaaattgtgggacccacatgtcatacactacactgtcttctctctcacacactctctctcacttctctctttcactcttcctctctctctctcaccggctcacggggtcagtggtggcgggggacatggagcggcggcgaccgcggcgcgtgacgcggagacggcggcggcggcgcgtgacgcagaggccgcagcggcaggggatgaggagctcagcgcagcttccaccctccctctcgtcggcagcggcgacgggggacacggagcagcggcgcgtgacgcggagacagcggcggtgggggatgaggagttcggcgcggcttcccctctccctctcggtgtcgtacgcgcggggaggacgagggtgcgagacaagaaggcggcggcggcgaaggcagat

SEQ ID NO: 31045 - DNA, 13909 bp, Oryza sativa
  unsure (1)..(13909): unsure at all n locations
ccgtccgtcccgcaatgctgccgcctccttgtcccgccgccccgcgtcacccgctgctgccgtctccacgtcccgcgccaccgccgcctcctcgtccggttgtcccgcggcgctgcccaccgtcgtttacagtgagagagagaggagagagaggaagagtgagagagagaagtgagagagagagagtgtgagagaaagaagagatagtagggtatgacatgtgggtcccaaattttttttataaatagaatgctgactggactgccacgtgtatgctacgtagaccaaaaccaccacggattaggttgagggggtaattcatccggtattcatagttgggggtgaagaatgttcggttttgtggttcggggggggtaattcggacgaccacaatagttcggaggggggtaattcgtactttttcctttaaattatgtactaacttgaccaaatgaaccaatgtgtaatattcatattgtattgcatacacgttctagttattaactatttttaaattctagattttagttatttgtaaattatattctcctcgtccaatattctttatttctttctgttatttataaactttattcctatatgtagtctaaactcttctttcaatattttttaattttatattctgaatttcagttatttctaaattgtactactatgtgactctagatttctatcacaatattcattattttaattctgaatttctattattttaaattgtatttctgtatgtactctagactcatctttcaatattccttattttttttaatttcgaatttagttattgctaattgtattcctcctatatgggctctatatgggctctagactctttttccaatactccttattttttaatttcgaatttaattatttctaaattgtatttctatatggtctcaattctacttttaattttattattttttattccgaatttcaattagctctaaattcctatatgctctccggacttttcattcaaaatttcttattttgatattttttttatttctaaattgtatttctatatgctctttaaacttttcttacaatatttattattcttttaattccaaatttcagcaataaattatatttctatatgaattctaacctctatttctattttttttaattcctaattttagttattcctaaaatgtatatcagtatggactctagtttcctattcatatattccttattttttaaatttttcgatttttagctcattttaattgcaattttttaagaactcttttttttcttttttttctcattaatatgagaatttgttggtcgtgagggggcacatgaaggctctttttattattactttaataagttaattaagtcaatagattatgtaataagtggatgtagtttcgtaagtaaatgtcggatttaattccattatgttaaagagaaatactgaatacagcgaaggtatatattaagtagtcccttcgtcccagaattttaagaagttttagggttgaatacgattattaaaaaagtaggtaggagtgagtggtggagggttgtgattggatgagtagtgaaggcaggtgaaaaaagtgaatgatagagggttgtgattggttagtaagagaatgttggtggtgaagttgttatattttggaataaatcctaatagctaagagagccaacaattaatcaagtagtacactcacatgggtccttgcctcctgggcacatatttatcatatccccatcacaaaccaaataactcaaaaaggccccataaattagccccaaaatcccaacaaactatccgccgtacataaacaaagcaaaatctccatcacgcaataattcacttcaccaaatcaccagcgaagccgctgtatatatatagcacctgcaacgagccaggatcgatcaaccacacacacactgacactgtgacacaacacaacacggcggcgcaacaaagctagcttcaacgcccggtcccggcgatggggtccttctcggcggcggaggagacgacggcgacggcggcggcgcggccgcacgccgtgatggtcccgtacccggcgcagggccacgtcacgccgatgctgaagctggccgtgctgctccacgcgcgcgggttccacgtcaccttcgtcaacaacgagttcaaccaccgccgcctcctccgcgcccgcggcgccggcgcgctcgacggcgcccccgggttcaggttcgccgccatcgacgacgggctcccgccgtccgacgccgacgccacccaggacgtcccggcgttatgccactccgtccggaccacctgcctgcccaggttcaaggcgctcctcgccaaacttgacgaggaggccgacgccgatgccggcgccggcgccggcgacgcgcggcgcgtcacctgcgtcgtcgccgacagcaccatggccttcgccatcctcgccgcgcgcgagctcggcctccgctgcgccacgctctggaccgccagcgcgtgcggtttcatgggctactaccactacaaacacctcgaccgcggcctcttccccctcaaaagtacacatcatcctaattctctccctaaatagcaaaattatattattctctaactaaaataggataaaattattcatacataaatattatttctagctcatacaggtttttatttgtgtgtaataaatttatattaaaaataatataagcgattgaccaaggttcaaatcatatcgcccatgaatattacgcacacgaagatgggtttttaacaaaatctaagtaaaatcagatactatatattgttgatttccgtctctttaaagatatattaggggacacatttcatagagtgtgaatgtgatattacgtgtgtagggttcaaattctgaaacagaattttcagaattttgaaaattttggtcatttcgaacctctcagtatgatattattttggctgaaatttttttattttttttaatttggcagtattttgtttaaatttgactaaaatttgttcaaaattttggaaacttcggaccgaatatcggcaccatccgatagaaatgtacagaccgaaagattaaaccctggtggggtgtgtgcgtctcctgtgtaataaaaaaaaatagcaaattagtacatgtttttacaggcgaggctgacctcagcaatgggcacttggacacgaagatggattggatcccgggcatgccagccgacctgcgcctgcgcgacctcccgagcttcgtgcggagcactgaccgtgacgacatcatgttcaacttcttcatcgacgtgacggcgaccatgccactggcgtcggcggtgatcctcaacaccttcgacgagctcgacgcgccgctgatggtcgccatgtccgcgctgctcccgccgatctacaccgtcggcccgctccacctgacggcgcggaacaacctgccggcggacagccccgtcgccggcgtcgggtccaacctgtggaaggagcagggcgaggcgctccggtggctggacggccggccgccgcgctccgtcgtgtacgtcaacttcgggagcatcacggtgatgtcggccgagcacctgctggagttcgcgtgggggctcgccggcagcggctacgcgttcctgtggaacgtgcgccccgacctcgtgaagggggacgccgccgcgctgccgccggagttcgcggcggcgacggggaagaggagcatgctgacgacgtggtgcccgcaggcggaggtgctggagcacgagcggtgggggtgttcctcacccactccgggtggaactcgacgctggagagcatcgtcggcggcgtgccgatggtgtgctggccgttcttcgccgagcagcagaccaactgccggtacaagcgcacggagtgggggatcggggcggagatccccgacgacgtgcggcgcggcgaggtggaggcgctgatacgggaggccatggatggggagaaggggagggagatgcggcggcgcgtggccgagctcagggagagcgccgtcgcgtcggggcagcagggcgaccggtctatgcagaacctcgacaggctgatcgacgaggtgctcctggcttgagagtcatagaatacaaaggactgctacggtgctctgagctagactctaccataaatgctacttttttttttcaggttataagacgtttggtgaaagtcaaactgcttttaagtttagctaaattagataaatatagtaatatttacattattaaattagttttattaaattaataattaaatatatttttataataaatttattttgcgtcaaaatattaatatttttttctgtaaacttggtcaaacttaaagtagtttgactttgacgaaagtcaaaaatattttatatcctgaaacggatggagtacaacttgttttaaaactatgttttagtctgaaatcatctttgtatgatgcacgtgcacaatgacaaacatcattatataccatgttttgttattattgtgctgctggtacacttgcctccatgagttcaataagctcttgatgtgtagcgtattattgtgttaaaacgattatcgtgtaactacggttgtatctctataagaaaatattgcatatttgccgaaagtcttctggctaaaagatgcatataggtttgtacggcaacctctcatatttttgtatgtccagatcgacagaaaaaatattttttttctccagtgtaattggaccaaaaataatctgaaagattattttttgtggatatgcgtgcgaacaagaaagcttcaatcgctgtcgagtgtcgactcgatgcttttacaagtcgatctgtacgtatagtgttagtagtattaatggttaatattgtgaaaacaaaattggttagtcatatcgcaataatgcatccgacttgtctgtcacgttaaattatactccctctaatttttaattagatgactccgttaatttttaaacacatgtttaatcattcgtcttatttaaaaaattgaccgtcattagtcttatttaaaaatttgcaaatctataagatattaatcatgcttaaattactttgagtgaaaaaataactcacaacaaaataaattataattacttaaattttttgaataagatgaatggtcacacgtgtgacaaaaagtcaacgacatcgtctattaaaaaatgaatgtagtacgagacactcgtagttctcttaattaattaggctcattttgggtgtattttctttatatatctatttaactaagttccttccaattaaaacatcgttattctgatttatagaatccatattcgctccatcaagagatgaaatactcacgagggcccttatataggttgtaggtaaatcgtaaccggccgcgctataaaaatcaagctctattttcgctatggctctcgcctgcaaaaatctaatttagcacgcgaacatcttatggagccacatgtaaaaataagatcattttcttatgcgggtctcttaaacggttgcatgagattacaggcaggcctcttaaaagcccgcctaaaaatctcacttacctcctattttcccactcaatacttcaattttcttaactcatcttccttttccgctcttcttaggggtgaaaacggagcggattcggacggataatggtcataccatatcctatacctttttttgtaaagcggatgcggagcggttgtggatgacatgcagatacggatacggagtggattatttcggacgtcggattcggtgtggagttggcgcggagtcggttcggaaacggaataatattatcggatgttaagtttgtattcaatccatacaacaaaagggtagcaatacaatgagcagtaatatgatggcaaaacaacatctaaacatggtgtcaactctctaggaaaatacatccaaaacacatccataatataaacaaccaaaaacataatataagtcctcacttcactgcattgcttaaaaataacgggcaaatgccataacatcaccatcagggacccagcaaattaacatgttcaatagtccaagatcaagatgacagtacgctaaatctcatctctaaattaatcaaattagacattgctactgacttaaattacctaaagcaaagctcatctctaaatttctaaatcccaaatctcatctctaaatttctaaatcccaaaattgaaatttcaaattagagaaagaagtcaaagaacacaatacttaatatggagccggtgggaggcgacggtggctagcaacggggagtccgggaggtagaggcgctggccgctggagagtggcgacggtggatgggacaagcaagcgggaggatggggacgacagggactggatctggaggagaggcgacgtcgtaggaggcactggccgctggcgagtggcaatggtcgttggatgcgctagcgctggtcgctggagagacggcgtcgcaggcgcgctggccgccggaggagaggcggcgtcgtaggatggcacatggcaggcaggaggcactgcgacgggcagttgacggggtagtcgcggcgctgcggcggtggcgtcgcgcatgtgcagcgccgggacagggactggcctgtgcggcgcacgtgtgtgtcgggactgtggcgcaatggtggcgccgacgcgtatgagagtgggaggagagccagcgtctgacagtgggggattaggattatgtcaacactcaacataaataggctagatgtgctggcctatttaaatgggctcaattgtgtagctttttggcctgaaacatgcggattatccgccaactcgtcattcggataatccgattcaaaaatcggataatacgcatccaccggatatcgatgataccatatccgcatccgcatctgcatgataaaatccgcatctgacgggtatctgaaaactcttaccatatcctcactccagtcagattcggagcggatcggatcggataatatccgctccgttttcacccctagctctcctccttctgtctctcacctccccttctcctcatattaattatcacctcctctcctctctctaactagccagcaggcagcggttggctcgagtggcagcgacgggcgactaggcaacaacgggtggcagcaagcggcggctggctcaagtgggagaggcgggcggcaggcgcgccgtccccgccatagatgcgcaagggacggccctcccccacccagtgaaggtggcgaggggtgacggcggtagcggcagggccatcccccacacagattttgcggtggtagtggcagaccgcacctagctagtattttgatttttgggaattttacttttttttcaaatttaatttttacatgtggacgacataagcacccacacacgaaaattggattcgaaaatcggattttcgcagacactttcgagcaaatagacggcttaaccgcacgtaaaaatagtttttggccatttggaataatgctttgagttctcaaactaaaagcaaataaatggcgcagaacaaaggaattccaaaagtctcccatacacactggcatgaataattctatagctcaggtacatgtgcaacattattagaaagaaaaaaaggtacgtgtgcaaacaaaaactagcacaagccacaaagctattttctccttttttttttctcttgtttcttctcctcatgatgttttgctatgataaccctccatccttgcattaatgacccatattaacacacagatggaggaaatttacgaaattttgtgttttggggtatttttgggaccgacgtttttagaatttttaacttttaacatattttgactgagatttgaataagcttttaccaaattcaacagggaggcccatcatcctcacgcgctccattctgaagcgtgcgaagcccatccggagacctgtccacaacagacacacacgcaccccggtttgccttagtcgccgctgccgtcctaccctctctggacctatgcccccccctctccgccctccttcaaaattttcgccatgaatgatagagtaggagcctaatgcatgccggtgggtacccttacccattccccaaacccatacccacctaaaacgggtagggtatggacaaaagatcctttacccattagaaatagggtggatacgggtatgcccgtaaattaaaagggtatagggagggtgctacccactttccccgtgttacccgtccccaatcgacctcatctaagcgatgacggcggcggcagcttcgacggcggcttcggtgagcatccggcaacagtgactgcagcctcggtaatggagaagaaccctttacaaggtactgcttcgattgactcatctgctgcttcaatttgtgaaatctttcttctgctcaaagcctcaaaccctagaagtaatcttggttgcatatgtgtaaatcttgnnnnnnnnnnnnnnnnnnnngttcttggctttgttgcatccaacatcttgctgattctaatgggagatcccagccatgatcgtgatgcggccggaagttccagtaagtggagaggacctgctgtacctgtagatgttgctattttatactgacaaccattcatgtggtatgtctttaggcagtagaatgaattttatttcaaatgagctccattggtgatattcaaagcttcgatcgaaatctagaattgcaaaatttttcacatgaatcatctgacgagcggcatgatgatgggtaatgtttctacttcacacttctagttaatcgtctttatttatttttcgtgctaatagaactccaatcttttatagtgtgtttaatgtggattttgctttagaatttactaatacagtactttcgtcgattcaattccatagagttgagggaataattgagctaggtaaatatgttagttcagacaacagaaagttcagatcgaaagtttggaaggattttaaagtgtcagtagtggatggttatactaaggcaatatgtttacaatgttctgcccatctagtcactggcaacaagaatggaacaagtcatttgtgttatcacatacgtgtttgcctagagcttcaaaagtcaaagaaaaagaaaactacttcaaaggcagaacttcctgtttttgatcagcaaagaagtcgtgatgacttttgctcgaatggttgtttgccataattatccattttgtatgtctgagtattattacacaaggtgattcatttataatctgcaacctcaatttaagttaatgcatagaactgctgtgaaagatgatatcattaagttatataaggagggaaaaaggaagatatatgaaatattggataaaaatcagagcctgaatgagtgaaatgacaggctatatgagcatgacagtacattactgatgctcattggaaattgcacaaaaaaaattttgggcttgtgcatgtcaaaaccccacacactggtgttgtcatttctaaggcaatcatagctagatcgtatgaatggaatttggatagaaaactctttagctttgttcttgataattgctcaatcaatgatgtagtgattcgggaaatacttggtatcctcttacccaagcaagcattacatttaaaaggtgaattctttcaaatccgatgtgcaatgcatatattgaacttaatagtttaggatggattgaaagtaattgcccctattctggtaaatattcgagagacaattagttatatcaacaaatccacatcaagattggaaaagtttgaattgattacccaataagcgaatgctcccaagttatctttagaaactgatactccaaccagatggaattcaacttttcacatgcttgagagaaccattaaattccgtgaagcttttctgtgatcgaaagaatgtgacaagtttttcccatcagatgaggactgggtacatgttactaaactaacagattgtttgtgtgtcttttatgaagcaactctgagggcttctggctcaaaattttccacagcaagtctttacttcaatgatttttgtggaatatatatttttctgcaagaattgaagttgagtgatgataactttattgcttcaatggctgtgccaatggcagaaaaaattgagaaatattgggagacatgcaacaagttattatctattgcaaccattcttgatcctcgctacaaattgaagtctattgagtacttctatggattgctttatccttctgaaaaagatgtgaaatttgaacatatgaggagatgctttagtgaattatttgatgagtattcaaagcaagcaacaatgcaatcctcatcagttgttgacacttcaagaaatttccaggagtgcagttcacaatcacatgagtcctcgttgagcttattttctaccatagtaggattagaaaagtatatccaagatagcaactcaagccagcaaacaacatcagagctcaatgtctatcttgatgatcctccacatcctggaatcagtgatacttcttttgacatcttggcttggtggaagttgtatggttccaaatatccaattatttctcgaatggctcgtgatatcttaagtgttcctatgtcgacagtagcatctgaatcatgcttcagtttagctaatcaagcacttgatgagaagaggtgcagtctactgcctgaaacacttgaaggtgtgatttgtacacaggattagctgagggattatataccaggtacagatctccaataaaagagtaaaatattgtattgcaattttgatgaatttgctaatcactttttttttctggagcagatgagtttttggaacagatgatagcagaagatgtgtcatttactcaagaacaagcagttgtagatcaacttgaatgaagatgtgctgtgatgattgaggcacttggatcagttgccaattactagtgacctacctagcacattgtatcaactagtcgaatatttcaaactcagtacttttcacggtctagtttcatttttaactcacttaatcagctagtagcagaaagcatatgtactcctgttattaacagcttcgttgtaccttaaattgtggggtttcatatctaattttccttttaaatgatatggctattacccaactctctttatccacacatatcagttttatccattccccaatgggtatgggtaatttagatgacaatgaatatggggagggtaagaacgagtaaggtttgaagtgggtgagggtatgggtaagcatggggatccccaaaccctccccaacggcaggtgtttaaggtctttggatgactggaggttgaagaaagcgtgaaattatgtcaacgaacgcagttgggccaggctcacttagagcagatacaatagcagactattagccagctataaatatattttaataagataaaagatgatatagaaaagtagcgggctacaaatctgtagccagctgcagcatgaactccaagacgtaatgtgtgtatgacagatgagaccatacattaatattatagtaagcaactattgtatgagttggctattagattggctatagatgaattagagctagtagtgggctatactattaaacttgctcttagaaaaggaattcccttaaaaattaggctacaggcccaaatgccacactagcccccagcggcccagcccaagtggccaaatacctaattccccaatcccccagccccaaatcccctagcagaaggcagtgagctccccgtgcggcggcgccggcgaggcagcaggcagcaggcgaagcgcgcggcgccgcgagcgcgagcagctgcaggccagtggcggcggagtctgcaggccggcgccggcgacgccacggcagcacgtgaaggaccaggcgagcagcaggcagccccttagcccgacggctgcaaaatacaaggtatgcaatgttttgtctcatactctcatgtacagattttgcctcgtgaaggataatccgcgtcgcacgtgagaaaataatcaattgtcttgtgaatgaagttgtgatgtactgatatttctcattatctctctgtttccatatgaaacttcttttagggtgtgtttgaggagaaggggattgaggagattcaaaagatacgcaaaacgaggtgagccattagcacatgattaattgagtattaattattttaaactttaaaaatggattaatatgatttttaaagcaacttttctatagaaattttttacaaaaaacacaccgtttagtcaagcgtacgcgcggaaaacgaaataatctttctccctttctcctgcgctcgaacgcagccttagagtacaacgtaatattatgctattgtaatattgtttgagacgttatgtgtttatgccggtgttcccaggatgttgagcccaccccccccccccattttttattcctggatccgccactgttggatccagtatgttgagccgccactgttggatccgaggagactcccgtccgctgctgctggtgagctccccgatttggggacttcgcgaacccttgtttgttcgtttgtttggccatggcgatgttggatggctttaggttgactatgaatttctggagtttgcggttgccaagaggggaaaaaatggtttgtttcatcatttgggctgttttgtagatgagggaattggcagttctctgcctatttttcgctattgtacagtttttatagcctgtttgagtttctgaatctctggtcttgccatcgtcaagggggcaggtggcttgttgagtcagtgtatgtagtccatgcgggcaccaactgttcgatgaattgccccttaggcaggaaatggcagtgactgtagaatgcatgcgcttggtgaactgccagccttgcattgcttccctgagaaggctattcattcgttccccctgtatcctgaggatgtgctagcctttctggccaatggccacaagaagcaggtttagttcagcctttcaatccagaaacctcagggggcaacttttataatcttcacaacccaatatgttgatgtatagtctttacctttacatgcatatttgattttttttctagaaattttgtctcaatcaaacttgaaatttcttgctcctcagttttctaattttgcttgctccaatcaagtaagttttttccaacaagttttctgtgtttaaagttataatatgtacccgttatgaactatatagtagtgatagtaaatatagctatagtaaacattatttatggtttgagtatcttcagcaatccatgaattgcgtgagatatttaaacatctttctatggaactggtgcattcttgttcatagttctcgttgaaatagcaaactctgattatggatatatttgaccttttcatagttctccaaacaatgagatgaggtcatgtttaatttcctaattttgctcaggtctacaactctaaatatgactatacttgtaaaatcgccttgacgatctccacaatttatggagtttttgtggcattgtacattggtattttcttatggtcacattcatatttacttgtctccaatagttttatttataagagatgttgaggagcaaacactgcatatctttacacttcacatacgaatatactttgtgctttactgcctggattactgcatctacttttttggtaaattcaatttcttgcataaaatggggataaagtaactgagagcttcagtagactagtacatcacaacctaggtaaatgggagaattagctactatgattctttggtgaaacttcagtttagtaaaatagagtaaccagatatatggtctatcaaatggaaacctggagagggacctccatagtccgatcatggtaattcaccctcagataatatactgtggatatataaaagttgctttcgatgattt

SEQ ID NO: 31046 - DNA, 5424 bp, Oryza sativa
  unsure (1)..(5424): unsure at all n locations
ccctcccgcgtctttcaaaggaagccgcgcccgaaattcccctccattccggggggttccagattcccagcgaggaaaaaagcaaccaaaaaaaaaaaaaaaaaaacggaggcgagcgccagcgctgcgcatcccagatggacggcggatcgggtgccagcgccacccgcctcgccgaatccgggccgtccattcctccgctcggtcgggcgccccgttaagcctgagccccacccaccccccaccccggaaccctcgccctcctcaccccgcgcaccccctccaccttgccgccgccgccgactcgccggggctcgccgccaccggtggtgggggggagctcgacctcctcgccccacgcgcgcatccggacgccgtcgttctgggcgcgggagagatccgtccgtcgccccccgctgggcttgcgccatcctctcgccgggtaagccctaggtttttttttttttttggtccgatcgattccgccgcgctcctagccgcgggtgaggcaggaatcggggtggttgcggggggctcgtcgtgcggtcgagggatttggttgttcctagtaggaggggttgtacttgttcatcccgtcgatccagtggaggcgcgtgggagatctcggttgggggtttccgtgggctccgtgggttgccgctcgcggtgcagcggcgggatgtggatggggatggggatggcgtggtgggccgtaggtgcgagcaaccctagacggattttttttttgtggccattttagggtttacgggaatggattttttttttaccgaacaagagatgtactctgaaaattgctgtcttttcgtagcgaggggcctataggatcattgaagccttagggacttagggtttgggctgcttgcagctgtatttctcatttgtaaacattagacttccgtgtctgctgtgggaggatgaaagaattgacttgggagctgagttctattaggttcactggttttgtggagtaatgtttggaaataatctgagggagtataaggctgctccatcgcagtgccacgtgtagcattcggttcgaatttttcatttgtgtaatgtttcttagcagttactttttattttggaagttggttctcccaaaaaacttgtgtcctatctggtttatttgaaggtatcttaggacaacaagacgattagatgcaaaagttgaaagtaggggcattaacataaaccttgttgggtgcagaatatggtaattttatacgtattaattgcgtacgtaccgtttccacaaaattgttcatgtagtaataaataactgccaaagaaagctgatgtgactccatgaatgaatgtatactacgctatatctgctgtattgattgctgtagcaatccattcgttttcagtattgtgctggtgcattgtttgcaaaagcaaatcatatttattaatttttcattattgagttgcagcttgcaaatgtgtatgtatgtacatattgtgagagaaagtaggcatgtctgaactctcaacatgattattgtcataagaaaaatgttatcgttgtttttctctctttttgggtaactgtttgtgtttatggttataagttctatattataaatttgttcaggctggaattaggctgaccaaatccttgttttgaaattcgaattatattgatatatatcttgtacggtcattgcattttttattgttttgctttataactatatataggctggcttcattacgtactccctccgtcccaaaaaaacttaacctaggcaaggatgtgacatctcctagcacaataaatctggacagtcctttgtccagattcgttgtactagaaaatgtcacatcccttcctaggtttagtttttttgggacggagggagtaaacttgtctatgttaaagtttggaatatccaaaggtcctcaacctagtatgtactattttcttgaccttaacatggaactatacatgacctttttttttcctattttactgaataagatgattgtttgtttgcggtttcctaaatgtacttaactgttggtattgttgtgaagatgtgacggaattagtattgtggtattacatctatgtcgtagacagctttttgggtttgcaggaatgaagtacataaatatctgtttggtgctgtggtacaacaatgtaaatagtttattgcagtgacaatgttgcactgttgcatgcatttttgttaggatcatggttgtctgttgccttgttatgccattaacaaatctagaataagtgaagcagcttaaagttatgttctcgtgctcttaagagcaaacatttaagaggtataatagcattctgtgttcaaactatattttagaacctttgcccttgcttaaatagttttatttataagagatgttgaggagcaaacactgcatatctttacacttcacatacgaatatactttgtgctttgctgcctggattactgcatctacttttttgttaaattcaatttcttgcataaaatggggataagttaactgagagcttcagtagactagtacatcacaacctaggtaattggaagaattagctactatgattctttgttgaaacttaggtttagtaaaatagagtaaccagataataggttctatcaaatggaaactggagaaggtacttccatagtcgtatcattgttaatttcaccctcagtataatattagtgttgaatatatgaaagtttgctttcgatgatttcaggtgatttgagacaatcaagatggctttttcatcagttttcaggagaggaaatgtcaaagaattgatctcaaatgtttcggtctacactagcgcagcaggtaatggctttggctttaggcagtctgagactcttgactgacttgagtctgtatttgtgctattttgaataaggtgcttggctgtttgaatgacaaaatatacctcattgcagagtcatctggaggattgagcttgatttttaagcgttgggccaccaaaaagacagctggatcaacaaaaaatggccgtgactctaaccctaagtatttgggtgttaaaaagtttggcggagaggtacaatcttgtgatctgtcatatgactttcatgtttttttattgtttatgacagcacaaagtactttctttaatcacgtaaaagtaatcagacttcggagatttgtgtgtcccttctgatcccgtacctgaactcctgaagcaacttgtcatttttgttattagaacaaaaaggtgaaaaagatctaaactgttcctgaacatcagcatttgcatcatttttcagaaagtggagccaggaaacatcatcatccgccaaagaggaacccgcttccatcctgggaactacgttggcatggggaaggaccatactctcttctgtctgaaagaaggacatgtgcgattcgagcgcaacaagctgactggcaggaaatgggttcatgttgatcctgttgctgggcatgtgctccaccctgtctacgccagtgattcgacccctgcagctgaaatggagccattgtaatggctttacatggaatgaagtaacatatgttgctgacagctttcgtccttgccttgagagtgacttctctaaagaaacttattgcgattaagaggcttctgggttgaatttgcttgcaataaggaacctaaccatcatgtttagaacccttttgtttttggttcttgctgtggcttaaagttgtttgttttaagtatcctttgtgatttgtggcatgaaggttgacaaacctacatgatttatgaacacacagaaattctaaaaatgttgcttgggccgggaaagtcaagatgcttatttttcttcgaaatacctatggaataacctatgtcacgggaatttgagagaactactttgtaggagggttaatcctttggcttcaagagtttcacatgattgtttttcatatatgatttaaaatattctgcaatacgtaggattttcattcgaattgattcagtttctgcaaaagtcatctagaattcgtttggttcaaatgaagtatttctttgttgcaatacatactcttcccgcccaatcacccaatgatccaaaggaatatatgtgtgagcacttcctttattgaagtatagtatcggttgttttaattccaactcttcacattttggaatctaccctggaaatggctattttgaaagttttactactattttattgtcatgttataacattacatagagttaatttatcggtcactccatcatctttttaataagtttttttgaaagctaatacttaattacctgtgcattactctatcgcttcattctgtatgtagtggaagtgttctctacccaaaatgatataagtacgtcttaaaacgccatagaaaaactggttatctttattacaacccaatctttttgcttttgcttatacttataagccaaaatttaaattttcaaccttaaatttggagttgattttggggtttttcatcaaagtttattttttattttttgcttttagatcactaaggccctgttcgtttcttatgtaaggagagggttaaattgtgaatactcgtggcacgcttttaaaactgctaaacgatgcgtttcgtgcgaaaactttctatatgaaagttgctctaaaatattagattaatctatttcttaagtttatataataattaaaactcaattaatcacatattattaccacatcgttttgcgtgaaacacttaatctttatcttcatcttcatcttcaggagattcaaacaccacctagaaacacatatataaaagttttgttcacaaattatttttcgtttgcaaatatgcaattttgcttaggctgtgtttagttcatcgcaaagtttagattttggttgaaattagagatgatgtgactgaaaagttatgtgtgtatgacaagttgatatgatggaaaatgactgaagtttggatccaaactttggatctaaacacagccttaatccccaaataagccaaacgatgggggccttagtttgttcaacgtgttaaaattaaaaaatatatttacacaactataaacataagcaaacacacacacaccacgttaaaattccgagagagagagaaccgatgcgaaaagagcgatcccctcccgcgtctttcaaacggagcccgcgccccggattcccctccattcccgggggtttccagattcccagcgagggaaaaagcaagcaaaaaaaaaaaaaaaaaaaaaacggaggcgagcgcgagcgctgcgcatcccaaatggacgggggatcgggtgccagcgccacccgcctcgccgaatccgggccgtccattcctccgctcggtcgggcgccccgttaagcctgagccccacccacccccacccccnaaccctcgccctccttaccc

SEQ ID NO: 31047 - DNA, 4720 bp, Oryza sativa
taaatgtactaaactgttggtattgttgtaaacatgtgacggaataagtattgtggtattacatctatgtcgtagacagctttttgggtttgcagcaataaagtacataaatatctgtttggtgctgtggtacaacaatgtaaatagtttattgcagtgacaatgttgcactgttgcatgcatttttgttaggatcatggttgtctgttgccttgttatgccattaacaaatctagaataagtgaagcagcttaaagttatgttctcgtgctcttaagagcaaacatttaagaggtataatagcattctgtgttcaaactatattttagaacctttgcccttgcttaaatagtttctgtacattaatataaacttgtgaaataattcactaactaattatggattgatttgtttcatgcagttcactgggttaatgtgagcttcttgataaaatatggcggataatggtaatgcaaagccaggtggtgggggatctggagcttatacaatcaacctagataacttcagtaagcggctgaaggtgttctatgaccattggaaagagcataattctgatctatggggttcttctaacgctattgcaattgctactccacctccgtctgaagatcttcgttatttgaagtcgtcagctctggacgtctggctacttggatatgaatttccagaaaccataattgtcttcatgcacaagcaaatacatttcttatgcagtcaaaagaaagcaaatctcattggcaccctcaagaaggcttcaaatgatgctgttggtgctgatattgtcttgcacgtgaaagctaagaatgacagtggtgttggcttaatggaggacatagtgcgtgctgtctgtgctcagtcaaaatcagatgacccaattgttggtcacatcgcaaaagaggcacctgagggtaagctccttgaagcttgggcagacaaattgtctagctcatctgtgcaacttacagatataacgaatggcttctctgagctttttgctatgaaggatacctcagagatcacatgtgaagaaggcctcctacctaacctcatctgtaatgaaaaattttgtggttccgaagctagagaaggtgattgatgaagagaggaaagtgacacactcttcattgatggatgagacagaaaaggctattcttgatcctcttaaggtcaaagtgaagttgaaggctgaaaatgttgacatatgctatcctcctgtatttcaaagtggagggaagtttgacctcaagccaggtgcctcaagcaatgatgattatctttactatgactctgcaagtgttatcatatgtgcaattggggccagatatggaaattattgctccaatatggccagaacatttctgatagatgctactcctgcacagagcaaggcgtatgaaactcttatgaaagctcatgaagctgctctagaagcattgaagccagggaatcggatgagtgcggtttatcaggctgcagttgacgttattgagaagaatgcccctgaactactccctaatctaacgaagtctgctggtacaggaattggtcttgaattccgagagtctggcttaaacttgaatcccaagaatgaccgtatcataaaagcaggaatggttttcaatgtctcccttggtttgcttaatcttcaagcagaaacaaagagtgagaagacaaaacaatactctcttttgttggctgatacatgtttagtgccattggagaacttaacagcatcatgctccaagcttcttaaggatgttgcttattcgtttaatgacgaggatgaagttcttcctgtcaaaaaggtggaggttaatgcaaaggaggcattgccaccaacaaaggccacacttaggtcagacaaccaggagatgtcaaaggaagagctccggagacaacaccaggctgaacttgctcgccaaaagaatgaagagactgctagaaggcttgctggggttggctctggttctggtgatgggcgtggtccctcaaggtcatcaaatgagcttgttgcatataagaatgttaatgatgttccatatgcaagagagttggtcatacaagtagatcagaagaatgaagctgtcctcttacctattcatggcagcatggttcctttccatgtttctactgttaagagtgtcacaagtcaccaagacaaccgcacttgcactatccgcatcttcttcaatgtgcctggcatgccattctcaaacgatagcaatctgaagtcgcaaggggctatctacttgaaggagatcacgttccgctcgaaagatccacgacatagcagtgaagttgttccgcaaatcaaaacgttgaggcggcaagttgcttcaagggagtcagagagagctgaaagagccacccttgttactcaggagaaactccagttggcaagcaacagaaacaagccagtgagactttctgatgtgtggataaggcctgcatttggtggacgtgggcggaagcttacaggaactcttgagtcccatgtcaatggttttagatattctacttcaagggctgatgagcgtgtggatatcatgtatgggaatgtaaagcatgccttcttccagccagcagaaaaagaaattattacactccttcatttccatttgcacaatcatattatggttggaaacaagaagacaaaggatgttcaattttatgttgaggtgatggatgttgttcagactcttggtgggaataggagatcagctcttgatcctgatgaaattgaagaagagcagcgtgagagggaccgaaagaatagaataaacatggatttccagaactttgtgaacaaggttaatgatcactggtcgcagccacaattcaaggggctggatcttgagtttgatgtccctcttagagagcttggattccatggtgttccatataaagcttcagctttcatcattccaacttcgacttgtttggttgaactaatagagacaccctctcccccccccccctctgcgaggatcctccgtcgagcatctctcggcgcacgagctgaagctggtgaccaccggcggcgcgccgttctgctgcgacggctgcatgcagcccggcgacgacggcgccggctaccggtgcggcggtgcgacgtctgccacttcgacctgcgcacgtgctgcgcgctcccgccggccaccctggagaacgacatgttcgaggtcagcgcgttcgcgtttctcgccgagccgcccgcggcgcccgccgccgcgggcggcaggatctgcgacgcctgcggcgacggcgtgcgcggcttcgtctaccactccgacgacccccgacctcgacctccacccatgctgcgcgttcctgcgcaggcgcgtcgtggtgcaggacggccgccacttcgagctccgcaagcgcgcgcagccgcgccggcctgtgcggcgagaggagcggccgccgccgcaacttctgggcgtaccggacctacgacgacgacggcgaacccgtgtacctgcacatcgcgtgcgtcaaggacgaacacccggcggtgcgcgccgccggtgtgccggcgagatcgtgctggtgagctcgtcgccggcgatggacggcgtgctgcagagcgtgccccggaggagcacgccgcggagcggcgggttcgagaggttttgcaagattgttaacgtcgtcgtgagcgtcatcatcgcggtcatattcgggagtcccatggcgatgataagcgcggttgcagggcccgatggtctcctccgtgggtagggagatagtgcgaaaataatcaaaatgatatccgttgtgaattagtgcaaaacacattcatattcaactcaaattgggacgatccgacgatgagaaatttgaaaaataaatagcaatggatatgtgacgcgatattctgcctaactactatgtgtgcacacatgtattagcgctgggttgcaaacgggactatagtgggtttcttcagcagtggctagcagtgtgtctatatttcaggtgcccgaaattttcaaaaaaaatcagtcattttttcatccatcctttggatgggaatccaacatggttctcatcactcattcttcattaatggaaggttgaacaatatattattctaaactacaaaagttgaagctgatattaaagaaacttatgattcataaaagtatacaaaatcacatgcaaaaatattactccctccttccctaaatgtttgacgccgttgacttttttaaacatgtttaaccgttcgtcttattcaaaaaaaacttttataaaatgtataaaactatatgtatacataaaaatatatttaacaataaatcaaatgatgggaaaagaattaataattaattaatttttttaataagacgaatggtcaaacatttttagaaaagtcaacggcggcaaacattttgggatggagggagtaaaagttagataaaattaaagtaaaaccgaatataagaacaaaattgcaatttaaaataaataaaatttcacattgcatactatgacatacgaatgtgtgtaattttgcgtgactgaaaattttaaaattttgatacgcactgctagaaaaaggattttcgcaggcggcccaaaaccaatttcgcaggcggggaggaggaccgtcgctacacatcgactgtgaaaatagaccattttcgcacgcgggcctgtggcccccctgcgaaaatcatctaaaaaataaaaaaaa

SEQ ID NO: 31048 - DNA, 24805 bp, Oryza sativa
  unsure (1)..(24805): unsure at all n locations
gtgaaatgagtggtgaagaggtgaggataggataaggatgggggaggagaggataagcaggtaggtacgatttttgtaagcggaccacctaacatgcgcctgcgaaaattgattttcacaagcgtcgcttaagtggtccgcctgcgaaaataattttcgcaagcgtcgcttaagtggtctgcctgcgaaaatcaggcggacagctagtttcaccccgatttatatttttataggaggtcgtttggcttcaaatgttatgtccgactgcgaaaataagacccctacgttgggaaaaatgctttttctagtagtgacgtacgcatgaaatctagcaataccctatgggagcagcaaaccccatgggctacatgatagaattttaaaaggagaaagtcaacgacaatgtatgtatagtattgtttgttttgttctaaattagtatcagtgaaagcttaataatgtggcaccgtttagttcgcgaaatgaaaatttttaggtgtcacatcggacgtttgaccgaatgtcggaagaggttttttggacacgaatgaaaaaactaattttataactcgcctggaaaccgcgagacgaatcttttgagcctaattaatccgtcattagcatatgttggttactgtagcacttatggctaatcatagactaattaggctcaaaagattcggctcacaatttcctcctaactgtgcaattagtttttgtttttatctatatttaattcttcatgcatgtgtctaaagattcgattcgatgtgatgtttttgggaaaaaaaatttgaaagcagggcctgtattaatgattggtatgacgtacgtacgcccagctgggaacgtgcgagctagattcgccaccggaatgactgtgcgtacgactgcatctgtccgaccttcatacgactgcacatgataaattttaacttattttgattgggcccacgtgaatgcttatgaactcctatgattggttggtttggcgcagtcgtatgagagttgtatggttcagtcggatgtacagcactactcattctctacatactactccatccgtcccaaaataagtgtagttttgtactatttatgttcaacgtttgaccgtttgtcttaattttttttatgattagtatttttattgctattagatgataaaacatgaatagtactttatgtgtgactaaatatttttaaatttttcacaattttttaaaataagacggacagtcaaacgtggggcacggatatctacggctacacttattttgggacggagataatatctccttagaccacggtaaagactgatgatggaggtaatatctccttagaccacggtaaagactgatgatggagacattttactgcttggtcgctacgaaacttaacaaacgagacgtggccccctatcatatggattgctttgccagcatgtgtagttagaccaaggtccggagatcttgactcgcagtctacttatatataatctctgtgctaaaaaaaactcaatagattcattcctaagattttttttttcagagggagtacagtcagctccgtctcgaattataagacggctttgttcttatatgaaaatcaatcttaataatgggttattaataattataatgtgtttaatgccatgtgtgtacatcattaaattcatatttttaaacactttcatgttatgtaaattttaaaggtggtgatataacatatttttgaaagaaaaaataatggtctaagatatatatggtattggagatttcgagaccatgtagaaaattttatggcttgcatgaaagctttgatttaattaactgctgttttagtagtactaactaaattaggtgccctgttcattaaacgacggatataattaactggattcggaaacatttgacagtgagacgggataatatatgtactgagagatacattgggaatgtatcctatagacgcaagttttcataccgtatacatcaactaacaaatatcactaaaaattttagaaaactttgtacatgtactttcaatagtattatatctacatataaagtcacacctttaaatttattttacataaagagcaataaaaaagataaaattaagatagacttgtagtcttagtactatcatattttttttgttttttttacgcctaaaatgtattaaatttgatgttaagattttacacgtagatataatactatatattgaaagtgtatacccattttttctagatttttcgatgatatttgttaattggtgtatacggagtgtatacactttgtcagggttatagataccacatatctaattgtagttgactaagctcggcagggctcaccatataccatgtcttatacgaaaaaaaactcgtatatagaaggaattccggataaggaaggataaatagagttttgtacggaaacgacaaggactactcggatcatatccatatttatctccctagttctacttggacaatggggcatctatgcgtataaatacgagccccctaggaggagagaggtaggaggagagaggacaagccacaagacacaacagatcaatataatatagatcgatacaagccaacacacgccaagacaagctgctggatatcgatatcagagataagcctagacatacccatccgatgcctacgaaggctggcaagagggatctagtgccatctctgatctcgcggagtgtggattcgaggaggaagactaccccaccgtcgactacgagttggttatctagccgccaagtcgataacagctatattggttatcccaaatattgtacttgtgtgattcaaataaataaaggagcaacaccggcttcggccaacaggagtagggctattacctgtcagataaggggcctgaacctgtataaaatcccggtctccatcttttttacctcaatctcgcatattgatgacgctctctctcgtggcccgatcttctggtgaggggataactctcgctttgatcaagtgcgacgtttgcgacgtggctaccaaccagaacaagtccaggacgccgtgcaatcgctacaccacaaatgatgtcgtaccaaccgtgacgcgcagttgatgatccttgcaatgcaaacgagagaacactacaagaataagataagatacaatctaaatattgtgaataggtgattaagcacaaaggaatagttgcgattgaaatggtagatataatcgacccggcaaatcaacacaccaactattgggggctctgaatcaatagtcaccgactaatcgagcgataactagagacaaagtgaagggcactttgcaaaattcaactaaacaaaacccaaatgtttttgaggatgtacaaagctatttatagaggaaaataaagctagagttaagtgctaattagtggaggtggagggagacacttccgagatgggcctagtctattacagggaccaaggcccaagttctgtttcaggaatagcactgtcttgttttggcgattcccattgactcgagataaatttggacatgagaccagttgcatttgaaaggtagcgagataagcttttcacaaagtctaagatcacccaaatcggagttcgcatgaaggcgctaggttcatttgaagtcagtgctgtctccggaggtcgaactggattccaaaacccattggactttaatatcttgtagatcctctgttcactctatgtattctttgtccatgttttatatttctcatgtttgggtgtatgcatatatttgatggtcacatcacatataccttggttccaacggtccccataccatacaaataccgtagtcgcgatctcaaaagtcgatacacttgtgtgcacataatatattcccaaatacatttcatatatatatatatatatatatatatttatttaaactgaaattgtaaagaatttacaagatggatatagtatctcgtgactaaaactataatacgaattacaactaaattaaatttgatttttaaaacatggtatcgcaagaaccgcctacccgccaccgctgggcgcggcattaccagccgccgtagcgcgcagcccccgccgccgccggccgcttgcctgccaccaccgggaggagaggggaggaagaaggggaggaggggtaagatctgtgtaggagaggggaagaggaaggggaggagaggaggagaggggaggatcgatcgatctgtgggagaaagtggttgcgcgattgtggaggagaggataagtgctagggattagaattttagttccggttggtaatatcaaagggactaaagtggtgatctttagtcccggtcggtggcaccaaccgggactaaagatcctcggtcccctgacatgcctctgacagggaatgaaccaggattacagatcatctttggtaacaccaaccgggactaaagatcgtagaatggctatggggttttcaaccggggctaaagatcatttttagtcccggtttttttggaaccgggactattgtgattttgggttgacccagcgaaaattagttttccagtagtgtcagtcaggcactgacgaaagtacgtaagagatcaaaaagtacagtatagtagctaagtatggtccaagatgtgtagctagtacgtgcaacatactacatccgaccatagccaccgtacatagatacgtttatatattatatccgggggaaaatatgtgatggaaatcatatatttggtggaaacttgaaaactaacgttggatcgagaaatagacgtccgagatacgtccacgttatcacaaacgtccatttttcgacccaacgatagtttccaccacatatatggtttccaccgtatattttccgctacatccgaccaaggagtacggttttatttatcacagattcacacaggtatatatatgctacttggtcgccaagctaccgaacgtataaaatagagctttattaatctctgttcttatacgcatacgtgtaagaagagggacatcaattgcaatgcaatgcatatggtctcaatcaagacatgtaaatgtatttctaattagttgattggtgttcattgccctgggcatactgacttacagttttttttctcttggaggaatatatacattacgcgtttaatttggcactattttagactttcaggcgagtaagccgcgttggataaatacacacactttttttcttgacacggcaagcacttcgcagaaactacagggaaattttcatttcttctggctaatgatcagttgacttataaaataacacgcaggcagtacgtacgcttggtaattaagttcagtgaaatcatctttataaatacctattagagcttgctagatttaagaatctacttgtttcttcctcttaaaatctcaacttttccttgctatatatttcgaatatattcttgatcgcatacaatctgtgctttgaatttgttagagatcagggcggcttgattaagcaagattaattcattcaagattcaaccatgaggctgttcgaggagccaccggcgaagctcacccactgggctcacccggagcacgagctgacgctggccgccaccgccggggcgccgttccggtgcgacgggtgccaggagcccggcggcgacgggccgaggtacaggtgcgcgccgtgcaacttcgacctccacaccgactgcgccctcccgccggccaccctgcagcacccgctcctcttcaagggcggcggctgcaccttcgtcttcctacgagagccccccgggcccgccgccggcagccggtagtgggacacgtgcggcgacgacgtgcgcgggttcgtcttccactgcgccgaccgcgacctcgacctccacccgtgctgcgcgagcttgaaggaccgcatcgtcacggcgggggcggcgacggcgacggccgcgtcttcgagctcaccaagcggcgtcgtcgtcgtcgtcgcggcgccgctgcggcgtctgcggggacaagtcgcgcaggacgttctggttctaccgcggccgcttcgacggcgaggacgtgttcatccacgtggcgtgcgtgaaggagctccccgtgcgaaggtggaaggcgagctaccgccgccgcagcggcgccggccagatcgcgctcgccggcgcgccgctcatggagggcgccctgcagagcctgccaaggagaacgcggcggagcggcgggttcgagcggttcagcaagatcgtgggtgtcatcgtgagcgccataatcgccgtcatcttcgggaatccgatggggttgatcgccgcggtggccggccctgacggtcttctccgcgggtagaagacgagtggaaaacagtgtgctgctaattagcaacagtcaacgagtgcgtcacgtgtagagtgttcttctctatgatttttttttcttcgtataaacccgaatgttttatttttaatcttgtggtgggtttggaatattttgaacaaagattggttcgttcatttatgcatgtttcgaataatttcatttcatgttatcattgatgtactcttctatcctatttacagtttatggtaaagtttttttttcctaaggggcacattaccattcttcgccattcatatgctggacaaaatgttattttaggcgaatattcaggatgagataatatttcaaatctatattttttgagttgtacatagtaaaaataattttggataaggtgaagaaaatggtggttttttggtgttatgagctgaccatccaagaggagagagcgaggaaacgagaggacacagtattttctctgtaaaaaagaagaaatgatacggcatcaaagcaaatggaaatgagataaatcccaacatgcatttggaaagatacccaatcctttacatatgctcttgaaatttactcaatatcttccataccctaatttttttattggatcccttacacgcccctaccgtttaggtattcttcagatatgccagtgcatgcatgtgttagcttgttagtattttaaaaaattatgaaaatgctcataacaaccctaggtaacacatgttctcatctccgatctccaaatcatactctagcacatgcatagagacttcacatcacaatccgtgctttcttagttgtcgagttccgcttcctggcagcgacatcaactatacatcccgtcgcggcgaaggtccatatcccgttgtagccttggctcagcttcttgttgcgttggcggaggtttgcatccagttggtggcggtggtgattgagcatattgattgtgcaagaagacactgcctttggagaaaaacaatagatccccaaaccaaatctcactctcttgcggcttgggatattgtttgcagactaacgaatagaggatgtatgggtattatcaatttggaacatcagaacattgcacttcttatgaagcatcttgacaaatttttcaataagagaaatctcccctaggtcagatttctttggagcaaatattatcataacaaacccctccctccacaacctatgtatgaaaacggctcattttggtggaaagatatcttccagctaattcctctattcagggtaatctccactcttcaaatccatcaaggaaacatagctttattctagaaagaccattggggtaatgatatcctaaaatctagttcccatcactattttcatttgcaatcagtgaggacatatctgtctctgccttccatcaacaagatctctgataattttcaactacctctcaacactcaagcattgcaagagtttcaacttctggctataacgctagagagcgtcagctggtctgagcaagaggattcttggtcttacttttgggaaccaaagtttcaatcaaaaagagtctatgatatcttctattcaaacatcattccctccccagcaatcaccacaatctggaaaagtaagtgcactataaaaatcaaagtttttctatggctcctcctaatggaaagattaaatactagacttatgcttcaaaagaagaatcttaatattcctgatggacctgaatgcgttatgtcctctcataatcatcttgaagataccattcatctcttcttcacctgccaatttgcacatcaatgctggaattatctcaatatacattggaattccaatcttcaattcttcaacatgatactcatttccacgcaaagtttctttgtggaagtaattggtcactcttgttggaacatctggacttgcataaatgatttttttttttcttttataatatcccgatctctttccagtgtgggaagaatctctttaagagagattttgctctgcttgtgcatagagcaaatttgttagaccaaccagtttggaaatcatggcttgacactctattgtaattctctccctgtacatatgtatttgtaactttattattttaatatatcgcagtaggagtctctcgtgttgttttaactgtcaaaaaatagttggtggcggtggctccccttcccatcgtggttgtagctccgcatctgatcgacaacgacggcttctgtcgcagcggtggcttgccatcctgtcggtgctcgaggtccctttcccggcccccgaacgctcgagctctcgacgcccccactctccttcacatcgttgaggatcatccatccttggcaaggagcaggttgatttcttctcgtccttttcttcattacattgaaatcttcttcttccttaggtagtagtagtggataagcgagtcctcttgtattttggatattttcatgttcaatttgtgtaggtaagtgcaaacacttggatagaagagagagcgaattagaggcgaccatcccctttctttgcaagagaagttcactcagtgcactttaccgtcaagttggtgcaccacacatccgcatcgaatggaagattcaaggtctagaactattccttcatatcattctttggggtaattggcttaattagctatcatgaataagttttctatggtttatgagtatctaggattcaatttggttgatagatagattaattgataggcaactattatgctcatccacaggatggaatccttaactacatatctgttgaaaatcaaactaggtgagggatcagaaataagctagtgtggaatatgattggtttatgtcagtaaggtggtagactcaaatgcaatgttctgcaaagactttgttggtcatattatgaagttatatccatggagggctaaatgaaactgttatagttggctatgtgcatatggttcattgaagttctcatcatgtcacaactaactaactaggatatgatggaaatgattgaaaagtttgttgataccaaggtgattccattgattatccgtttgcatggtattaatgaaaatgttgatgagttcgatcaaccacactcttgttaaagtaagcgtagaagtgcttgatactcctcttttgagaacctcatctcaagtgaatttcagccaacctagcagcagcactaaccttctcatgcccttgtgccatccaacacatacttagaaaacccttatcctatggctaaacatgttggtgttgatgagcaaggcatgtacttagatgatggtgatgaggttgcagcatgttgtcatgctgagaaaactagacttcaaggggttgtcagtgaagaatccaagtatgaatcttaggatggacgtacatgaggataaatctcaggatggacttgaggatgaatctcaggatgattgtgtggatgaatcgatggtatcagatggaataccataacatcttcctacagcaacttatgataaaaacgatctaccaatgatagtagaaaacatatatcctaagatgaatgaatttagattgaaaatagtacaacacgcaatgaaaaggacaataggacaaggagcaatagctcaggttcaagtaaatcggataggcacttatactgcaccatccaatttatttacaactctctttgttcaagtctagatcacttaccgactccaaccaaccaacatgagccttctaacatgattgtagcactaccatgccttggaggataaacgctcctatttgcacctaaaatggctctaagagcaagacaaaggaaaggccaccacttgatattgttgctcctaacagcctagctatgagcacaaggagtaaaagtaagagccctacaatgagcactagaagtaaagaaaacttatggactaagtaaacaaaactatgggtataactagttgatttagttttcttttttactgtcaattaatttaacttgtgaactcttcaatatgctaatgcatttcctgaagagtgctaaagtgttagcaacttactcatattttgctactgtgaagattgtttgctattgtggtaatgtggtggtgtacttttatgagtcttgtgacattatgctcatcatttacaaagtaatggattttttgtgtgtgtatggtataatttgatttttctagctaatttggtttgtcaattgctcagctattgaaatggatttgtggtgggtgatggtatgaattgaattgttaatcttgtattgttgatggtgaataaatgtcttttcattttcttcctgttaatgggtgctatcgatgctcctaatatttttgtatggatgctccagatgaattgcattggtacttctcagatcaccaaaaagatccattgaatgctataaaaaagataataaatgcattaaaattctttttccacatttatattaaaaattttatgcattaattatttagtctcataaaacacataccgtgcagtcatgaatattttaatttttatcaagccaactgccaaacacacgctaaatttccaactctaaccccaacggtattatggtaactttcaaccaaattgaatagtgaacggaactaaatctaacggttgaggatcaaataaaaaattcagggtataaaaggcatcgagtaaattcagaggcatccaagagattgggtaacttatttaggggtacatagggaattttctcaatgcaaataagatatgttagatgatgagaccaaacatactgtgagaacgataagaaacacaaacaatgagcattgggcaaccaggcttgacctaaggctagaggatataagtcttggattacaaaacctacaccataaagatatatcttaattttcaacaaaagaaaattaagatcagcctgccagactaggtgaagctcctggcctagcccaaattaacgaaactaccaaaaagtttggtccaagttttttaattcaagattaacaaattttcttacctatattttctttagcgaaatatttcatccgtcccaaaataaatttacttttttacactatatttagattcaagtaagaaaaataatttattctaagacggatgtagcatatactagttatgtataggattcacaattacgacgaaatcaggccaattccacgaaacatcgagattctgatatggcttggaagttgttgccatctggaaattcgataggtttcatccaaattcaaatttgagttgataaataacgttaaaaatcaaatgaatccctataaatagtatgatattggttgaatatattgggatataattttttcaaaagaatggtgaattacattctttttgtgaactgtacagagaaaaaaaaaagataatgatttgggaaaaggaaaaaaaaaaggcctttcctaggagaaattccatgtaataggcccatttcgcacttagctagcccagttaacataatggagggatgatgtgacctgaagaatccctgatcgatcgatccctccataccccagtagctgaccgaagagaaggatgaggttaatgttgctttctacatgtggattgatgtttagaaatatttcccagttttctaacatttccctctatttttcacatttttgaataaataaataaatttggtattaattgtcggtttctcgacaaaaccaaccggttttcacttcggtcatgctttttaagttgtcatttagaatttcgttagtttctttgctactttcggtagcaccgatgatcggttttcaacgcaagatcagttgacctagaaaattcgaatacaaaactttgatttatcaattttgttcaaaatctgttggttttcgtcgggatttcaggaagaccgatgtcccaccagcacccgaaatggaaaggaagtcttggaaacagtccatccgagctgtagtagctagcgtgttctagtgaaatctccccgtgtaagacctcgattggaaacagtccatccgagctgtagtagcgagcgtgttttcgttatgtatgtcatccggactggatctatagaccgtgcattatattagtgcagttaatttattcctgacgcaacatatatataacttctccgtatatacttcctccgtattttaatgtatgacgccgttgagtttttaaccaatgtttaaccattcgttttattcaattttttgtgcaaatataaaaatatttatgttatgtttaaagaacattcgatgataaatgaagtcacaataaaataaataataattatatattttttttaataagacgaatggtcaaataatatattaaaaatcaacggcgtcttaccagctgtcgaccggtcggctttgctaacgaacaacgactactggactaccacagtacggccacacgcaagcaagcatacgcacgccagctgatccatcgctgatgcgcttgcactagcgtcatcaccgtatagcattattgtctactcagttttcatattataagacgttgtgatgtttcaagtttgatcaaatttataaaattctaacaacattttcgacaccgaacgaaatactatcaaaatatattagtttaatactatatttaattaaacttattagatgttacaaaagttacttatatttctctataaactttaattaaacttatagtagttcgattttaattaaagagtcaacacgcgtctttatactacataagaaagagagagaggaagttaatgtaacttatacgtaacgtacgttcatgttagttgctagtattgtcgtgttcatcctacattcctactatatatactcggtcaactctagatatgtggtgtgaactgtcatgttatatgctgcatgtggtggtcggatacgctaattgacctgactgtcatgtattatctgatcttgggtgccctacaaacaaaatggaacaaatccaggcatccagcaccgttgtaaaatgcccgttaatagagttaaaagggttatgtctatctttggtacgtgatgaacactcggcactaattcagtacttttttttccgtgggccaaggaaaaatggggctcagcgtgaaggaggagaataccgtaagagaagtacatatataggtcaactctttttaaatataaagcatggattccgaaaatgtaacatacttgggtcctcatatcaatccaaatgcattaaattaagagggactgtgtagggttagtgtatgagatgagactatgcatgaggcagcagatgttaattaacattttctttggaaagaaggaagcaataaaatggagaggaaaaaagtacggcaactggtggagaaaccatttatactcctggttagtaacccctttagtcccggtttttcaaccggaactatgaacctgggactaaatatgcccatctttagtcccggttgaaataaccgggactaaagataccttatcacaccaaccgggaataaagagagggtagcgttagtcccattaggtctcttttttttcattattttttagctagagtttaatccctatattttctcccaaatcaagtgggatacatatccccaaatcaaatctcaaatcaaagtaacatctcaaaatatttacgtcacaaatcttaagttacttatgcacacaaatcaaatacatcacaaatcttaaaaaaattacacacaaaccaaatacatcacagattatacatctcatatcatacaacaaatcacaaaattatacatcttagtgaatcacaaattgtaaaaaacaaaaaagatgccggcagcggctgccacctgtcgccgctcgccactgggcccgtgcgcggcctagccgaccgcctgttgcgtgggaagggaggaggggaggagagggccggggatgggagggaaaggggaggaggcggagggggaggaggagggagatcgatctgagagggaggaggggaggaggagagggagatcgatctgagcggatgggaagggaggatggggaggagaggcccggggatgggaggaggaaggggaggaggcggagggggagcaggagaggaggagagggagatcgatctgagaggataagtgcaaggcggttgtggaggagaggatagggaagaaggattatatattaagcgttgaattttagtcccggttggtattacaaacggggattaaaaatattctagatctttagtccgggttgataaccccaccgggaggtaaagttaggatttatagtcccaggagtaaagatcccaggggcctcacaaggcctgacaggtttagaactgggactaaacatggtctttagtcttggttggtgtcaccagccgggactaaagatcaaatatgtccactgtagccaccaaccgggactaaagatccggtttttagcggaactggaactattgtggattttggccgaccgaccaaagatggtttctccaccagctgccacggtgaaataaaatcaaataaaccaagcaaaaattacccatttcccccgtacaaaccaaacaattaattagccacaaaatcaaacaaaaaggcaaattattgtatatatacttcctccgtttcacaatgttagatttttttttctttcgttcatgttaatgaatctaggcatatacacatgtctagattcattaacttctatatgattacggacaatgctagaaaatcttaaaatctgaaacgaagggtgtacctaatatataaaaaacaatttgattgtaaaatcctgtcccatgaaatccatcacatcaactttacatgatcacaaaggcaaacacacccacgaatactctctctccgttctaaaaagaatccaaactaatatgagatgggatataatctatgtagaacgaaccttgatatgagcatatctagattcattgttttttttatggaggtaatacccgccaagaagtaattaacgtatcttgttccatcagttaccggccaacacaacactagaccagcactcagcttttctagccgtagacgacgttggagatgaaggctccgacgagaggcaccgccaatcccgttgggtccccgaacagcacgctgacgatgacggagatggcgaagttgaggaagcatttcaccgccttgccagtcctggaccgcttccgcttcttcatcgtcttctccaggatggagacgctgatgatgctcctgccgccaccatcgccgccgccgccgccgtggccagcagccaagatctcctgcaccatctccttcacgcacgccacgtgcaggtacatggcctcgccgtcgtagcacgagcggtaggtccagactttgcggcgcagcgtccgtgagcagctgcagccaccgtcgtgtcaaccggtataaaactctctgtcaaccttctcttttatcggaatatcacgtatgtcctgatatcagcattacttaaaattttttacatttatataaataatgttctagtacctttaaattaaatatttatactccattaaaagcctatagtggtggtagtgaattggatacccctattgctttggtaggtttacaaattgcccttgatattttctgatattgtggaatagctcaacatttagttcaaacaagtgaatataaatataatcaaataagcaaatatgtaacactaacctgttcttttctgcaacaaaagttggattaaattttagatactcgtggcacgcttttcaaactgctaaatggtatgtttcgtgtaaaaattttctatataaaagttgttctaaaatatcatattaatctatttttcaagtttaaaataattaaaactcaattaatcacacgttattacaacctcattttacgtgaaacacttaatcttcatcttcatcttcaggacattcaaacaccaagatatttgataaaaaaatattttgccatgatatattatgataattttattcttctagcttaaagcattggtattttacgaggttgtaaagttattggtaatcaaggctataaaattttaatcttaatcctattcaaaacatcaaaagttatgaaaccggaaggagtaggtccattgttttttccaccgaaaatcgcttccgtatttttgcacctgaaacggatccttcgtttacgcattagcgacgtgcgtgatacgcgaaagcagataacgaagctcgcagcaaactcgaaagaacacaatgcctcctcctgcccgacctcacgatgacgattcgcaagctcgtgctcgacctgaggccacacacaacgtacgtgcgccttctcctgcgcgagacgaccgtgcgtcgcagccttttcgctcattcgcgtgctcgcctccaataaaagagaagaaatataatgacaatatacggcaacatgtgtattcttccattgagtacccggtgttagacttgaacttgtcgactataacacattaacacctcaacccggacacgagcacggagccacagatgggcgaaagcgaaacagaggaaagcagagcagggcaactaggggcggaggcagcattttagcaagaataggactatagctataaattttttgtgtaaattctacctaaatttcagtgtttctccattaaaaatttttgccacgtgtggagcccaagcccaaactgccccacacgtggctccgcccctgagggcaacacacaatgcactaatactgaacacggagcttggcgtctcatccgcgaaacaaaattggcatattaatatgtatttttttttcttgatgaacatgacacaattttctgaattcaggaaaatagctactccctccgtttcataatttaagtcattctagcattttccacattcatattgatgttaatgaatctagacatatatatttatcaagattcattaacatcaatataaatacagaaaatgctagaatgacttacattgtaaaacggaggaagtatataggactgtaattggcaactgacatcaagtcaactacatactttgcgaccctacactcttttagctagcgaagacaacacagccaagcaatgcagtaatgcactagttaagtagttatccctaaagtgaatttattagcaaataaaattaatcttacggcattagactactaatagtatccggtttagtaagttttggataattgttaggtcaaactttaaaattttgaactataaataatttttaaaatatttgtctttcaaatagagacatatatttagattagtctcacaagcaattcaacaaaatcatatatctgttaaaaatattatatatattataatagaaaaaatagtgttcaaatttattttttttagagaccgtgctcttgtttaacagggcaatcagtattatcaaaccgaagagagtagcttgctagccgaagaaggggaagacgtggtagcggtcgtagagctcttcgaagacgtaggagacctggttgcgttcgtagagatcgcggagattgtcgtccttagggttgttgaggttccagagctccaccctgcgattgtcgccgctctcgaggtagtcgtagcgccatagcttgtagccgctgtcgtccagcacgacgaagtcgccgcacgcgccggcgaagtccaccggcctctcgcgctcgaacagcatgtggaagtagtagaagccgacgtcgtccaccgtcgcctcgtgcacgcgccgccacgccggagcggcgacgccgtcgtccgtcgtcatcacccacacgccgtgcacgcccacgccgccgtcgtgcggatacgggctgccgctctcgtcgctgtcgtcgcggacgtcgaacgcgcacatccggaggcgcccgccggtcgagcccagcgaccgctccgcccgcccgatggacccctccgccctcgcgggctcgcggaccacggtgactcggccgccggcgacgtcgtagcggaggatgcggccgcggttgcggcggtgggtcagccagtagaagcacccgccgacgtggatgcccggggacgcggggcccgccgccgacgctgcgtgccaagccctgggtcccctgttcgggcagctccttcgtctcccacctgccggtcggcgacgtgaaggtctcgacgaccacgcgccggtgcctgcagccgatgagcaccaccgtgaagtctagcctccccgtccccgacgacgcatcgtcgtcgaggtcgtcgtagtgaaggccggagttgatgccgtgttccggcgggagagtggatggcggaagctcgacccagcggttggccgccgggtcgcagacgtagtagcagctccggccgcgggccagcagaagacggccgtgcgccgcgacgatggagatgtccagcgccgggacggtgcgctcgaagaaggcgacgtggtcgtcgtcgtcgtcggcgtccacgacttccaaccccggtgccagatgatcggcaaatcgatcgggctcctgctccggcagcggttcgtcggcagctgaggcattcgggatgaagctgcggcggtggctctcgtgatacaagcgagtgggccgcttgtacttgttccggatggggacgtggacggcgagctcgtcggcggggtcgacggcgacgaggctgaggtgggtgaacccgagcttccgcggctggacgatgagggcgcgggggcgttcgccggcgagtggccgcggggagaggtggcggcagaggaacgtcggctgcgacaggatcgctcgccaccgcgggcacgcggcggcgaggcggtgcgctgctctggacgacaggctgcgcgagatgtctgatatgacggcgtcgtcgggtaggtgccgcccggcggcggcggcgacggcggcgacggcgcgagcaaatcgttggtaatctctcatggtgctatgctacaccaagctaggtctaagattagtttattcggaatgatatttagttaggttcggcccatttatccactggcccgatccataaattcgttggtaggccgtgttggacctgaacttggcgccctacacggctacgcctggacgcgagcacaaatgggtaaaagaaaaaaaaagaaaagttcacgttaggtcccttcatatgtcaccaagtgtgaaattcaaccctaaactgcaataacatatatgccgtgtctctcaactcctaaattcagtacaaataagattacaagatgtttggatagtggttttgattgatgtggcacttatagtcccaagaaaccataaaactcatatatccgcgactatccactatggaatccacgtcatcactcttgtttttttttccctcttctctcccttctttcttggggacctctgccctcctgctcgccaccaccggtcgacgccgcctctctccttcctcgatactccatagagaatgattcctcgttcccgatgggcgtcgcagatgtccccttgttggcttgttgccgacaacgacggtggcgtcgctgaggcaccagtcgcacatgccggcgctggccctccgccgggtccccatcactgtagtagttggtgaacagtgggtaagtttgttgattgcagcacgtacgagtgctggaagtggcggcggcgggcgcaacgagagagcttgttcagataaccgacatcgccgcaagaaggagacaattttgatacggttagagtgactgtgacagcggtgcagaccgtgtgagagaagtgacgacgaggagcaaagggagagagaggagcaaacggagacaagagggaaacagggtgatagagaggagcaaacgtagccaggagggaaacagggtgatgacgtgggtctcactataatttttttatttttaattaaatagttactgatacgtgggtctcacggtattttctaacttaaagtatcatgtcaatgccacataagcgtcacgtcagccgaaactactatctaaaccatcttaggattttatttgtactggttttagaagttgaggaacgcgtcacatattgcggtttagtgacaaattttatactcgatggtagattggggtacctgaagtgaacttattatgagagagagagagagagagagagagagagaagcagaggaaaacagagcagcgaacagatgggcctaaataaaacagaggaaaaacagagcagcgcacagatgggctaaggttaaacagaggaaaacagagcaaaccagagtgcagtgaaacggagcgagagatcccctgaaactggacaaattgacacacgattttgtgctgcaagaaccgcgcagcatttctgattttattcctctcacaaattataccaacaaaactgctatacaaaacaacaaatgatggtaaatccctagctaaaaacctatttgcgcgcgacgagctcaacgtcgacgacacgcatctaaactgacgctggcttctccaaacatggccatgcgcccaatcaatcaaatttaaacaaaaacgcatcctaaactcaaaaagtttaggggattattcaacaaatcaaacccctagtactcctattgccgaccatgatccctaaccggtggggaagactaaccccaccaccgccacggccatcgccgtcgggtcaccgaacaacacgccggcgatgacgcggaggacgaacacgacgatcttgaggagcttcttgagcttgctcctaggcctcccgttcttcttccgcagagccaccgccgcctgaaccggagccctgatcaccggcatgttccggccgccgccgccgccgtcggtgcggtggctgctgctgctgccggctctagagctctcgtaggccatcctcttcacgcacgccacgtgcaggtgcacggcctcgccgtcgaggtcgtcggagctgtacgtccagtagttgcggcggaggtgggggcggctcccctcctccgtgcagaggaggcaccgccggggagccgtgccgccggaggagagctcgaacgcggccccgccgagagcgacgcggcccggcaggtgcgcgcaacaagggtggaggtcgaggtcgcggtccaagcagtggtagacgaagccgcgcacgttgtcgccgcacgcgttgcagaccctgacgtcgccgtcgtcgggcgccgccgtcggcgggggctcgtgaaggagcacgaacgacgcggttccaccctttgacagcgcgcgcncccgcggcagnacgtccggcgccagcgcgcacggcgcgtgaaggtagaagtcgcacccggcctcctcgcactcgtaccgcgcgcagccggcgccgccgagctctttgcagccgtcgcacacgaacctccccgcccccgcgtcgtcggcggtgatcagtttcagcttgtgcgccgggtggaacgggtggccgcggatctccgccggcgccggcgcatccttgtcgctcttcaccttcatcggtgaggaagaaaggatggatcgtcaattcgaatccgtctgtctcactgcgctgctttctttggtggaatggtggcggcgcgagtcttcctgtttatttataggtttgcgcgcgccgccttaagccgcggagaacaagcggttgcgtaacactggcgcatgaccaacacgttctccttgcgcgccaagccacagcataagtaaagctcggggttgatctgctcacttaattcgagtacataatgcagtagcttaatccttaagcttgattagttactcatttaggagtactcacctattactggataggatataggaatattataatgatacaactataaagagaagcgggggttgatatctcgcgtgcgcgcaagatgcacacacgccagctggcgccctctcccccagcaacgcagtttttttttctattttagcgctacgtttcctctgcgcatttttctttttttaagtgttttttccgatttcttttaatcttcagcacacgtgtttttcaaatctctgagttaaaagttttcaaatttaagttgaaagtttctaaatttgagttgaaagttttttttaagtctaaattaaaagtttcaaatatagagttgaaagttttcaaatcttgacttggaagttttccggtctgaattgaaagtttcaattcaagagttgaaagttttcaaatctaagttgaaagttttcaaatcttgacttgaaagtttcaaatctagagttgaaagttttcatatctatgttgaaagtttttaaatttgagttgaaagttttccagtatgaattgaaagtttcaaatctagagttgaaagttttcaaatctacgttgaaagtttttaaatttgagttgaaagttttccagtctgaattaaaagtttcaaatctagagttgaaagttttcaaatttgagttaaaagtttccaatttgatttgaaaggttttttaaactttagatgaaaagttgaaagttttcaaatttaacttaaaaattcaaatttcgagttgaagttttgagtttagttatggcttttaattttttcatagaaagttttaaatttatttaaaggtttctttcatgtatagatttcattcaatctatcagtaaaaacaacttttgaaaaaacaaatcttaccttaattactgtcattagctaattagagtcattatctaagaatggttagttacgatagtatcgtcaagccgggaaaaaagataaggcgtagcggtgttggtctcgtgggtataaaacacgtgccgacaacacacgcgcgccaattagcttctctggacaaaagctatattatgggccagagggagtagttattgatttataaatattaaatttatatatatatttgtattacaaaacattttaaaaaaattaaccatatgctgaatgggttagttattcttccaatgggactattgtggcgacgacacagttaaagcaaaatttggtgagctataattgcaagaaaaaattatatggaggagtaaatttcgcataaaatacaaataattttatcagtctattataacactaaagatttaagaaatgtaatcataaaatagatattaatttaacatcaatcttattacaaaactactactttataacttaaaggaatatcaataatactcgacctaaactctaaaatacatagttctataataatattattactaaagctgtaattttgcgtgtttcaaaaaaaaagccgtaattttgtgatacaatatcttaaaatatagttttatgataaatttagtctaaatatgtagttttgtgatatatttatattttaatctaccttttttcttaagacacagattttatctttgttttcggttctcattatcacgcttttttaaactgctaaacgttatatttcgtgtgaaaattttctataaagaagttactctatctattctttaagtttaaaataattaaagtacaaactgatggtttgatagcggctcagctcatacaatctaaagagaaagatctttccgcactagcttacattgttaaggaggttaaacaccgagaaagggaaatagttataaagaagataccttggtcctagaaccaaacaagccatgttttagctaataaagcttgccctggacttttatctgaattttggttaggagaaacttgtaattttatttcacagttagttagttcacgaagactctttggtcgagtaatatatttctactcttccaaaaaaaagtttaaaataattaaaatttaatcaataatatgttaatagttttcttattgtacttaatttattttatctcctgtaaacttaaggggcttatattagggctgtgtttagttccacattaaaattgaaagtttgaagaaattagaacgatatgacggaaaagttgaaaaattatatgtatagaaaagttcgatgcgacggaaaagttgaatgtttaaagaaaaaagttagagtctaaacaggatcggcatgcacatacgttagttcggtcggtcgacgaacgtataaaccacgcagaggcagaagagcgcacgcggccgccgatccaccggaacaaaaaagcatattcgaccgacggattgatccatcgggcggccaagatggagaaagaagctagcgatgacgatgtccacgcaagatccgatttataatattattactgtccgcccacgcagcttaagcttagcttagctttgcgttgcttaatttgcgttgcccgccggcttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31049 - DNA, 1431 bp, Oryza sativa
ccaaagtttataaatcaaaagtttatatacccgattcaaatttgaatttgaaatatatccgattcaaatttgagtttgaattcaaatattttctatatatagtatttatttatatatgtaaagtttatacacctaaagtttataaacccaaagtttataagtcaaaagtttacatacccgattcaaatttgaatttgaattcaaatattagtttatagattcaaagtttataggtcaaaagtttacatacccgttccaattctaaatttaaatttaaatatttatggcgtagtacgaagagaaaaaagagaggagggagcgacggaggtaggggaggcggatctgatcgcttgggtgatcgcccattatgccccactataagggtcaccggcaacaaggaggcacgacgatacacagcaaggacaccaggaggagagggcaacgagctcgctagcagggtcaccatggtatggcgacgtcgttgaatacggccagcgcggggggagggactgagggagggggttgtcgggtcgatgatggcaatgggcgatggcatgtcaatggtctttgggtaagggcgtgcttggttcttggtgttgtaatgtcggaggtgacaacatagtcgggctgtgtacatccattaatagatgtagagaccggattttaatccattttctaaaaaaaaaacatagtcgggcggcggtacgacgaagcgagggtagcggagtgacgagacacgaggtttccaatggccttggggcttaggaaagaggatgttgaggcgctgaggttaggggccagaggggaggatggtggaggggtcagccaggctaggcaagcctcgggccgccgaggaatggcggctgaagtgcggcatcgacggcggtgcttaagcaaaacgcgacataacagtgaggatgagcggcgttggagcaccagtgctgcggtgcaaaggggaggaagagaagaagtgggccgtcatttatagatcaaggaggatgtatgaaaaaaaaacaagaaaagcaagcaagctagcagcccagcagcagcggcaggccttgggccttggttggcccatgcgagcaagtagcagcagcgctagctaagcaatccaaggcaggccatggttagcttagattagatggacaacggtttatgaggtgacacggccgttactagcaacaccgagtgcaaattcttttttgcctcaagcgagatgatgaaaacgcaatgtgttgcagtgtaggtgtgattcaactaaatgggttttagtccaatactgtttttgtgccttgggtgttatagaccttgcctttcacatcaaggcggtgaagataaaaattatggggaaaatgaagaggatataatagagaataaattgataatggacatagggaaacgaagatgagagaatggagaataaaaccccca

SEQ ID NO: 31050 - DNA, 521 bp, Oryza sativa
accttgggcttcctgttcggcgaaattgccctgcgccgccaacggagggccttcgccgcgtcggaaccggcctcgaaggggatggagtggtagaaccacttcgccatctaatggcgatcccacttcgacatggcggcgttcaccggccatagatcggagcgctcggggcgaacattaaagttcacgctcccgaacgccgttttctttgtcccggctggggtgaccactgtcttcgagttcacggtgccatagaacacggcgccgaaaagctcggcgctcggttcgaacctggcggtccggcacgcccagtcgaagatggtgactcggacaagtgccgatgggctcagctgggaaagctccacctggaaaagaagaaggatctccggcaacaaaacgttgcatggaaactgaagccccacctcaaaaaacacggcaaataccatcgtccggttgtcgccgtgtttcggcaccacggcctttcccggagcgaaggccttcccctccaccagcaggctggcgct

SEQ ID NO: 31051 - DNA, 1400 bp, Oryza sativa
tttatacccgaggtaggcagcctaaagccacgaaccaaactcatgctagaagtcctaatcaccctaggaaaccctctagtacaagaaacaaactttacataaccaatcataccaaatttggactccttccaaattcgactccgcatcccatacgcacacaatacctccatcgtatgccatatggaatcttcaccaaccatgtgcattgaactctaaccttagtatcccgcatgatctctgaccaccacggacgtcgtcttatccccaagccgactcccggtccatcaccgcaaatactctcccagcatctcgagtcacctacacatagaacaaacaaagaaaccaaaccatattccgagaccaagctatccccaacatgactcattagtagcaaacggcagtattacatacgcatagtatccatctagaagtcataacaatgaaaaaatcacagatatctaaataaacaacccgaaaccgaaaccgacacagcgtcggccggtcagaccatgggctgcgccggtctgaccgcgtgatacacgccggtctgaccggcaacccatgcccggtttgaccggacccaaatccagcagtacctgtagatcacctatgaaatagaatcatctccaaaaccacttcgcaaataaattccaaatcacaaaaccaataatctccaataccaattgttcatcacagaataataatcaaaaacacttttgattttacaatctcccccttgataaacacattggcaaacttatcaaaaatgttttggtgtttggaaaaataaaaacaaaagtggtaaaaagcacacttcatacaaacgtacacatcgtgctcaaaaatccaaaagaaaacttccctcacttttgaaaagaaagaaatttctaatcgaaccaaaaacaacatgctcttctcaactcatttgcttctccaaaaattttcaccttgcttctcccccttttgacaatgatttcatcaagcataggaattatgttcattaatgtttaagagcttagcatacatatagcatatcaagtcatgtgttgcaataaagagaagatgaacccatctataatataacaagcatgcattaaccatgaaccaaagattttacaattaagcttgaatcaactatcaaaattcatgatttcatatgatttataatgcaacatcttaacaagcacataggttgaaaaataaacactaaacacatataccaattgcattaatcacactttctcagatgagcttttgcacaaaacaaccaagagaatttttttaacgttttctttttcttgagcctttttgcccatatttttctcttttattcggggtacgtccctgtcgtcaagactgtttccaggaatttggtacccattattttgctcacatcgaat

SEQ ID NO: 31052 - DNA, 600 bp, Oryza sativa
ttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctacctaaggaggataacaaccactctaccccggcgagtttaagattcgatct

SEQ ID NO: 31053 - DNA, 669 bp, Oryza sativa
  unsure (1)..(669): unsure at all n locations
nnnnnnnnnnnnnnnnnnnnnnnnnnnnnnnnnnnnnnnnnnnnnnnnnnnnnnnnnnnnnnnnntgaatcatatatactacattattatttatggttatatttaatggtagctcacgatggttaatcgtgttatgataattaattggtaattaaaatatgattaatggtgggttgtaagcacatggttttgaaggtcgtgctcatggcaatgaaggaccggttcgcgagctactgttgtgaaacattaaccgtgccaaccacaagccagcgtgggcaacggctttaccttttgtatagcatagttcattgcggagcaccagactgagaagtggcggagataagcccacgggggtcgctggggagtccatgccctgttttataagggggtaattatgatccaggaatggtgcactgtggtgagttgtgttgtgcagagggtattgttacagcctctattcgggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31054 - DNA, 691 bp, Oryza sativa
  unsure (1)..(691): unsure at all n locations
nnnnnnnnnnnnnnnnnnnnnnnnnnnnnnnnnnnnnnnnnnnnnnnnnncgatgcgtcctaccaccagatccacatgaatccagccgacatctctaagacagccttcatcacaccattcgacaccttttgctacctcaggatgcctttcggcctgaggaacgccgaggcaaccttcgctaggctagtgtacaaggtcatttacaagcagttggggtgaaatgtggaggcttatgttgatgacatcgttgcgaaaagccacaaggctttcgaccatgcgtccgacttacaggggaccttcgacaacttacgcgcggcgggtatgaaactaaatcctgagaagtgtgtttttggtgttcgcatgggcaatttgttgggttttctcgtttctgaaagggatatcgaggcgaaccccgagaaaattgatgccattcagcaaatgaagcccccgtcgagcgtacgcgaaatacaaaagctcgcgggccgaattgcggcactcagtcgattcctctcaaaagcggccgaaagaggcttgcgtttcttcaagactctccggggcgcggaaaagtttacctggacacccgaatgcccagcaacgttcgacgagttgaaacaatatctgcagagtccacctgctttggtcagcccaccactaggaagcgaactggtactctacctagcaaactcgccgg

SEQ ID NO: 31055 - DNA, 1835 bp, Oryza sativa
ctggacataatattattggaaccaagtgggttttcaaaaataaacaaaatgaggatggtttgattgtgagaaataaagctagacttgttgctcaagattttacccaggttgagggtttggattttgttgaaacttttgctcctgttgctagaattgaggcaattagacttttgttggcttttcctgcttcaaaaggttttaaattgtatcaaatggatgtgaaaagtgcttttctaaatggtattatacaggaggaagtttatgtcaaacaaccaccaggttttgaaaatcctgattttcccaaccatgtttttaaattgtctaaagctttgtatggtttgaaacaagctcctagggcatggtatgataggcttaagaactttttgcttgtgaaaagtttttcaatgggaaaggttgacaaaacgctttttgttcttaagcatggtgataatcaactatttattcagatttatgtggatgatatcatctttgtttgttcgactcacgctttggttgtagattttactgagactatgcgcagcgaatttgagatgagcatgatgggtgagttatcgtactttttgggattgcaaattaagcaaacacctcaaggtatatttgtgcatcaaacgaagtatacaaaggatcttttgagaaggttcaagatggagaattgcaagccaatttcaacaccaattggttctacagctgtgttggatcctgatgaagatggtgaagctattgatcaaaaagagtatagaagtatgattgaatctttttgttgtatctaactgcttctaggctagacatacagtttgctgtgtgtttgtctgcacgctttcaagcttctcctcatgcttcacatcgtcaagcggtcaaacgaataatgaggtatttgaatcatacactcgagtttggaatttggtattctacttcatcttctatatgcttaagtggatattccgatgctgattttggcggttgtagaattgataggaaaagtactagtggaacatgtcattttcttggtacatcattgattgcatggtcttctaggaaacaatctagtgttgctcaatcaactgctgaatctgaatgtgttgctgctgctagttgttgttcccatattctttggctttaatctactttgaaagattatggtcttacttttgagaaagtacctctcttttgtgataatactagtactataaatattgctaagaattatgttcaacattcacgcacaaagcacattgatattcgtattcactttttgagggatcatgttgacaagggagatgttgaattctagtttttggacacaaagttgcaacttgctgatattttcactaaacctttggattctaatcgttttgcttttcttcgtggtgaattgggaataattcatccttttggcatgatttgagtgggagttttgtatcacatggttttatcaagcaacaatatgacaatgagaaaaattgagaaaagagagctttgatctatacatatggtattttcttgtgcatgctagcaatactttgaaggtttatttgtctctagcatagcttgtatgtattctagtctttttatgagacttagattttgtttttaagggagatgatgcatgacactttaattctatacttgaattaagctaatatgcaatgttgatgctagcatatggtttgatctataaatgctctacttatatgctttattgaattaattgctcgttgtgcaaagagaataaaaaatatgaaaaaaatgaataccgaatccttggaaacagtcttgacataaggacgtattcgatgtgagcaaaataatgggta

SEQ ID NO: 31056 - DNA, 28272 bp, Oryza sativa
  unsure (1)..(28272): unsure at all n locations
nnnnnnnnnnnnnnnnnnnnnnnnnnnnnnnnnnnnnnnnnnnnnnnnnnnnnnnnntgtaggacttctagcatgagtttggttcgtggctttaggctgcctacctcgggtataaatagagggggagcgtgaggcttcccggtatcgcttttgagagcaattgagttgatagttgagttagggtttcgagtttagtcgaaatttttgtaatgagtgctattggtgcactttgtaaacacagagagaatcaataaaattgtcatccactttaagagttcttcgatttatgtttcaccgggtttcggtggtctaaccagtggcgcaccggcggtcagaccggcggcatcatggcggtaagaccggcgggcacaaggcggtcacaccgggcggcagcgacagggagcggcagacgatctcagcggttcgaccggagttcgatctcggtcagaccggcgtgttccaggcggttagaccggtggaactacttcggtcagaccgcgatccgtcgaatttgagggtaacttttatttccactaaaagttttggtttttaggcatatcaaccattcacccccttctggttggcttagttgttgtgattcgatcctacattatatgtcacatcctgatttttgtttcaggatttataaattatttaataaattattattagaatttatattaaatgttcattaatttacaagtgaaattaaatgtgggagataaaatttcctaaagcatggatggatttaatttttattaaattctccatggttaattatactctctggaatattctcggatttttcggagctcaattcctaatttttaatcatacaaagagcatttcagtaattacccacatattaaattaaccattaaatggtctaattataattttgttaagtactttgagtgtcccagtattttcaggatttttcttgaaattatttgagcattggaagtatttttaacaattcaaagatcatttaagtgattattttaattggaaaagtaataaaattctcctcccttgtcttaggctgaatcggcccattcctttccttcctctctcttccgccggcccaacccgagcctgcatcctctcttcttctctcagccaaagtccggttttgctccctcttctaatcaggctgagaaaagaaaagcccggcaagaagtctactttccttccctgcactactgttcatcttccaactcaggcagagcccgagccagccgtgccgtgcacagtgccgccgcctcctccttccaaatctcgcctccccgttgctcctttttccaatttagttgaggggaaatattcctcttatcctcctctatctttaccccaaaaatcggagctaatcgttgagtatcttatccgaatcgaacctcgtttcgagtttatctccaaaaccgagtttttgatttcccggatcgatttcttgcgggaggagtccgatcttttcatttcttggctataaataggaccccctagtcctcctctttcgtttgccccactcccgtggtctcccgtgccccgtagcctctccgccgcncgccgccaaagttcgccgccgccgccggcccgaacttcggccccgtgtcgcgccgtcgctcttnncgccgttgccgcccggtcgccgtcaccgccgtaaggtgcgccgaaggtgtgggcaagctcggccgctccctcctcgctgtcgccggtcaccggagccccgtcgccgccgtcgaccgaagccgcgccgccgctagacctcgtcgccggccgtcgttgttcgtcgtttggttcgagggtgagtaccgttgggttcgtctcgtcgtcctctacgtgtacatgtcctccaaagtcgcatccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcaaaatcatgatctacatgtttgtttactttatatgtactgtttatgcttgttttttactgtttatttggtttttattagtctttttcttggttttgcgtgttagcctgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtaagcacatggttttgaaggtcgtgctcatggcaatgaaggaccggttcgcgagctactgttgtgaaacattaaccgtgccaaccacaagccagcgtgggcaacggctttaccttttgtatagcatagttcattgcggagcaccagactgagaagtggcggagataagcccacgggggtcgctggggagtccatgccctgttttataagggggtaattatgatccaggaatggtgcactgtggtgagttgtgttgtgcagagggtattgttacagcctctattcgggtactttccagtatcgcgacgcatggtagacatgatgttgaggctgtgtcttgtgggtacagtggtacacctctggccagagtaaaactattcgaatagccgtacccgcggttatgggcgggttgagcaatgtttttcgtgattagtctcacacctctcacaattattatggatgttatacctggtaataatttgcttagctcctggtttggagttagatctgtacagccgggtatggttgttcaggatggttgggcctgtgtagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtagcttgttgagtatgtcatatgctcattcttgcaataatcaatcaacctcagttgaagaaaaaggatccagaaggagaagacgtttggcttatactcattcttgcaataatcaatcaacctcagttgaagaaaaaggatccagaaggagaagacgtttgacttataccccagttgagctgcctgtgggagtggagctgaagctatcgctagaccgttattccgctgctgttttcttttcttttgtaagtgtgtaacgttattattatgatggatttgtatattaaattgtcagtttgtatacctcggctgatttctggacgaggattttatgcactaataagttcggaaattactagtgaatttccgggcgtgacattatataagcgtacgtgtgccctggtcgtcgccatacgtacgtaggcgccgcctccctgcgcgttgtcttatatacaatcattccatagatcccccgtcaaatttggttgctgaagggtgaactaatgccagattctacaccaaaaacactactgtggcttccaagatcgaagtcaacattactgtgtggctgctttgattaactcgatcatgagtcaatggaccatgcatgttcgcattgcaaaatcacactgtatatccgatcgaactatatatatatctgacatacacaaagcttagttaatggactcatgaaatttcaaccattaatatttttcaaatacttctcaaaaaaaaaaactttcaaatactgttttaaaatgaaagaatgcatgcataaaatttatctaataaatacatgtgataatatcatagaccgcgtggtcaaatttataagtcctaaaaataccatacaattgattactggggcaaagctgtcttaaatacggcacatgcgcccatgcatggatgcctcatgcctcgacggtagtacttagctactaggttactataaaagtgagcgtctcttgccgaattcctctgacaaatagagtggatgaaacaatagttgtagctgtcacacaaattagatagcaaggaagcgcacaacgtacgtacgatcaatatggtggccgcagcatctccatccatgtatggcggcactctccaaccatggttgtgcagaaggagcagcactactggaacaccaagaccatcaatcacaaggcctaatgcgactgatcatttcaccaaatgtatcacatccaatgtaagaacgacctcccctcctctaatggtgatcctattttaattgcgttgtcgatatatatacttgcagccacatttcaaggagtttcagcagcagcttaccaccaaacttggggaggcatctgcgccagtaaccatggcttccagtctattgctggatgcgtttgtggactccaccttcacattcagtcaccaatctttgcgtcccaccgaggtacatatatatgtgtgtataattattataagtatacgttctttctcctactctctttcaggggcttgaatttgtcttctttgcccagttcgctctgataatcgtagaaattaggtgaatcccgggtattgctacgggaatttactataataacaatgagtcaaaataatgcgtaagatgactagatagtataaacttacataagttgatggggtttatgatattttaaatttaaataatactccctctgtcccaaaatataaacatttttagaatagtgccaagtcaaactttttaaatattgactattaatagcaaaaaaactaaaaagattaatcatataaatttgatgttactatatttatcattaaatgaactatcataatatgcaactctttttatttaaaacattttacttccatagatattgttaatcaaagtagtatctcggagaccgtgtcgagacccaaaaatgtttatattttgggacggaaggagtatacagaatgatgatttaaatgtaaaagtaaagtgatgtggctttatgagagaaaaaaatgagggagatagtttggactgtagattaatcaactaaggctaaaaacaactgaggtgatattacttaatgagagaagagagaaataacattaattaactaagtaaggatgaactatataggtatatatgatattacaaaaatgatgaagagatatattaaaatattatgtgaaatatatgggatgatgctttaacatgcttgcattttaaaactctaaaataaaattaatgatagaattatagataatatagcatgcttgcatgatgtttaaatataataattgttagtggatgatgatgttgtatcttgttattgcatgatgatgtgccatctttacatgttaagtttttaaatttagtgggttataactttatagtaagattattgtataatgttgtgatatctttgtatgttaagatttaggatttagtgggttataattttatggtaagataggattccctaatgcattgcagcagtcacgacatatgaagtggcataggtcagcgcatatgttcgaaattgtttgtttgttgaaccggtttgctacataaggattatttgagggatctgtgaaaaaaaacgaagacaatgaaagtcaggaaatgaaatgtgactaaataatctatgtagagaacaatctccggacttacgttattgttgtttgttgtgcatctcctgttgaccctaagcatcttgcacacttaatatccacataggttagtgcctagggttgcttgaaacacaacaaacatgataataacaccagtcagtttaaaaatagtaatgattacaacaatttgtgtgcatggcacacgccattacataccggccagtccgtcttcacatgaagctttttcctctgcacatcctttactggcctgtgatgtttgacataaaatttacgtgctctgtgccgataaaacatttatttgtgttactttcaaatttcggaacggcaattaggtactgaggtggtatgttactacgttgaaattcgaaatagtgaggaactccatataggctttcttggatagtgtgccagatcaagcgcgacgaccaagtggtccctcggatataccgggaataaaatatagtggtcctgcaaacaagatagatgaattagagatgacatttgctagttatcttgtattacaagaaaaaaaataatcaaatggaagagatgctgcttatataagagcgtaagggaccattatgatgtttttgtctcagtgcatgagaattgcggttcccaagtagcaagctacttcaatcttcttccttgtgcaatttcttgatatatgcttgtgttcctccggtgtcttatctgttagttccgggctattagcaagaagctgtacagtttgttgtgtggcctgcaaatccttgttggctcgatatagccaacgagttgcctcgctctttctgtgtcgtagaactgtgacctatggaatgcagcttgattgaaaaggaagtttctttcacacatttcacttacaacaaactagtgtaaaaacacttacacgcaaaatgcaacaacgagattgatgtccatcttatcgagcttgaagagggcgtgtaggtcccggaaattgatgataaagatctcattggttttactcatgaaatcgtctcgtgggaccttgacactaatgaagcttagggcctttctagataccttgaggtaccattcatgcatcaccctcatctgtcgtggtagattattcataatgtaccatggtaagaatgacttgtcatatttatattcttggggcacatctacagatagccaagattgcaactcatccttggcccatactactgacttctaggaattttacagctcagcaacatcttctttcttcttctttgcccaacctctcccactgaagattgaaaacaggaacctctctttatctcttgacatttccttgtggtcgtacatggaaaccaattttcgtatgagcctgcgatgttcaagggtagtagaaatggggccagattgatttacttggtgaggtgggacttgttgggcgagagcaaattgtggtgtaggaggagattaattggtgaatgggagatggttgttcggtaggtggcgaagggggagggcaagggacttgagcagaaggtgtaggtggagaacgtgaatgatgtggtgacgttaccggaggaatcgaaactggtagggatggtggatggtgtggtgaccttactagaggcaagaaagcttgtggggaaggtgatcctagcggggaggtcggtgcaagagcggcaactgtcattggttgggatggagctagggcagatggtggttgtccggcaaggatgatgtctcgatgatgccacaagacaaactggttcattgcatctcccaaaagttcgatcccctctggtttagggatgtctagctcgaacgtgacatgttcagcgtggaccttagctacctgcacccttgcatggtcgtctagaatgggggtgttgtggaattgtcgtataatcacagtatctggattatcccatgctgcccatcaatcgcccccacgagagtggtttttgcatgcgggagcacttatgggctgcctacaacctattgtgggttttgtatagaaaaaaaatcaaatctgcagtagtgggaccgccaatgaaaatcgattatcgccggctgtcacttaaggggtctacttataaatatagggctatttttacaagcatgtttgttatattcccatcgatggaaaccaattttcgaggatcgcctgctgaagagcaccgcctgaaaaaagaaatcataatattaaattgttttgaaccttttttttttaatttagaggtatagtagaggggagaacacttcagattccaattaattttcatcacatgcttttgaactccctgtttcttagaaaaccacccatcaactaaaaaaatagatattttacagctttccattaccataaccggatgaaatagaatacaacctgattttaatggtaatattcatgatttgaaatccaaatagtacgataaaaaaaccaagttagacagataggtagaaagtggtttaatataagtcaaaaaatatatattttgttgtgaaaatcatgaaaaccgctactaaaactgggtgtataatatcattacatttatggttgaattttgacttgttttaatagttgaaggcctaggggttataaaatatctgattttgtagttaatggatgtttcttatattattagacaaatccaatagttaaggggtgtagtttggactatcggaaaaatggctgaattgcaagtgctaatttatatgatggatctatccatgagcagagcaatttcgcaccagttgatgaaatcggtggaagaacagagatatggaggatagaagggacgatctcagatgattttcctgagggtgtttatatcagaaatggtaattttctttcaatctttcattagcaactagcaagctagcgaaaactattgtagtttaagcccttaactcttgacttttgtgctacgtcagttatgtgctcagatgctagttcacagtattacttttcacaatgctattattaggttcgcaaagtttgatcttaatttgctctagttctgaatagattaaaactcaaccaatataatgcaggttccaaccctctctttggagccttgcacaaggtgaactcaatcttcggccagtctgaagacatctgggtcgagggagaaggcatgctgcatgccctctacttcaccaagagcagagaaggaaacacttggtcagtctcatacaacaaccgctacgtgcaatctgacacttttaatactgaaagggatcgtcagagaccatgcttcctctcagcaatcaagggtgaccctcttgccataatcgcagccagcattttgaacatggtttgtaaataacttgcaccctctgtttttgtcggcaaggaactttttactactcttgtctctatcaaaatataattattactttaagtagctagaatgaatatagagtttacaataaagagaaactccctctatttgaaaatattatgtgtaacagccttttacacggtctccagccttattcttattcttcaactactaattttgtttataatatattattaatagtaacaaaattaacatcggatgaaaatacattcaaatacaaatctaatggcactatatgcatgacacaatacagatatattaattgttagctcaataattagtcaaaattttaattgttgactttatggaaaacaagaatatcccatattttagaacggaggaagtaatacatattagtttgctacacggtatacaatattatagttttaccattggcttctttcataatatattacaaacaagtatggacggagttgacatcataagaaaaatattttcaaatgttgatttctgttttgaaaatagggatgccacagggagtatgagttaaaacttccatgcttctcatacttcttatagatagctgaagtgacatggttagtgagattcttctgataaatgcaggagagaggccatgtaatatccatgtccaaacattgaacatattcaacaaactcatggtgcaagacttcaattttgcaggaagattgaaaaaattacaggtcttataaaaacaaacacggagtattttctatgttgacaaacatttgcaacttcacaatttcaattttgtcctctttgattttcgcccttgatccactaccacacatctctagtgaaccatagtaccctctgggtcataaagatttgataatagcattttcttctgttctagtgtcatatgctaaggcaccgtagttacgtagtgttcaagtgacactgatcattaattgcatatcttgctgtagctgaggtttggcaaggtgtttagaaacatgagtaataccggtgtgtttgagcacgccgagagggttttctcagtggcagagaatgacattccctacgagattgacttggacaatcttggcacactgtgtagctgggtcgtcgatggtcagtggaacatgccattcacagcacaccccaaggttggtccctctgcatatgcctctctgcctcttaaacatgtgaatctgaatacatgaagattatgtatcagtttgttttattcttggttaattgttccatattcaccagcattttctacagaagacttgccttctactatctcttttcagttttgttttgcgttgcttttggctataagtctcaacatctgtttgtcttccattttgatgaaatttacaagcacattactatcttaagagcaggagagaaagaaatttgaaaaaaaaggtagagagataatttaagcttatcaactagtggaaaaaaggtcaatagtgcagcacttgttttttcttgaaaagtgccattcacagattgacctaccttgacaaacatggtaaagaactggcttatagttttgtcaccttttaccattttattaatgctaaattcagcagttcttggagtatttaatatgttaggccaacatctagcataaaatgtatgcttgtgctaagaatatgagtgaccatgggaaacgttgggatgcttaattataattatttgatttgtacattaattctatttcatgttaccttattgcatccaatttttctatgggcgcaggtagccccagggtcaggagagttagtcatatatgggtttaacattgtgaagcccttcctaactattggagttgtctcaggtttggtagctctgtaatctcaattctttttctgcatatccttttaccaaaaaaaagtactaagtacatttgatcacgccaaacacattctgtagaggatggaaagaaacttgaacggaaggttgatctcaagctagaaagatgtacatattgccatgaaattggggtcactaaaatgtaagttcaatgccactaccaactgtttttcaaacaaaaaaacatgttttcttgttttatctatatcaaaatttggcactagttctatattacaatagttcaccaaacatataaaaaagcatattgaccatcatataccatgatgtagccaagtgattgcagtgccctgagtaacaccctaaggtcctgagttcaaatctttgtaagagtgaattttatattggcttgtttgaggggataagttccaaatttaaaaggctgcatatatccggttggaaataaaggccgggtaaaaattacccttctctgaaaaaatagtataccatgacagataaaacttctccaaaagctactagcccatatttaattaatgttaagtaataattgctaatactaaagtattaatctcgccgttttaaaataaaagacatattttgtttcttacgataggctttgaccaacaattattctattacgatataattttaatgatacaattatatttattattagatttgtattcaaaagtatttaattattattatgcttttgtatcatttaaatgatatcataatatagtaatctacatatgtgaaagcaacaagctttctaaaaccaataagccacgtcatgtgaagaataatagccttaggatgagaggaggaataaaattggaccgttggatccatttgtgtataccaatcacacatcaggaaagttccagatgaatagctcctgtgcatccatcggtgcacaccggtgcatatacagatagtttcagatggagaacaccagcagctcgtctcattcacccgcagcgacagtatataaaatttatcctactttacatattccttcatctcaattaactacaaccattatctttttaatttcttcatatacttctttatctcaatcaaccataaccttcacactttctatcaaaaataaaaataaaacacaaccctcgcatttaattttattgccctctccttaatcccttcaaaaaagcataaaggtagctactctctatctgcaaatataagcatcacaaatatttataatttattcaaaaatataaggatttatagattaacttaccttcaatctcactttccattcaattttttttatcctactctcaacttttttctaaactcctatcattcctcggtaaagggatataaagttttatatgatcaaacataatctttgttaaacaatatagaaatccttatatttgagaacagagagaatagtctcatagaaattattccgtaattatcaagatcggtcgtcaactcctatacagcgctcagagtcacgcgaagcgtgactgggtggctagttgttagtgaaagtctcatcctaacaaaacaaaatgcgccttataatttgaaacgaggaagtaacaactcatttgccagtgaccagtaacttggtaataatttcgttcgcacaaacaaaacatggcagcttgatatatgttaataaatgaactagaattagttgaaagctatcttatttaagagtgtgtgtaatcaaattagtacgcacgcacatttttgacctaacgagcatcccgttacgagctatgatatgttgtctgcatatatgttgttccgggaaatctagcttaactagtgcactgttctacttcatcaagcaagtaaaatatatatatattcctaccacataagcttcaattttttctaagatccgattacactgttgtgttcgttgcaattaaatctttataaaagatatcacatgattatattttgatgaaaaattacaaattaattatataacatatctagttacttttagactccattaaattactttttagacatctagaagtaaattcaataaagtataaaaataatttgcatatattacaaaagtaacttaagagaaaattttgttttagtttaggtgttaggaatcgtttccttattacaagaatgtatattcctgcgtaggaaagatatattccatccattccatattgatcatcatataaccaaaactcaaaaattccaaattgatcatcatataaccttggccccttcacttcacatgtagtattactgcatttatgcatgtaaattgactttaacatttatgatgatcaatatggaacatagaggtcctgtttaaatcccctgacaaaattttacactctgtcacatcaaatgtttagacacatgaatggagtattaaatataaacaaaaaaaactaattacacagattgcgtgtaaattgcgagacgaatcttttaatcctaattacgccatgatttgacaatgtggtactaaagtaaacatttgctaatgatgatggattaattaggcttaataaattcgtctcacggtttacggacggattctctaatttgttttgttattagactacgtttaatacttcaaatgtgtgtccgtatatctgatgtgacacgccaaaactttacacccctggatccgatgtggcggtttacgccaaaactttatagcaagagagtacatattaactttagcatttgtgaggatgatatgtggttaacactaattagtgcacatgcactctgtagtcccgtccttcagagtgcatgacttccatttagatagacctatatcttaaatggttcaaatgcacttgtgaaacatcataggaatgaatgggtcatttgatttcttaagtaactaagagaatttgattaattaactgccttatgccctatgtctattcatctggagtgttagatatcaacaccacacataaaaacttttttagtctaaaatctaaaattgattaaaaaccatggcaaagttctatttatatttatagacacgcacgatagcaattataagaatatttaaacacaccagcatcaatgaatatggtaccatcaacaacatcctagaagtatcaggaacaaccataataacataaacatgaagtaaactatccaaatataatgaaaccaagttaatctaatcttacaaactaagtttaattttcatatgtgcataagtgtatcgatgttgggtgctattcccgtccttgcatgctggtgtcacgtgatacctaaaaaccaaataaagcacaaagatgagtataaaatactcagcaagattatatggaactagaaaatgtgtacggaataatttataaaaaagagcgagtcggaaactatttttattttacgcgaatatcattttagcatttactggttaacctgagtattaggttcaatgtaactcaggtgtcatgaataaagaaccaaattacagttccgtggctatgcgtggcacttgatattaaaccaaaaaaagagcagaatcatgaaacatgaatatataacatgattgataagatgaaaccaaattcaagattacacgtaatcacatgaataattacaacataataaaagtgaaacaattaaattaaactagttcacgcatcatatacaaatagttaccgtgcacttgccttaaccttagtggtaacttggtatcagaatcctccaaacaaaaagaacgaaataacatgcatctaaattaaaaaaaaaactgcaatgctagtaaataaacaacacactaatttcttgatataatttttaaaaccccaaaacatagaaatttatttatgaactacctaaacccttgcttgctcgctattctagcaattgcttttataccattaaacaaaagaaaacattaagtacatctggagcatctatagaagagtacctgcaactttcatgttatgcaaatgacctagttatgtgtttataattatcaaaatgaaataaaaggattgctgcaccagttttcttaccatgttagcaaaattttagcaattacttacaaataaccgatctaaaataaatgaaacaagtgccattagaaaaatatgactgatacctacaacttttatttagaacataaaacttatttcttgatagatcaatcccagattacaatgttttgtttcatcttaccaatcaaaaggttaaatttgaagcgcccactattaaacttgaattgtatttaaaattgatacatctagcctaatttcaaccgaaaaccttatattgaacacaactctccaaactatctacctctactcctcttctcttcattttcttcttcccctgtgcttctctgcttggtggattggctcacagtaacatatagaggaattggaaagaagtagcaactcagcgcagcagtagtggcattggatggacagcagtcagcaggttgatgaggcggtggtgacagtggctgcaaatacaatacaatacaatgcaatacaatacaatacaatacaatacaatacaatataatacaacataatacaatacaatacaatgtagaaacaatttggaaatgcaaaataagataactacatttgcatcaaaagtatgattaatccgttcttccatatgtaggtacaatattatcatggatatgcctcttacagtggaccttactaggattctaagaggagctccgtgagtacctatgttagacatactattgttgagacaacaatcttccatgtttctaacatattaattatataacattctataggttgattgattttgaaacagaaagttatgcaagaattggagtcatgccccgtcatggagatgcagattcagtaatatggttcgatgtagaaccattttgcacattgcatctcatcaattgctttgaggaagatcatgaggtagcgtatcaagtggttgttgtatagtgctttttctatcgacatgaagctgtgttgcacaattgaactgctacactaaaatgtatgctccaagagattagcagttatttgaattggatgattagatcatagaggccattttgtcagtaaacaagtggttgtggtatgtttttttttatcataatacacattaaaaatcaagagcctttttgtcacactcagtgaagaaacaatcaaattgctgaagtgtttgaatgatttggtcaagatcaaatccatgtagagtaaatgtgcaaacactttcaaaatataatttggcgttgtttaattttttattattaggttgtcatcagaggatttcgagtgccgggttccataattactggcataacacttgagcacacggctaatgaagagccagctaatcaaggacccagtgagaaatcttttcctcgcttatatgagtggagattaaacatgaaaagcagggctgtcacaggtaaatacttaactgggacagatgttgctctggaattcccagtgatcaataacaaatatgctggcctgcatcacaagtatgcatatgcacaagtgattgatgtccaagggagcctggaaggtggctgtggaacaggtattttctcagcaaagattgcatttgtcttaaatatattcagcactaagttgaactgacaaaattaagttaaacagtttatttgctgattaggataaaaaatttcaacaaggaaaatataatgaaaatgtacaataacatttctgccgcataacctaaatattgcatatcatgtcggatctaccatatctaagggtatattaaaaaaactgaccaagaaggatatattcaactattcatcatgtgctaactttactttcgttttatgtagtgcgaccaaaatttggaggtttcgcaaaactacatcttcaagataacaacaaggtagtatatatatatatatatataagaaaacaatgtctttgtcttgctgctttcttttttgaaatatcttataacatcatggtttgcaactcttgagatagtttggtggagatctaataaatgtggagtatcatcatcttggtaaaaatcagttttgctcgggagcaacttttgttccaaaggtcaatggagcaaatgaagatgatggatggataatttcctttgtacatgacgaggaaataaacacttcacaggcgagctctctagaatcatctttcttctattatatgtgctaaactatcgtgactgttctgtctagaaaattagataaaataaaattcaaaattacttttgatattcgaactagcatgttaattacaacattctttatattcttgacattacattacaatgcatgttattcccatatataatcatttttactccctactcaccagtacaaaacccctagtaaatgccgattggcaatccttcataggtgtcagatttgacaaccgacgacaccaactcacaaaccggaaagcttgataagaaaattaaaagaataacttataacccatcagcgggtatatattattaatgattaaactgtgattctttaactttacaggcacatgtcattgatgctcagagatttgaaaatggaccaattgctaagataacattgccacaaagagtaccctatggctttcatggcacattcatcccaagaactacatacaagaagacatgactcttgtataagcatataaattactgccaaacttttggcgataatccatacctataggcacattttctgacaattcgatatggcttatgatattacaaatactgtgattaatcttgtgtcctttattactacatctgtaagtgttttgtagctttgtacgcaataaattaggattacacccttcctaatatcagtaacaatcttagtgcactgtgaaaacagacaaatttcaaaggtgtctggattacgactaccgcctctaaaagtaagttccaccggtggtttcgtgatgcaggtccctcctgacttactgcaatggcagatttccttatggaccgtagcatatgtgcagtaaaaggattctctgcgaaaataatttttttacttgtgatatgattcctgctctgtgattggttcctcgcgcgacgtcttcccaaggagccgcgccgcgcggcgcgctgtcctgccgccccgcgcgcgcgcgcgtctccgcagctcgtcgcttcgtcggcgtcgcgccaatgcaaagcgcgacacggcagcgcagctgcgctccatgcgcgcccgtcacacgctgcgcgcgtgtcatcccagcgcgatgtcatgggccgagcgtcatctgatcatcctacgccctgcgcgccgccacgctcgccgccggtgcttcgcacccatgcccacatgctcgtcgtcgcaatgctattcaggcaagcaaagccagcgcgctacccgcccacggcctcagcacattaaggcctccatcgattcataggaaaaaatggaggaaaaacataggatcaataatcctatgggatttggtactgttcatccctttgatttgtaggaattgaatataggaaatgcatgggaaaatttcctatgaccatgattttaagggaattccataggaaaattaacatccaccttgagctcatttttcttttcctatgagtaggatcgaggcaaaacactattgaaagacaatgtttaccctcataaaaccattcaaattttgatggctattaacttaatacttaacattcctatgtttttcctttgtatcaatcaaacgatcgttcctataattttcccatgtttttcaaccattagttttacctatgatttcctatactattcctgagtttttttttgttcctacattttttcaatcctatgatttaaaggagccctaagtatatttgatgcgcacagatttcacaatttactaaattggtaaagataacattatcataaagagtatcctacggttttcatggaacattcatatatcaagaaataaataagaattgtataatatatttactgccgaggtgacatgtacggtacaagaattgtaagctcccgcgtcttaatacattctggccggctttcagccggtccggcgaagatacaacaactgtgattattttaagtcaataattcgtgacggcactatcatccttacggctccttttcgctatatatttttgttgttcttttgtttttaattaattagcatattagcatttcaaacgaatgcaatttaacgcagtggtaaacataaaacgagacagcctcttggattactactctctgcaaagtacagatacactccttagataaagaaacgaaaaatgccaggaataatgtgcagagcgtggtgaatgcttacgtcgttcgagtgcaaaactgcaaatttcacgctttttttccatgagccctaggaggctagctaggagcagctcttccggttcagtgccaggaaaaaggatttggaaattaactctatgtgccttgtaggattcgatcagcaacttaaatcttcatgtgaaggctacatgatgtatgttcttaaatcttaattaactacaaaacgaagaccaccacagttacagcttaaggatgtaaattgccgagcatacctagctatcacaagacagatgctagcttgcctgaaattggttttgcttcttaaactgattaaaggccacacagacttaggttgttactaaggtatcagtcaactggtcttggcatggcagaagcaacttcactggtgatgcatggggcaagaatgttgattctaaacccttgtgtcgtacgtgaccacctgagtttcctgatactgatggctgatagcacttggaacaatggcaaactcttttaatcacccgaatgaacatcccctcattttgttcaacgaaatgattatattttttttaaaaaaatatagataacaccccgagttaaatattatgtaagcttatttcaaatgacatcgtgaaatatttagttggatggggtctcgataaaatctaaataaaatggtaaccatccaacttcatcgatgccctatcaaatcaaaaagctaacacgttatgaaacccgaagcctcaagtacagagcataggagatattactaggactactaggactcaacgtgctagtcaaccgtcaaaccacacgaaggtggcgaccaggttacacatctcaagagacatgaaaaaataagctagagttctacaacatcgcaaatgctctaaacacatactcatgtgaagctagttcccaggttaatgtcacacccagagttttccctttccttaggttccaattcactaataaatagtctatagaaattactttggttaaccaggagaaaaccctaattaacaatatatttaataatcggaattgccagaggaaattttttttcaaattctatttgctctaaaaatgactaaccggacttaaagcggaattcatagagcaccggaggtaatgttgctaagtttaaaaatgtcaagatcacattaataataattcttccttttgcctttggtcatgaattgtgcccaattcactgccttctcagtccgcggtttcattttgcatgatcaaccgtgtccgtttttgttcgcgggaccgtttcctttcctttcctagaacggtgccgcagttgttttcctttttagggaagtccttataacaccccgattttcgttcggcattacaaatcaattaatagtacattttctagaagttaaataaaagttaaagtaatttaatcaagtgaattattaagggaattaaaaaaatttccttaaaaatcatggccggaaatatttttgtaatattctctgtgccctaatatattctctgaaatttcccgtgaattttcggagctcaagaagtaaatttttaaagtcacaaaattcaattaatcaattaaattaaatgaaaaaccaattaaatttcccctccttcctttgggcccctaccggcccaaatccctccctctctctccttggcttgtttccccctccctcctttcctccttcctttcgggctgtcctctctccctcggcccacgccctcggcccacgaagtctactttgcctccctcctcctccctcctcggtgaggttggggcggaacttcgggggccaccggacgtttcggagactcgccacaaaggccttgcacccagccccaccggacgggggcgtggggggccggccgcctcgcgcggggtggcgcgacactcctgataaggaggcgccttcccccgcgcagggagcgcggcgctcatccctgtgacgcttgatgttgattcgggcgtcctgttccccgtaaagactatcgtaacgccctcggcttttcgagggccttgacaacgtcggggttgtcgatcgccgtgagatcatggctgaccgacaagccctcctcctcgccgatgaggagagggcagtagaggtacgtgaggtaccacccgttaagggccagccgttagtggccagctgccgctgtgcggctacgaccaagttggccacatcatccagccaccgctggaccggggtcttcggctctagaacgacgggagggtgccgtaggagagcctccacggcctggagcgcgccttggggcgtgccgccgtcgtcgtaggtgaggcggcggtgtaccccggcgcggcgcgcccttcccccatcagccggcagggaaagggccgaacctcctaaccggttggggtccttccgccgtctggggcttcgcgaggaggggtcggagagtcccggcggtggtggcggggattacgactcccgctaccgtcctcacttccggacggagtgggagtgtacaccaccacttcttcctccactacctcgaccatggtcgttgaggatggaaggaaacttggggcggaagaaaaacggctccttcacaaacgcgcgggatttcccctaccttgcgcgccagctgtcgaggagtgaccatctctagcgggaggacgtgagaccccccctttgtgagttcggccagaggattaggcgtgatgatcaggagcgctatctctacttagcgaatcggattcgctcggggctaagctcgcaaagtggatggtatccagacggggacgagagattacccaggtttgggttgctatgaagcgtaataccctactcctatatatgggttgatcttcgagaagttacaaggaatccaaatctcagggaaaacaactagggtttttctagtctcttcctagagctagagttcttaagagtcgtcctttgctcgctgggcaaggtcctccatttatagttcaaggagataccacatacaccgccgctacggtccctaccttggagaggggcccacatcggtctgggttgaacagcttcccaatcctttggccggaagtgaagtgtgcgctcgtcctcaggtggtccctagcgaagtccttcgcctgacacgggggacatcccctatcattccctcatacatttttggagacttcgtgggttcacgcgcgtggggtgcaccgacctgcacgtcgatcccctgctgtcgatgggacggggtatacctgcccccacgtcgcctgatacagggtagggcgtgggtgcgctgccgcctgtcacatccgtctgtcaccgatcgcacgccggtcgcagaccggtcaaggctgcttgacgcacgtcttccggtgggcggttggggcgctgcccataaatgcgcctggcagtccccgcgttcccgcctgctcgatccccctcgcggtcaccacgtggcgccgagcgagggcctcgaggtaaggcagcccctcggggccgagggatatggcgagataccccgagccccctgggggagcgcggacgctcctgggctattcaccgtccgtgcgtccaaccccccgatgtggggcctgggccacgcggccacgtggctgacgggaaaggatcccttcccctcagcataggtacccccgggcccatatcaccgacacggcggaaacaggcaagcacctctcccctgctaatgccgtcacctaccgtggtcgatagcgaggaagaaaggaagagggagtggcgacgacggcgccgtcgtcaatgtcgttaatggtcggggaagagagtaaagagagaggtgagagtctaactgctccaccccacttatttttaaaaagaaaaatgctaactggattgccacgcgtacgtacgtaatgtaggacaaaactgcatcggattgattcgcgggggttattttgtctggtataaatagttcggggtttaaaagtctgattttgggatttagaggacaattcataatgtcgtgatagttcagtgggtaattcagatatttttctaatcgtaaaatagtttagatgcatgctttgattgaactacatcggtccaaaatatagcaatatagcatcggatgagatgcatcctagtattattaatctgtacaaagggtctgtccaaaatttatattagtgagatatgttccatctgatactgtattgccatattatttatattagtgagatatgttccatctgatactgtattgccatattttaaaacggatatatagtaccaccacgaagtatcaagctgcattagacaaagtactataattaaaacattgtacggctactattatagtccatccaattcatcattgtttccgcgtgcaggagagaacaaggagacaaggggacaagagagtgtccgctcagtgtcgatcgatcgagtcgtacgtcttcggcggctaactcatcagtgtcacacattaccgggtgacgcggcacgagcccgacagcggcacgcacgtacgcctgaggacgacgcacaccgaactcaatagttagggcatccacaatatgaaaatcggaaagggcattatgcttatgatatctacttatacgttgtatgtggagatgatccttatagctattctttacttaagtaagcattatacaaaaggaccactcataaagaataaaaaattcaatcttctctgctccaactttgtctctctccaaatcttttggttgcccccgtaagggaggagaagcagcaagtagtccgccgtgggagagtgagagagcatgggtgcacctgcatggatatcactagaaatccccctgcgactgccatctccgcaaccggagatccacccgcgaccgtcgaagatctgcccacgaccgccgctggatccgctcgttcgcaccgtcgcgggatctgcccgcgaccaccatcgctgacgctgcatccaacctcgaccgtcgccgacaccgccagagatccagccaggaccgccgtcgaattcgcccgtgcgcgcgttcgcaactgctatcactgttgccgccgcgagatcaaccaacgatcaccgtcgatgctgccacatatgaccgcacatgctgccgcaacccccgtcgttggctccattcccgtccgtgatggccaatgtccccccccccctctctctctctccttgtacattgctggtgccctaagctagctaggttagcatgctgccagaaccggaatgagccagagtggctggtgtagttagaaatttttcgataggtagtcctacttcacaagttcatattacacatcaaaattttcaaacacctaaaatgatatatacaagtagtaatacgttgagaatatggtacaaataaagaaacatgagtaacatttatttcagacgatccatatattttccaatgtgacaaattagatgaaccaggtttggcctaatcaaggtgagtagctggttttcggtcatgctgatggtgctcccgctcagctctgttgctctcaaacagctgattaggttgatagaatctgatctccacacagaacaagtgaagcaaaatgagccactagtacaaatccgctcatatgcctaggcaacatgggccgttaaaatgaagccatctcaatcgggcctaaattaacatcgttgtagatgtacttatatagacataatagaggtgtatatacctatagcccatcaccgatgacattcatcagtgtcgggctctcccttaggcccgattgagattacatcctatatctcaatcaggccggactactaggcctgttagcgatgaagaatatcggtaattaatcaagacatgatcttctatatgttgagaaaatttgaaccttctccagttgtaccaacccaagaacgcagattactcagagctaaactacattgttttgtttcactcttccaagatcaaaattttcctccattgcacgctccaagatcgaacaacaaacaaccagacagcataggatgataggacttggtagagagagatatcaagtagggcctcagggggccggtgggggcgccatggcaccatgagggggaagccagctgggcgctgggcggggagcaagttccttgcctatgccacgtcgcccgtctgccctcctctaccctctgcaaatcgatacaggaaaacggcggcgcggcgaggtgaggagtggagagaggcgagagccacagaatagtggtggtgcggctctctcacgggcgtgcaaggagtggagggtcgcgtcccagccgatcagcctagggcttctgctatgttttctctttctctttcttgggctggcttcttttcatttcttgtgcttactcttgagacagaatttaggaggtaggggtccttgggccaaaatcggtggtacttcctccgtttcacactataaaactttctagcattgtctgtatccatttagatgttaatgaatcttagatatgtgtatgtgtttagatttattaacatctatatatatgtaggtaatgctagaaaattttacattgtgaaacggagcgagtagtttcgagtatatcaggaaactaccacctagctacgcccgcacacggtagatgaagatcccgagcagagcagcacacatccgtggcgcacgatggagaggggggatgatgaggctgcggagctagcgtctctcgttaccctacgcgtgttgcacgatttgctcatggtcaatcaggatcatagtaactggccaccagccgtagccaccgcccaccgacagctactggatcgatcagtgacaaaaaaagcctgtgaagaatttcgctttgttttctcaacatttctaaaataatatattattgacagaccatataaaattctattttcaaaacggaacctcatatccacgcaatatagcaaaaggacatatagcctattaattgtagtgacttgagtagtactgacttcacatctttataggagcgaatttcagattagattgtttgagaagctaagtcccaatttaaaagattgcatatatccgatcgggtaaaaaatattcttctctaaaaaatccacgcaatataattaacatggtatttaactaatgtcacgccaacacgaatggagtgtcaacatagacgagcacctataccaaaaaaaaatccacgcaatataatcaacgtggtattcaacatgaacggggtgtcaacatagacgagcaccaataacattcagcattatatcgaactcaactatatataaagacatatcagtatatttttaccaaaaacagtacatatattgaaagttatctaaataattatattatgacaaattgttgttaattatgtgaaagcaaggttcttctttgcaaattagaataaccaaggtaatcatatatatatatatacttatatatacttatatagttcatccccactaaatgtagttcatgatatttctctcttctcttattaaaccacaccacctcaattatttctagcctttggataaaagatctatggtctaaattgtctattctttcttctctcataaaacatgcaatctcatttattttcaggctcaaaattatatcaaattgttttcgttttgataatcaaattatattttatttgtatatattatgcaacttaattctccgcagcaacacaatggggtattcatctagtaaacatatacattgtctacaaatacatgcatgcatgcacgacgaagtcgtcacgccataaagtttagcattgttgcacgaggttaccacaccaattaaactggtgtggacaacaaccaatcctctcttactatatactatatataaagttaaagtacactaatttctaaagtgtaaaaataccacatcatcatctactaacaagtattacatttaagtatcatgcaaacatgctatattatctataatttaataatttattaaattttaaagatttaaaatgtaataatgttaaatcatcccacataatttacataatatttcaatatatctctccatcatttttttataatacactatatacctatgtatagttcatcctcacttaggtcattatatttttcttttctctcgttaagtcgtatcagatgaattgtgcttatgcgattaatccgtggttcaaattatctctatccttttcttctctcattaagccatatcatctcaacttttttagcccttatatgtatagtctaaattatcttccttcttttattctctcataaggccacaccatcttacttttatatttgagtcatcattgtatatactatttaaatttaaattacatcaatttatataaacttatgtttatataaacttatgttgtttaagttattttacacattataattacttattgttatcatatagtaaactcccacagtaccacgtagggtttcacctagtttaatactgcatctgtccgaaaatgtagcaacctctgtcctaagacttatgtccagattcatagtcacccatcctagattgctacatcttgggatggagggagtaatgctatactacataggtagattcttgccaacttgaccagaatttgctactccctccggttccataattcttgacgttttggataatgacacggtcttcaaaatatgtatttcattttgttttcctaaaataatatatacaataaataaatgcatgtttacttttcttacattattttgaaagacgaatctatatatgttgttctagttcctttaaacttaatagttctaaagttattgataattaaagttgcaaaagtttgacatcaaccttgtccaaaatgtcaggaattatggaaccggagggagtacgtcattaattcaaactgaagtgacattaatcaaatgtcacgtgaattatattagcatgataaaacgcacaatttcacaaaataaatattgtatggtaattaaaaatactgttttattaatatttgaaataaaaaatcgccagtgaagtgac

SEQ ID NO: 31057 - DNA, 22545 bp, Oryza sativa
tcgtaacttcactggcaatttattgaggcaatcaatctgcagggtacctattaggcctaatgtagtttatgtgaattaagtggagatggaagcggccggctctattatataattcaaacatacactctctcagttctaaaatatgaatacatctaacaattgaaatttgtactaacaatctcttgtttaatgaaagacatcaaaatcttttatccttaaccttatctcagctaaacagttaaacaaattacaaatgcttatattttagaactatccaaactatttgctataaacaatggagggaggacactactatagaaaagatttttcgggacgaagaccctgtaggttgcaggcgcgaactgtaaccttaacatgcaaatgaattttcacatgtgggcctcttaaaaagcctgcatctgaaaataaacctattttcatatacgggcctctttagtgacccacgtgagaaaatactccgctccgccggatccgccgctcgctgtcgccgccgcagctgcagccgctccctagggcagcgctgccggatccaccgcccaccgacgccatcaccacccctactccaggccgcctgtgcccgctctgagagggagaggagagaagagagagagagaggggagaggagagaaagggagagaaaaagagagagagaggaaagtaaataatagtaggagaggtgaggggagagagagaggagatgggttgaaaaaaagggaagtggtagaagggaaaaaagagtggagggagatgaaaaaaatatgtgaaggggtggtatttttgcatggaaccacttaagaagtccgcatgcaaaaatctatttttgcatacggacctcttaaggggccacatgcgaaaatatgagaatttcaaatcgaattttgtgatactaaataaactcatgtgaaaacgttgtcaaaaacaaagttgtggaacttgttgagatctaccaattttattttcgtcatttctctatctgagtttgatttaactacataaaatttaaattttaaaatataagaaattcaaataattttatggtagtaaatgatttcaactggaaaaattgtcaacaacaaatttgtgaaacgcataaagatctacaacttttgttctaatcatttttctacatgattttgtttgaacagtttgaatttaaacatcaaaatatgacaacttcaaacaaaattttcaaaaactaaatgatttcaactgaaaaagttgtataactcactaagatctataacttttacttttatcatttcttcatcaacaaaaagataagtaatgttgttcacgaatttcacatatctctcatatggttttataaactgtaagagagatatgtaaattgtgtgaacaatgttactatcactttatcggatgaaaaaatgactaaaagaaaagttgtatatcttgatgagttctacaacttttttttaaaaaattgagttctacaacttttatgttcatgactttttcagctgaaaatatttactgcatcaaaatattatttgaagttgccattttttgaaattcaaatttttaattgataaaacaaagtcacatgaaaagttggccaaactaatagcagtaggaacacaataacataatagagcatgattttagaaacatttaggaaagaatcaacacatttgaagttagtatgagggaaaaacactagttacaagttttagtcaaagattaaaaagagaaacctttgttgtggaaaaatcgattttcgcatacggctccttaagatgcccgtatgtaaatttttccatacaggcgtcttaaggagccatatgcgaaaatgccgctcgatttttccagatgctgtaagttatggtccgtttgcaacctaccaagggtctcgtacacaaaaatcgtttatgtagtattggggtggcgagcggcggcagcgacctcccctcttcttccccacctccccttcccctctccgtcgacggcgtcggcagcgggtgggaggcggctgccgccgacgggtgagaggcggccgggtcaccgtcggagtcggcgtactcgtcctcggctcaagggaggaacgccgggcccagtccgcgcgacggcggagacgaacagcgccgcggcgtgtgcgcggcggccaggagctcttgtatgtttctttgttcttctcttctgaatgcgtgtagtgttcatgtacataattaatcttctctttgaagatgtgtagctgtgaactagtccttttttgcgagtgagaacatgagttgtgcacatccataagttgtggatggttttgctgttgaatcttgaagagtaaatgtatgtctaacataaaagcttttggctggctttcattaaaggatccactgaataaaagatacatgctagatcataaaaaatatgcacctcctgattgtgaccgcgggtgtgttttatgtggacatggaattgtggagaccatgttgcatctaaattttgagtgccccttttcaagatttgctgggccgttgttaggattttctggaaaacatcagacaatttggagaatataatgtttggtgtctatcttcgctaccgagaaagatgctttatcgagaaaattttaatggtgacttgaaaagtttggaaagtgagaaatggttttatttttgaaagcaagccagtttccatgtcgtcttggaggtgtctcttaaaaggagatcttctactccttttcaagctagcagagagagagagagagataaagatgtagccatgtattggatcagtgttttttaatatttctattgtaattacatttttctttatatattaaataaagcatgcaataacaacggggacctcctttgccgtgtcttctttaatagaaaatcacgatattctcctatatttaattccaactatttccttaatgtctgtacctaactctacaaattgttattacttattttaggagacagacccattaattaagtgaggagaaaggtcagaggatcaagctgcatcagtggaagctgtacgataaggcaactattagtgtccatccaattcatcgtttaccctgtacatggaatgagagagagagagagcaaggagacaagagagcgtcccctcaaatgcccatcgacttcggcagcaagctcgatcgtcgatcggtacaatattaccaggtgacaaaagacacgagcccgacagcgacgcccgcttgcttgtcgatcgaccgtgccacatctgtctatctatagcttgccgatcgatcgacaccggccggcatccgaggactaatgagagtcgcggaagaaatttgaggcaccgagaggaagaggaagaggaagaggacgacgttgacgcggatgatatttgaggccgccgcacgctagcttatccatcctgtgtggtggcgtgtcgttcgatccgacgatgttaccccgtgcgcaagtcaggccgggtcactctcaaggtttcaattttggtccccaccgaaatttcggtggttaccgaaatttggaaatgtcgtgatttctggatttttcagaccgaagtgatttgaatttgtaacgtattttgactgaatttgaacagatttagaaatatttgataaaaaaatggaacttttggggagatttgtgtttgccgatggggtcgaaattactgaaatttcaaaccttggtcggtcgtacggtatgtttgggtagtttaaagttttaagaaacagccggttggtagtcagcttctgagaaactaagtttctcaacttaattatattttctaattaattttctgaattctataattatagcttctcaaaatctgaatgaaaagttaattaaactgtttggaaaaaactcctgaaacagactcctagccaggatctcggcctctagcatgtgccgaccgtgactcttgagtgagagagatggccagtgaaagttggtgaaagcatcgtccagacggtacaaaaattcacgtggcaatttcgttgagccaatcaatctgcttggtccagtggtacctgttagctaggcctattgtagttcatgtgagtagagtggagatggaacgttttatattataaaactttatagcattgttcacgtaattctactaacagaggaagtactatagtaccactattttgaatataatatgcttgcttggtcggttatacaatataaatggttctaacaattgaaatttgtaccgaaatctaagtaatttaagtgctattcgtattactttatacccgtgtaatcaatcacctctctttttattttttaatatatagaattaccaatctaacctaataaagtcttatttaatgaaggatatcaaagttcttttttcttatctctgctaaacgcccaaacaatccacgaatacttatattttggaactatccaaactatcggttataaacaacggagggagtagtagtatgcatctctaattaataaatatgcaataataacatacccaagcttagggtggataaatatctagatatttttacacgtgaatatgtcagaatccttatgttggaggattgtccttgttctgttgcgaaaacccagctaaaatagatcacatcgttcacttttcgcatagcatttgactattcgttttattataaatgtagtataaatatgtaaaagtacaggctaggattttagtttttttggtgataaaataagtcataataaaataaataatatttatataactttttaaataaaatgaatggttaaacattacgtgaaagtcaacaacgtcatactgggacagaaggcgagtactatatctatctcttggaatagccttataaaaggaggagttgttaggagcaacaagcttgcaacaatggcgaccatagcatccatgcatatgtatggcttctctcttcaaccacgcctgtgcagcaccggaggaaggccagccaagatcaccaggactaagcctttggcgactcatgattcctctgcgcacatcgtacgcacagtactaaaccacacctccctccgtagttagcctctctagtctcctttctgtctctctgcatataacaactgaactgatcaattattccagagctagctagctctactgctataagcatgcaacaacgagattgagattgtatattttactgtttgggccaaaaaaaaatgtatattttactgttgcattgcatatgtacaatgagatgatcatatgattccattttaatacgttcatttgatacatacagccacctcgtttcaaggagcttcagcaagtattgaaaaccaaacttagggaggcatctgctgcaggaagcagtgcttccaagaaattgctggatgcgtttgtggactctatcttcacattcagtcatcaatctttacgtcccaccgaggtagggcaggcaagcatgattgcatatacgttacacaaaatgcagcagcaatttattgctttgaacttcctataatataaattttcttccgtcctgtaaaaatgaatgctttttaggattaaaaatttgtctgaaaagagtattcttctaagtactactacctccgtttcaggttataagattttttagcattgctcatattcatatagatgttaataaatctaggaacacatatatgtctagattcattaacatatatataaatatgggcaatgctagaaagtcttataatatgaaacggaggaagtacatgttatattcaaaactttgtcccatcctactcctaatcatgcatcctcctatcatacatcatagttgtttccttctcaagcattgatttatgctaaacaagttagaagagcaagtagcacttattttggggtctaagcaatgaattggagagaaatacattaatttcccttggagaaacaattttcctctaaaactaaattggagaatcagttcaatttccattgctaataacttacgtatgtggtggatctatatatccatgcagagtaattttgcaccagttgaagaaattggtcaaataacaaatatattgcggatagaaggggcaatcccggaggactttccagagggtgtatatattagaaatggtaattctctttcattactaactattactaactagattgaaagttatatatggtagcatttggctcgggtgcctggtgggaaggaaaatatcgggcgccctgcgccccacatccctcctttctctctcggtctcatctattcccctcctttatctctctcttcaccatttctctcctctctatcccctttgatctgtgaggaggcaaaggtggaggcaaggtagtgacaggcagaaacataaggcaagatatcggcaggacaaggcggtggctaataggggtgacggtggcaggcagctgcagtggcggcaatgtagacttagctgagtctatgcaacaacggcggcaatggctatgtcctgagtggctgtaggagtgggtggtggtggtggtttgtagggcatcatcagccaaatcatcatcttcggcagctgcacgccatcattagccacgtctcctccgtggcttgggcagcatctaccgtcgatgatccggctaacctgaagtggatttagctggtcttttttcgggtgattgtttcaatgttttcattctatgtatatggttgtttcattagtcagatcaaagtgtttcacttggatttttttatggtgtttcaatttttgtcttcgatttcactcggaacttgttgatctttcaatggctttaaatcattagttttatttattgaaccaaattgtttcatctggcgatccgattgcgtttcacttttttcaagaactaaaacattctttcacttagtgctgaaacactctttcataaggggtaaaataatgcctgatttttaggaaaaatcgggcacccgatttgtagtcatttcatcacaacagacacatacggtcagatgcagaacaaagcattactatctactagcttctcgaatatatatgacattttaaaatgtgtacagttaaaccatcaaatcttaaatcattaatatatgtaaatataactccctctttcctagaatattataacctagtaccactaatctaaaacgacatcctgtcgttaggggtggaaacggatcggattcggacggatagtggtcacaccattgttaacagtgaaatttggtaagccccgaagtcctgatcggcctagagttagtattggcttcagagttctggaatcagccgatgagagtcatcaagtcgctagtaatcagattaagaaaattaatcaattaaagaaagcttatctagaagagaccgtgttcaaggaagatgtggcatggcagtttatctattaattaggaagagtttgtgtttccttttatctttaggaaagtgtgtttagtgtcccataaggattttatgttttctttttatctttcgaaaagtttctttcttgtccaacaaggactagtatctacccatgggtataaatatgtacatatgtggtaattttaatttatctcatagatcaatacagctactcttggcgtatagccaccctctttcccgaggtttttatttatcatccggcgaaaccttagcacttgacgcggggttgcatcggctttcgatcttcggcgaagggggtaagtcctacgttccgccagtcctggcaattgtatcggctataatggtgttgttcaaggctgcatcgcttcgacctcttggatcgctctggttcggttgatatttttgcctacctatttatcatatatcttagttaatctagttttagtatatcgatttagtcatatcagctgattctcgcttaagggtttatgccggtatcggctaaatcgatttactagattggattagctaaggtatccaccaccctaaaaattagtcaaaagcttgattgtctagatattgtgtttcttttcatacttagtgatgcattagtacattcgatctactaagtcgtatttagaaccatgatctctagcctgcttcttgattgctaataagggtttcatcggggtttcagccaatgagttacatgggcgttgcatcggcttacaaggattacatacaagttggttttagccgatcgcaataaaggtttcattgtttatctaatcgtttggatttaatgacatcggactttcagccgatgtaagctttaaccttcggattagtgtttatgctctcatatcattattagccgattggtttctactggattacattaccatcagccgattgtctttatatcgttatctacattggacatatagccgtttgatcaaaaccctattgacatcggctagtatcggcatcgactggaactactccatcagcttatcagccgatcggctatttgatctgctattgtatatcttgtgagttgcaggatcaaactgattggcacacccgcatctcatcaacctttggacctgcactggagttaagcaaatctcccaggccaccgtgttttcacatcaacaaccatattctaaaccattttttaagcagattcgaagcgggtgcggatatgtgcgcatgcagagcggattgtttcggatgttggaaatggtgcggagtcggtgcagactcggttcgggaaacaaattaaatttatcagatgttagatgtttatacaatcaatacaacattgagttatcaatgcaagggacagcaatacaataatcattaaacgacctttcataaacttaagtgtaagatgagacggcaaaagcctcaaacaaggaagtttaggttaattgataaattaggtcattggatgggccgactcatgttatatgcccagatagagtggttacatgggttgatattttcggattatccggcaaacgacctatgggataatccgatagaaataccagataatccgcatttatcggtttttagagataccacatccgaatcagaatccgcaccttactatccgcattcgcatccatatccgccgatttctaaaattccataccatcctcgtttaggacggatttggaacggatcagatcggatataatccgatccattttcacccctacctttcattgtatcaccgttagtctcccataaactatgtgaaaagtccatttcacacttagaataatatatgcaaaaatacactttatgtgtggtgcaatggagtatagttaagggtaggctaatagtgatggtaaaaggggaagaaaaaaccacttgttcgatagcatcttgtggaacttttatttgtcaatattactcagcaagtcatacaggaataggggtatgatgcaaggattcaacaagggatagctaagcaggttcatttgcataaagcgagcatttataaacagaagctgaaagattcaaacagttgtaattattaattaaacatcctctgtccagcgctaacccacgttgcgacaggcccaaccatccacctaaattatccaaattcaaaagattacactaaggtgagactaatcacggtgaatctggttgaccgcccgtaaccgcgggcacggctattcgaatagttttactctgatcagagctgtacaactgtacccacaagacacagccccacgacacgtttccgtgcgcccacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaactggtaaccataggtaaccatcccatagtaatattataaaacaatgcaatatttgaaagaaaacaatagagcatttgcaatataggatcaacatgttcaagtgacaagcatgacttgccttgctctgctgctggagaaacctcggcgactatttcgaagtacacgggagcgtcggaagaaacggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacgtcagcacagaggggggtgcggcgccggcaagcgggccccaccggtcagcggctcaggaggagcggttcaccgtggaccaggaccacgcgggtggtccaccgccggtccacgggaccgacggcccagatcgccctcgggccgatcggacgggcggcggtggaggcagccgccgggctcggctcggcatcaaagccgaccggcccgacccggggctgacggcggtggcacgcgcgcgtcgcgttgccggcgacggcatccggcggcggagacggcgacgcaaaggcggcgccgaagggcggtgatgctaaagcgacgactaaccggcggcggcgctaaagcggcggctaggagggagagggagggcaaaaaacgggaggggggtgcctcacccagggtggccggcgcggaggaagacgatggcgaacagcgacggcaagccacgggaggacgacgtcggcgggcggacgagcttcggggtgccctaaggaaggagaagagagggattagagagagaaagatggaccctggcaaccggaaaccatggccgaaggcggcggtgaaggtggtgctcacccgagtgcgagggaacgagggctccggcgacgaacctcgacggaggaggggtggacggggtggatctcggccacgcgaacccgacggcggcgacggcgcggcctggcggcgaccctaacggcggctagcggcggccggagtagcggaaaaggcggcggcaaagggttgcacggcgcgggagcgatgggaggctcgagagagtacggcggaatggggaaaaagtgagaggggacgacggcgatgcttaaatagggggagaggggaccggacgtggccgggagaggcgggaatcgccggccgacgtggggggtggcggaggagagagaggcgggattcgaaaatcgaatcccggccatctcgggcgcgggcgcgagcgggagagagagaggagtgggcgcgggagacgcggcgcacgcgcgggcgtggtcgacgtggcccggaggaggcggagacgtgggtgcggcggcggttgcgggcgcggcggcgcgagcgagatcggcgggaggtgggggaaggacccgacaggtgggccccacctgtcggtgaccccggagaggagggcggcgggacggcctggctgggcctcggcctgcggccggcctagcaaggaggagggggaaggaaaggagagaatgggccgacggcccattcgaaaaaaaggaggaaaaagagaggaaaaaagaaaaagaaaaaggaaaaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatctgattattatttgcattaccttcttagggttttctcttgatttgcacctgcattttcttagggtcatttataaattaaattttaggcttgggaggagaactttggggtgtgacaaccgccaaggccaggtcaagctcccatgacttggaggaaattcagaaccgaccatccacgcaaggccgtgatggttgttgaagaagttcaagccctccgcaaggagttcgacgcccagcaagcaagtagccatcaacagcccgttcgcaagaaggtcagaaaagacctttactgcgccttccatggacgctgttcgcacaccaccgatcaatgccgaaacattcgacagcatggcaacgcgcaagatccaaaaccgcaacaaggagtagctgttgaagcacctcacgaagctgttcaagagcaagcacccccggccgaacagcgccaagatgtgcagcgcagagtaatccaagtgattacaaaggttgacccgccgaatcaactgtcaaaacagcaaaagaagatgcagctgcgaatggcgcacaacatcacttcggcaagcgaagaggccccgtgatacttgaatcagtagatttccttcgggccaaaatatgccgaaggagtgctgttcccgcatcaagaccccctggtgatctcggccgaggtagttggcttcgaagtccggcgaatcatagtcgacggaggaagttcgaccgacgtcatcttcgccgaagcatatgccaggatggggatgccaaccctagccctcacccaagcaccggcctcgcttcgcggttttgacggagaagcagttcaagtcctaggccaagtacaattggtggtagccttcggcacaagtgaaaagaggcgcaaagagcaaatactgtttgacgttgtcgacatcccatacaactataatgccatcttcagtcgcgcaaccttgaacaagttcgaagccatctcccgccacaattatctcaagctcaagatgcctggccctgcaagagtgatcgtggtcaatgggcttcaaccttcggctacatcaaagggcgatttggccgtaatcaacagagcagtccacaatgatgaggccgaaccgcatgaccgggcgaagcacacgccgaagcgcgcccctcatggcagggtgatcaaggtgcaggtcgatgatgccaatcccacaagacttgtatcgctgggggcgacatgggcgaaagagaagttgagaacatcctggaggtgctcaagaaaaacattgatatctgcgcctggggccccgacgaggtggtaggtgtttcgccatatctcatcatgcatcatctggcggtcaggccgaatgccaagccaaggaaatagaagctgcgcaagatgtctgctaatcgccaagaagcagcgaaagccgaagtgcaaaagctgctcaaatctggggtgatccaggagatcgatcaccccgagtggttggcgaattcgatactggtgcggaaatcaaacggcaaagggcgcatgtgtgtcaatttcacagaacttaacaaggcgtgcccaaaagaccatttccccctaccggggatcgactagctcgtggattcgacaactagctgcgaactcatgagctttttggatgcgtactccggctaccaccagatccacatgaatccagccgacatctctaagacagccttcatcacaccattcgacaccttttgctacctcaggatgcctttcggcctgaggaacgccgaggcaaccttcgctaggctagtgtacaaggtcatttacaagcagttggggtgaaatgtggaggcttatgttgatgacatcgttgcgaaagccacaaggctttcgaccatgcgtccgacttacaggggaccttcgacaacttacgcgcggcgggtatgaaactaaatcctgagaagtgtgtttttggtgttcgcatgggcaatttgttgggttttctcgtttctgaaagggatatcgaggcgaaccccgagaaaattgatgccattcagcaaatgaagcccccgtcgagcgtacgcgaaatacaaaagctcgcgggccgaattgcggcactcagtcgattcctctcaaaagcggccgaaagaggcttgcgtttcttcaagactctccggggcgcggaaaagtttacctggacacccgaatgccaagcagcgttcgacgagttgaagcaatatctgcagagtccacctgctttggtcagcccagcactaggaagcgaactgctactctacctagcagcctcgccggtggcggtcagtgcggccctcgtccaagaaacagagtcaggccagaaaccagtgtattttgtctccgaagccttgcaaggggcgaagatacgatacattgaaatggagaagcttgcttacgccctagtgatggcttcgcgcgagcttaaacactactttcaagcccacaaagttacagtgccatcacagtatcctttgggctaagagctccggggcaaggaaattactagccggctcagcaagtgggtggcggagttatctcccttcaacctacatttcctcgcccgcactgccatcaagtctgaagtcctagctgacttcgtggccgaatggacaccggcattcaccctttaatccgagcctgtcgaaacaaccttgggtgacgtactccgacgacttgtttcgggaaacaactaaccgaacaccgttacactcgatcaatatgaaaacacaagcgctcctatcagcgcagaatactacagatcgaaaacggaagccgaaagctgaaaagtcagcagacctatttcgctaatatacgcaaatgggccaacacgttccgacctaacgaaagcacgaaaagtgacaatgcaaagaatagcgaaaaggaagtaaaacacatctttatcaacttcgaaaaaacaatcgaagaatacaagtcttacaacatggtatagacaaagaaagcaacggctttacagcctagcttacagataaattacacattcgcccccacaacaatcctcactccctaaggaatgatttggcgaatcaggttcgtcatcactactaatattatacacgaccctaagagggaagggggcgaaacacagactagactataacgacattgggagatcgcctcctgacgatctgttttctgatggtttcgccaaaagcgaaccatgtcctccagacgttctgtatggatacggtcgtagtcttccagggttctcccggggtgcgcccgcattcagccggcaaccttcaaaaccttgtagctgttgccgtttattatcatctcgcagtaaacaggccgaaacgggcatcgcacctttggcaaacccttcgccgccacgaacttctcgttcttgtttcgccaattcccaaagggggaccgaacacacaattttcggcaaacaccctgctaaaacagtgcagaaagggcaaatgacgaagtgcaaagttaagactccacaagaaacgtaaaagtgggcaaaaagagtaagcactctctagtatgcaaaaataatgcgaaaatgacgcaagcatatatgccaaaggcatcaagcataataattggctaaacttggatcatccattccatatatcaaaaagaccgttcttggctatagtaagaaagggaaggggccattggccaaatttacatcgttcgcctttgtcacagcctgaattttcgtttcaggatttataaagtatttaataaaatattaatagaatttatattaaatgttccttaaattacaagtgaagttaaatgtgggaaataaaatttcctaaatataaagcatggctggattttatttttattaaattctccatgattaattgtactctctgaaattttcttggatttttcggagctcaattcctaattttaataatacaaggactatttcagtaattattcacatattaaattaatcattaaatgagctggtttcaattttgttaaatacttagggtgcccaagttgtcgacgtttgatgtcgcgattccggtatttgcatagtatggagatcgttggtactaggatatacgcgagactgaggtaaaagagatggagacaaggatttttatacaggttcgggcccctgaattgtcaggtaatagccctacatcctgttggccgaagccggtattgctcttattcaccataatcacaccaagtacaatatttggggtagcctatctaactgttgtcgactttgcggtctgtaggtctgactcgtagtcgacaacagggtagtcttcttcctcgagttcgtgcccggcgaggtcagagacagcgctagatccctacggctagcctcagtacgtaccggatagggtcgatccaggcgtatctctgatgtcgatatccggcggcttgtcttggcgcatgttggcttgtattggcttgtagctttgtggcgtctatgttgtctgtgtcttctatggtgggtgtgtcccctctcctcctagggggccttgtatttatacccataggtatccccttgtgcaagtagaactaggggaacaaatatggatacaatccgagtagtccttgtcgtttccatgtagaactctagttgtctttccttatccggaactcttcccatatccacaggttctttccgtataggacatggtatatggtgggtcctgccgagatttagtcaactactattaggtatgtggtatccataaccctgacagtagccccagacttcgatgcaaatgaacaaattcatattctcaaccgcgcgcagaccttagagtaattgttatcgagctcatgtgaccgttcttggtgaattcagagataacgttagacttcctttatcagcctcgtgcgggcacctaaagggtgtgtctgagtcaatctctgacgtcaaccaagaaagttcaaagcatacgactaagtctcccgtcttgctgtaatcgagaatttggattgaagtcaagaaattttatctcggtgggtacaccatttcttcattccgtattccttgtcgagatccaccaactgttctcgagtgatcgagaaggcgtagaatcagcgacgaagccttgtcgaattttgtcgtactcgccttagtcgatcttggtgtagaaccatagagacatggagccttcgataatgtcgaatagaattttcctaaaatcaatactcagaaaagaatattagatagaaatagcccccgagcgaacgctcaaagggtaacatgttataatatgtatggaaaaccgaaaatgcattaaacttacagaccaatgttttgtatatgagcgtctactcttttaccgacttcgatcagtcagtttgttgagttatacactctccctagcccctagccttattgtcggcgaattgttcttggaggataaggctcttggacctttcacctgcctcggttgaacaagcactgatcctagcccccagccgtgaagttggaaaatccattttcgattacacggcttggttaatacgcacggcgagaactcttacacgaccagatcttacatggtctttcgtctctaaaggatccgacaaagccttatccgctctgggcgtccccagccgaagtttccttaggttcctcagaggctttgtcaagacggcgtaaagggacattaggataggtttcaacgctaggtgtcttttgtggtaagggatctctgggtaaaacacttggcgatattgtgcacctgatatcaactttgttgaagtagaggtaatgggagaatcactacacctctggtcagaaccaggtagtagtcgtaactcaaccactagaattaaatgtacgagagatcgctacaattgactggttgaggaccagtgagtaggtgtctctcgatcatttgaagtcgtagtacgaggaccgctgcgttattgctgtagtcgtacctcgactctcgaacacctatggaggcgctggaattggtttattacatgcgcatctcatgtggctagcatgactcacacacccaacttgtagcatatccggatgtccgttcacaatcatgtcaggtaataaagccgacaacgttcacgaggaattatccgttaacaaccttttctcaaatagtccagccacagccggtgctatgagataggttgtcagttttcgttggtaggttgggcgcgacgactctgcatttgtcgagatcgttctcgataatgcggtgtacttgaccacaacctactcgagtgctcaattgttcctgaaaaatattttctagaagacaagatatatagcagataatatcgagtatgtactcaaaaaactgcatgaatcttctagcattatcaggatataacgagcagattaaatatcagggcattatgtaaactgtaaacaagcatgatttatacagaagaagacagagcgagtccccagcgttagatcgtagtcgatttaacatcagggacacccgcgcaacagatattgtataaaaaacatgctctaggtaaacataataaattataaatccgacaatgttgtatgatctgaatattggtatggaaaattttatataaaataatgcgtacctgtgtagatatatgccggatatatctacgaaattagtagatcaattaaattaattaacctactaattacatttctgacatgtgtattcggagtagattagatcgatgcaatcttacttctccaggtgtacagccgcatgaatgcagtaaacacatgcacttgctgttaattgatctgatgcatgcacatatggacgttatccaaattggttggacttgacgccggccgtgatgagttgacgcccgtgtcaactgactaaaaatcgggtcctagtcagaacatggtagcactactctggcagttgatttttggctcctcgacacacttgcttggttggtaggaatcggtgtcgggttcggcttggactcggccggccgatgccttgcaccagttgatgtcgcacgcgtcgagggttaggctgcttccgacatcatggttctccgcggcggcggtagtcccaatctcgtcggaagatatgctccgatcaggttagattttcccacagccgaagtcgccgagtagcttgttgttggagaatccatctcgtaaacccatctcatcgaaaccttgaagcaccaaaaatcgccctacctggcgcgccactgtcgacgttttatgtcgcgattccggtatttgcatagtatgatgatcgttggtactaggatatacgcgagactaaggtaaaagagatggagacagggatttttatatagtttcgggcccctgaattgtcaagtaatagccctacatcctgttggccgaagccggtattgctcttattcaccataatcacaccagttcacctttagtcctcgcccattcttccttctattcggccggccttatcccttcccaaagtctggtttgcattcctccttctatcgggctgtgcaatagaagcccagccaaaagtctggtttgccttcctgcgccactgttcatcttccagctcaggaagagccgactgtccgccgtgcgcatgcactgccgccgcctcctccttccaaatccgacctccccgttgctcctatttccaaattagttctgggaatggaatcctcttaatctcctcttccttttccccaagaaatccccaaaagtttctacggaaatcctttccaatttcgcggatcaatctttcctttttccggcgaagatccctagaatttcccgtagtttttccgtcgatttgggcctggacccgagctcccgtgcctatataaaggaccccctcgttgtcctctacctctccctcaagtcctgtcttccgccgtcgccggaattgctctccccgggagccccttctctctctaccttcggccgccgctccagccgccgtgcgccgtcgcttcggccgtcgccagtcagcgccgccacctctctcggctccgcaaggtcaatagcaagctcagcagccatctccccaaagccgaagaccccgggaagcacttcgtcgccatgaagaccgagctcgccgccgcgttttgatctccagcgaggccctgctgctccttcctgttagtgatatgccctagaggcaatcatagagatgattgtatcacatactttgtttacatatttatccgacattgttccttgaaatagataactccttattggttaatgaatatgtgattctttcatgagactctttatgttgtttgttactatttctaaaggatccctaatcaaatatcatatgtggaacaaatatgtttatatgatcagcacatgttttaattgatgatcatgtctcatggatcatggtatagagataccaaattaataatgtggacacatgttggtgaacatgttattggatagacccaacatgagacactgcaagagccatatgtgttgtgtcatcagtgatctcatttagtgttggtgttgaatccttagacctgagattatcatggttctcaacatgtgtagtagcttacttaagaactgctaaatgctactccgtaaatgggtagctataaaagtagttttcgggtatgctatgaaatatgtagtgggatatgtataatcaagatgggatttgcccctcctatggagagatatctctaggcccctcgatgttgtagattatggaagtgcatagccatgccaaaggtgattgaggggtcaatcacaagttatataatctatcaacaggttcgagtgaatgattagctattagaggatgccacatatctagccttgagcttaatcgatatcgtgaggcaaaggggtttatacaagtatacactagaggttcaaccgatatgatctttatgtatgcccggtgggtcaatacgttctgctaggggccgctgttgacgcgtggaccgaaaaggagttttcagattacagccgagtatatatgaacatacagggtcgcatgcttaatgggccggaataaggggatttgatagggatccaatataagcttaattcggatagggatccgaataggagtcctatgggccttggaggcccgagtgatggatcctatatattcgtgaggggtgtgaccggcggaggtattgcaatacgtgagaaaccctagccatcacttccctccccgagcaaaaccctagccacgcgcgggtgcaagcacatctgcgcgtggcgttccgtccctgtacgtgtggataccggtagagacgccgctggtttgcggtgctgatcggcgtgggaatacggcgaggagaaagcacgaggaggagaaggtcgagccggtgcgatcgactacttcctctacatcgacgcgcgctacttcgcgagagttccttcgacttctcagcgtcttcttccgctgtgcagcgcgtcgagtggtaacgatctatgatctaatacttgcatggttcctggtttacgcgatagaaaattttgatttatgctatcgtagcctacgcgtatcccaacacttccatcatcaccaagcttcaccgccgcctcctttgggttcggtgttcgcctccgctttgctgacctctaggcgaagagcctaaatcttcggctcgatgagattgtagtaatcggttagagcggtagaatgtgcttgctcctttttgagctcagccttgaggcgctctatctcagccttcgcctcgctccccttctccaattcagcttggagccgcttattctcagccttcgcctccttgagggtattggcgaggccctccatctccaagctcttgcggcccagttcgtcgtccttggctcgaagacggttcttgaacccgtcaaggcaagcccgcatagtccgttcggttgaacaatgggccgcgagaatctagatcaaaagaaaaagagagggcgaagaggacaagcgttaacataagccgtcgaagacggacaactgaaagtaaacaaaaaggagaacaacatacccgaaccgccaaacgcttgatggcagaatagccttcgtcgaactcgttcagctcggtgaataggctcgggctgccagccagagacacgagattacttaccccctcgacgaaggggataaggtccgcgccagtctcgaagtcagcaggggcgcagtggggggccaccaaagaatactctgaagcagacgtctcgacgaccgtcttcttccccttctcaatgacaagcggcgaaaaccacagtcctccgcacaggactgccaaagaccctagcaacgaccctgacaatccggtcagcaaaggccaaagcccagcggccacactccccccgagctccacctgcatcaaccatggcgctgagagcggtcgaaagacccaagctccgaccagtgggcgaagtaggggtctcgtccgaaaactcgtcgtcgctaaaaatgcgagcgacatcaacgagccctttctttttgggggccttcttgatcgaaccccctttcgtcaccttggttgcggcgatcgcaacaagcgccttcaccccctcaatatccatttgcgggaggagggagaagttcgactccaccccggtcccaacgtgctcggggctcggagtcggagtgtagctgggcgtcttggcgcggttgccgacggcctcgtccgtgcccttttcggccacaacctccgtttcccccacatcctccccttcctttttgtggtcgtgatctatgacagtgtctttgtcatcagcatcagagtcggtgaaggcaggggccctgcacttccggggggccaacttcacctgccccgcagccacttcctagatggcccctcatcgccatcggccttgaaggacttcgtccggggaggcagttcaccgacatatacccggttcgcccgaccggc

SEQ ID NO: 31058 - DNA, 734 bp, Oryza sativa
gcagttgtgaaaataaaagctctagttggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtatacgcccaacaacggcggcataataagccagccgtgcaggcggaagcaccagtccgccgcggcgaaagcaagccggtcggtgaaga

SEQ ID NO: 31059 - DNA, 520 bp, Oryza sativa
  unsure (1)..(520): unsure at all n locations
nnnnnnnnnnnnnnnnnnnnnnnnnnnnnnnnnnnnnnnnnnnnnnnnnnnnnnnnattctctctcccggtttgctaaaccggacttattgggcttgcaaaccaagagagatgagggtttctctagtagtgatagccggtccaaaacgcgtttgatcagagctgaccgcctatgtggtgcttcacgtaggcaacatcttacatccagccccctccatatctcaacgtgctactaattttgtacttaccccctattgctactgtagacatcaaaatctcccaaaatatcccaaatcattttggaccggctatggtcagctatgctcccgtacatcttagcctcctcctccatgcacgtcatcgtcttatatgtaggatcgaatcacaacaactaagccaaccagagggggggtgaatggttggtatacccaaaagtgaatggttggtatacccaaaaaccgaacttttagcggaaaataaaaattaccctcaaattcaatggatcgcggtctgaccgaagt

SEQ ID NO: 31060 - DNA, 738 bp, Oryza sativa
gctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgaagcttcttcatctaagtcttcttttgttgctgtttttaatgccacatccgatgatcaactcgaacagatcgaggaggaggatttggctttggttgctgacagaattgctcgagctatagtgccaggaacaggaaaagaggtggtccaaatcgttgctttgaatgtggttcaattcatcatcttcgttcgcattgtcctaagctagggagaggcaaaagagaagataaagatggcgagaagaccaacaacaacaagccgaagggttcatcccaagggaggaagctggagaatcttagtaaggcttttcatcaagtttgcgccgccttcgagccactaagtgatgtagatggtgaaagtggagatgaagataagggaaagaacatctccggtgtttgcttcatggcgcgtggcgaatcggattcagagtgtgaagataatgaggtaagtgctcttgaggaagctattaatattttgagtgcaaaaaatatgaagtgtgagaagatgtatagaaaac

SEQ ID NO: 31061 - DNA, 782 bp, Oryza sativa
ctattcgctattgccgttcgccgtcgtgcgtgccggaggagccggcacgagcgaggacacggaaggggactctgggcgctcgccttcttcctcttccccggcccgaggctggagagatcactcccgtgccgtcggcctctcgtcacagcgccccgcctcatctcggtagtgcattcccccgttctccctcctcgatccatctcttccccttagttttcggtagtagcatgtgtagccttcctgtagctagctggcgccgccccgaccgttgccgccgctagctgtgtgctcgccgccgtcgccgcccgtgctccatagcgcccgctcgtcgctggcctcgctcggcgtagctccgcccaatccgacgctagcaacggattcccatagccgcgtagatgctctcaccgccgggaatcggccccacgtgacctcgtcgccgtttccccttccctcgccgccggttgccgccgccgcaatccgccgccgttgagttccctccggcgaatccgagccgttggctcgtctcccctcgtcccatgcaaccccccggtgtgctcgctttcacctgtatcgccgtggttcgctcagccaatcgccaccgccgtccgccatccgttccggccggcataatcgtctaccttccgccggcccgcgtggctgccacgtaggcaccacgttggcgccacctccggcgcgaccggatcggctgaccccgcagccgttcctttctgttccccccccccgtgcgcatggtccgcggtgagccgtgaagctactcgtgg

SEQ ID NO: 31062 - DNA, 1840 bp, Oryza sativa
  unsure (1)..(1840): unsure at all n locations
ctgctcactttcataatgattttttaataaagtatcaataaggacacattcccctaacaaaaatattgtttttgacaagagggaccagattcttgcctgttaatgaattatggttaagctgattcattagtggatggagtctgagaactacccgccttgttacatttctttaatcaaatatccatgtgctataagtgttacaaccatagctacaatcatgcaaaatcagtaacaatggggacacatttcacctaactgagacatgatttagagaagcgagaccagatttgtgttattttaacaagtcagctttagttgaattattctaggacgacatgagaccgaaatgggaaaaatatcccctttctaacatttatttgatcaaatatttctactgatgcttataataaaaaaattggcaggtatcttattgtgattgatgacttatggaatatagaaagttggaaaattattagatgtgctttttcaagaagtattactggcagccgaatcatcacaaccacacgtataaatgaagtagctgaatcttgctgcttcccacatgtgcatcgggtatataaattaaggcctcttcattttgttgattcaaaaaggttgtttctgaagagaatttttggtctggaggaatgtccatcacacctgactgaagtttgttgtaacatattggcaaaatgtgatggtttacccttggcaactattgcaatatccagtttattggctacaaaagcaccgacagaagatcaatggaatcaagtggaaaagtcaattggttatgcattggaaagaaacgaggatgtcaatggaatgataaggatactgtcgcttagttactttgatcttcctcataacttgcgtacatgtctattatatctatgtacatttccagaagattatattattcataaaaaacggttggttagaagatggattgcagagggatttattcacgaggaacatggacatacattatatgaattggggcagaggtgtttcaatgagctgatcaatagaagtttgattgagccaaggtatattggcaagttcggtgaggtgaaatcctgtcgagttcatgatacgattcttgatttcatccggtcaaagtctattgaagagaacttcgtaaccttgttaggaattcctaacgttcctattgatcgncagaagaagtagtggaggctatccctccttgttaatactgaagagtattatagcagtttggagngagaatcagtcataaaatatgtcctggataaaaaagaagatgatagcaatgagcaggaagataacagtaacggttttcatatcctaaaaaagttgaatttgggggccccccaaaaaaattgggggtccctttaacccggggaaaattttcgggcccctttaaaaaaaccatattttcttccaacattctgtgaaagtcccatctttgttgcagtttaggcggttgcgtgtgctcgactttgaaggctgtgagcagttagaaaatcatcaccttgcaaatatagagaatttattgcacctgaagtacctcagcatcaaagatacaattgttaatgtgcttccgactcagataacaagactacgatgtttacagacattgaatgtagatgtaagaggggcaattaacattccaacacatatttatcgacttcgacaactgacttatctacttgttgatatgagatgtcaactgccggataaaattgggaacatgcaagcattgcaagagctcaaagttgtgaatgtgcttgcgcagtcactgaacacgctgcaaggacttggtaaattaacaaacctgaggaagcttagtatatttatg

SEQ ID NO: 31063 - DNA, 1192 bp, Oryza sativa
caatagaagtttgattgagccaaggtatattggcaagttcggtgaggtgaaatcctgtcgagttcatgatacgattcttgatttcatccggtcaaagtctattgaagagaacttcgtaaccttgttaggaattcctaacgttcctattgatcggcagaagaaggtccggcggctatccctccttgttaatactgaagagtattatagcagtttggaggagaataacataaaatatgtcctggataaaaaaaaagatgatagcaatgagcaggaagataacagtaacggttttcatatcctaaaaaagttgaatttgtgcaatgctcgattgctaactatttttccacattctgtgaaagtcccatctttgttgcagtttaggcggttgcgtgtgctcgactttgaaggctgtgagcagttagaaaatcatcaccttgcaaatatagagaatttattgcacctgaagtacctcagcatcaaagatacaattgttaatgtgcttccgactcagataacaagactacgatgtttacagacattgaatgtagatgtaagaggggcaattaacattccaacacatatttatcgacttcgacaactgacttatctacttgttgatatgagatgtcaactgccggataaaattgggaacatgcaagcattgcaagagctcaaagttgtgaatgtgcttgcgcagtcactgaacacgctgcaaggacttggtaaattaacaaacctgaggaagcttagtatatttatgcctggccatcacgctgatgcggcagaaagatacaagggtcatatgaaagcaatgatctcttccatatgtaagctaggcagagacaaccttcattgtctaacaattcatatttcatccgtatcagcagatgacttcatccaggaaccatggtgccctcctccattgagtcttcaagaacttgtcatcaatcaggcgccaatgtctagggttccaagatggattggctcacttgtcaacctccaacgattaggtttatatctgaaggaactctcgcaagaagatgtcagtacactgggaggactgccagccctgctctctctcattctctatgtggaagaagtaattacagaggagggaggaaggcttaggatcagcagcagttatggattcccatccttggaacgtatccgaatcggtggggaaagttgcagg

SEQ ID NO: 31064 - DNA, 1793 bp, Oryza sativa
atagagcattgaaaggctttgacagcaattcttgccagggtttaaatacaatacataaatcataaataaagcaccgactatttacgtccattgtgtttgtgtgcaccctgaatttcttataataacccaaaaagaaaaggtcaaattggctgcttttaaagctccagggtggagatccatttgctgcaattctgttgcttggctcaacaggcgccattgaattctgttactgccttcttagggaaagctgtaaaaagtacagatgataaaaacatattagtgtagttttaaacacactgtgcataccaacactttccagatcaccaaacttcccattgttttatcagaggcaagaaaccaaaagatagtcttgactaattattatccgaaatttttcagaaatatccaccaaaagtgcttcagcaaacacaatcagggtgaataaacaaagaaagattgaccagtccaatgataaaaacaatgaaattgcaggagccagttccctgcttaaattcatgcacaaaaagaggaggaaaaaacatcaagagagatgatgtgagtgaatgcaagagggaactatcaggtcaacactgcttttgcaacaatcttaacggaaataaaactgcttctgcaacttcactttgctagctccaaggtctcgtttgccccatcgctctcgtaatagcgttgttcataatcttgcccagctaggtgtgagttgggacccaggtcactctttgggtagaccccctcacagattttgtaaatgttttggtgattcgtgatctcactgaatctacccagtaataagaatgtgtggttgaagctaaaaaaaaactgatttgtttgagaataagaattggtcctgaagcttgcttggatgatgcatatgggcacatgggatacctccagagccctcttataactttgttgatcatcgtcataacctcctcctgaacaaagttctctacaccaataaatcagatactaatcctccagaccctataccatgtgagtgaacctaaagagagcatctccaagggccgcgacaagcctcgtgaacctttggtaagaaagagtactataacatctgtaaacaagggaattacctatgcaaatgataatattttattggactattgagccatccaaatcaggaaaagagcttctagctagcaaccatttggtcagcaagaactagaaaacatctataaacaggggaagttgcctacgtcaatggtaatcttttattggacttttgtgcaacccagattaggataagagtttcccagtgatcgacttcaaatatgtggctcgagaccacgacttgcaaacaaatgctgggcttccttacacagcaatgcataatagaccacaaatggagccaatttggatacttgtataaaaactgggacaaaatatcaatccttttctataagaacagcattattacaataaagcctaactgaccaacataaattagaacattctgtacctgtttaaaacatgcatgattgagccttttgttgagcttctgcatcgaattccaaatatgttactgacagtattgactattgaaggtagaaaaattagaaaaaatgtaaagggaccgccatagaaaaagaagggcagtgaaacaaataatgtattgcctcatccatattgcaaaaaatcacattacctaccaactttccattttgctgtaacatgattatccttagcaagagctacgcctttgaactgatccacattaaaaattttgccttcaacaggactcatctacaaaatcacca

SEQ ID NO: 31065 - DNA, 7359 bp, Oryza sativa
tatacgtgtggttgtgatgattcggctgccagtaatacttcttgaaaaagcacatctaataattttccaactttctatattccataagtcatcaatcacaataagatacctgccaatttttttattataagcatcagtagaaatatttgatcaaataaatgttagaaaggggatatttttcccatttcggtctcatgtcgtcctagaataattcaactaaagctgacttgttaaattaacacaaatctggtctcgcttctctaaatcatgtctcagttaggtgaaatgtgtccccattgttactgattttgcatgattgtagctatggttgtaacacttatagcacatggatatttgattaaagaaatgtaacaaggcgggtagttctcagactccatccactaatgaatcagctaaaccataattcattcaacagccaagaatctggtccctcttgtcaaaaacaatatttttgttaggtgaaatgtgtcccttatggatactttattaaaaaatcataatgaaagtgagcagttttcatgtttggcaagactatgtcctcgaatgatttttgctcaaccttttgctatggttcaaacctatatttgtaaataaaatctgaaaagcagaatggtatgcacataagagagctgaatgcaagtaaaagaaaacacggactacttagcaagttggaccggcaaagaatgaactaaaggcttaaaatcttgaaggtctggccttataatacacacaccatatattttggagataagaatatatgattgaaggttagaattttgcataccttttgttcttaagggaagtagtgatttttctaatgagttgttgtatgtcccctgattcagtgttgccataaggttcggcgctaacttcactgagaataattctcaagattccagagatgtcagggtgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacagtagcccctgagaccttcgcagtcgaaaagataatcttctctcgaaccatattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctgaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcaggccggtcggtgaagacgtagacgcccaacaacggcggcataaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaataaagtttcacggatcagaatttactactcgggtacttttgcaattattaagagcagaaaataaatttatctcatctctatgcttttgatttattccgaataatatttagcaccttgcgttactcggtccatccaacgagcccccgggtgctaggaatcggcccaaaggcaaccatccattggcaaaccaaacggaaagcagaggaagatagaactccataactcgataggtacttttgtactcagattatgtcgcaagcaatgaagataaatattataaaaaatatgatataacatctgtagcccccgactcactactcaatggaagaccaattggtgtagtgaggcagagaaaaaggaaaaatatcatataaagaataaaataaatgatgacttagctttgtaatattccccttggtgatggtagaagtggccaatgtgggaacaaagtcgtccatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccactcggcggcgacggaggcaggccgacggtgaagtcgtagacgcctaacagcggcggcataataggccagccgtgtaggcggaggcaccactcggcggcgacggaggcaggccggcggtgaagtcgcagacgcccaacagcggcggcataataggccagccgtgtaggcggaggcaccactcggcggcgacggaggcaggccggcggtgaagtcgtggatgcctatgaacggtggtgcgaccatccaaccgtataggcgagaacaccagtcggcggcaacgaaggctagccgatcggtgaagacgtggacgcccatgaacggtggtgtgaccaaccaaccgtttaggcgaggacaccagttggcggcgacggaggtaggccgacagtgaagtcgtagatgcccaacaacgacggcataataggccagccgtgcaggcggaaacaccaatcggcaacagcagtgccacagcattacatgtaaacaacaggaaataccaagagattaatctgatatttagagatcaatctaataaacaacaataagttgaaaaggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattctcatggaaacaaataaaataaatctgattaatatcagcaaattaaatgtataaatctcagcgattgaatgcatgtatggctggattaattaatccatgcatggcggttgaatcgacacatcctgtacatctccagcgatctcgttatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagattgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaatctcgacgcacccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggggggggggcaggatta

SEQ ID NO: 31066 - DNA, 2441 bp, Oryza sativa
  unsure (1)..(2441): unsure at all n locations
tatataaggaaacgtaatacccgagtcatgatctattacatatcccatagatataagttatcccctatgactagtcggataaccatgccgtatgggtatggggtacccataatatccacacagggtttcttgacacagacacaaaagcagaacaatcgaattgctccctcagctcctcaaagatgaggtttgcgatcgttgtcttccctaatcccccaattccaacaatggagatggtccttagatgctcggatgccacatgcccatcatctttcatcaacagatcgatgagctccttcttcggctgatcaaccccaactagagatgacacatcctgaaagatggtaagagctctttggtctacggtcgcattagctgtcctcatcaaactgatcccaccattcatatatcgcgcattcctctcccccacttctttgatttgtgccttgaactcagcaatcatcttggcaatccgacgccgggccatggtcttggtcagcaaattcctgcatttgacgatgaacccatccggattagcggatccgtcgacgacatggagcatgaactcgtcgaggctgtcctcgatgtcgtaggagagctcccgcacctccctcgtccaggccttgtcctgagggtcagcgttcccctcctccgaatccgacatcctgaggaggaacgcgtgcatggcggcgaactcgtcggcgaggaaactgatctggccgcgcaccccttcgaattcgccggccatggcggcgagcttcaccaggacggacttgagtgccccggtggccgcggtcaccagaaacccctccatatgctcctcgaccgtacgcaaagaaagatcctgcgaaacagaagcagaagcagatctagatcagcaggtggggaatcaacacgaaccgcaaaagacggcgggggcgaatgttgattgatggccggagctcaccgccgtgatcctggggaagctcggcggcgagctggaagagttccacgcagcagcagcagagactgatcagtggtcagtggagtggtggtcaactggtcatagacgaagaggacgagaacatgtttgactcgcagcagacggagcaggtggagaagtcgataggccgggcccacagcgagccagcgagttggttgctttgctctctccatttccaaattttactcatcgttttttattttttatttttattttctagcagtgcagaccatgggtttgagatgaaatgaatatactgtgagtagagccctataagggctaattgagtttacgattttctgttagcacgtttttcaaatactatttctgtctcattttaagtatagttatagtttttatgtccaacgtttgatcgtttatcttatgtgaaaaaattataaaaacaattagtcacacataaagtatcatctaataacaacaaaaatactaatcgtaatttttttttcaaaataaaacggacggtcaaacgttaaacataaatacaaaactacagtctatctaggaaagctaaaaacaaagagtatgagttaggaaagctaagtgccaaaatcagccttattgcacctgctctaatacacttgttgatttcggcaatcaaaatgtctttatttgtgggcgagcatacataacaacttcatgctcctctttaagtggacatttcaaaaagcttttgactctataaagtggaactacatcaacatagttttccacaaagatatgatgactgggttgtggggttgttgacaactttcggttttaagatcccgcaaaatagcatccccgcaaatgtgatacatcatgccatggacctatttcaaggagacccactttctatcatcacagcaatagacctatagcaacgactgctatatatccaaagcaacggaccttgggctgattagtaatccttgaggaaggtcggtgcgtttccgaatcttaatatatgcatatgactggcggtcttcatcgacctaaaaacaagaagatgtccaggcattgcaaaactttgggcaggcaactgggttgtgcgccaacatacaaaagtcacaggttgccctattagatgcagtgacatcggcctcgatgagatcctagaaaacatcctagtgaccagacctttgttcccaatgaaatacctcggtctaccattgtccattggaagactgcagaaaatagaccatcaagctttgttccacaagtcaatagggcggatggcgggatggcaaggcaagaacttcggaatggctggctatcacaacccgccctggcaccacctaatagtgacaccaaagagggtgcgccataggaaattggcgtgaactgaattccatggaaccgcattgccaataccagtttcagtacaaaattattggtactcgtggtcaaccaagatannnnnnnnnnnnnnnnnnnnnnnnnnnnnnnnnnnnnnnnnnnn

SEQ ID NO: 31067 - DNA, 1615 bp, Oryza sativa
gagttcattgctttgattccgcagccaatcgacctacctgtagtgtttccggtgagcccttctcttctcacggtaatgtttgtgccttttgttgctactatatagattttagggcatgtttggatcaatgccaaaatatatagtattttttagtttaaatagttagtaatgtggtggcttggtttcaagccaaaggttggtaatgcccatgctcaatttgacacaattctagaactttcttcaccataatataaattttggctcctaattgacatcaatccaaacacattcattttcaatgttaccttaccaaaacattgctattgtaaaaaattacctagattttgattattttttttggtatgatagtaaaccaaacaagcctttataaaggatctggattgggaccaagtctgggtttttatttacacttcttgtgttgttgatttcttttataaaaaaaggcaaatgggggaaaaccacgcaattaatccatgatgatttccaaacacagagaaaagaggctcacagatagaaaccagaaaccaatttcaggcttggatatactagtattctatatgacttcattcctgactgataatacttaccatcttatttatgactttgatgctctttgtgatagatttcttcatggatatcgaaatatggctagcagcaatatagtaaatggcgaggagttgggtgaaccagaaagaagacctctcaacccttctgccaagggtttcattatttccttgggcaagcactctgccatttcccaaggcacgaaggatatagagaaaagcaatactgacacaatgaacaagttcattactcattgtagcgggaatggtgcagaagatgggaggacatcaagcgggaatgtcatttctggttacgaaggtgtttgtgggacaacctttggagtcatagacaacaaagctgatacaacaggagaaattgtggatgttactggttgtgaactgagcagtggagacaaaagagagcttggctgcaggggtaccacagctaattgtttacccaattgaggatggtgtaccccctatggagatactcccatatagcagccattgtgacggttctatatacaggggcacagattgctggaaaaaagagtatcatattgctgaccgtaatgaaagtaagtggtcgatctctttttcttatttttattcattattagggcgttttccaagctatagggtcaactgatatattctctccgtaaatctcgacttaatttttctttcctctgtttacttataatttttgattgcggtgcattggcatatataaatggaaatcttctgaaattaacaactcatggtttcattgcttggtgtgtgcaaaagcacgaggcatctaacgatcatacctttagcagattgcagcctgtgctgacatcgccctgggtgtaggacatcatactcaaggttgtgatctcactagacattgtatctcctatctatccaaagttttctgattgtccagataactccctaagccatttttttgcctggaaatttgttcagttaactccagaatgttattgatcttcttgtttcttataaaagcatgttttattttgaaaatt

SEQ ID NO: 31068 - DNA, 353 bp, Oryza sativa
aatcggggtgttataaggacttccctaaaaaggttttcaactgcggcaccgttctaggaaaggaaaggaaacggtcccgcgaacaaaaacggacacggttgatcatgcaaaatgaaaccgcggactgagaaggcagtgaattgggcacaattcatgaccaaaggcaaaaggaagaattattattaatgtgatcttgacatttttaaacttagcaacattacctccggtgctctatgaattccgctttaagtccggttagtcatttttagagcaaatagaatttgaaaaaaaatttcctctggcaattccgattattaaatatattgttaattagggttttctcctggttaacc

SEQ ID NO: 31069 - DNA, 743 bp, Oryza sativa
ttgagggaggagaaccaatttttatcaccggtcatgtgccgcgaacaaccggaatccacgatccacacgttctccttccttgctaccaaaacctacatacaagcagaagtcgaagcctcagtactgggttagatgataataaaaatttaggaatccagtactaagatacacgaccagaagatccaataggcatatatccacgtgcaaaaacagtttgagaattttcagaaaaatttctccgaggccggtctgaccgaaggggtactgccggtctgaccgggggtcggtcggaccgccgctgcaccgccggtctgaccgctgcccagtagccggtccaactggtcgccggtccgaccgctggacccactgcagtctgaccggtttcctcgagggaaaaccaaatttttgccactttgaatttgcaaaatcaatctctctctccattttctttttatgagccaatctgaaacaaaaaccaacaatatatccatctttcccacaaaacgagcaagcatatttttcacgatgattagaaacattggtagactcagatggcttagcaacacaagcaacaacatgagattttgcatgcacaacattggattttgaagatgatgcactcaaggtagacatgatgccaacagatttaaacacagtgtaaatagtttcatgtttaaccaaaatgtcaccacttactagcactaatacctaacacagtaggaggatgggtaccgagctcgaat

SEQ ID NO: 31070 - DNA, 677 bp, Oryza sativa
ccatattctagtctatgtcagaatagtggcgtaaagctcgagcaggtgatcaacggttagctattgtcggctttcttgaacaggaacttggccagattggagtcgacttgtattgtcttgttggcttttgtggctcatgttggttttgtgatcgccttggtcaagatttgtaccctctattcctaggggtgttctatttatactcttagatgaccccttgtctaagcagaaccacataaacaagtgcagatactatctaagtaaatcttgtggtgtccgagtaggactctgtgtaggatcgaatcacaagaactaagccaaccaaaggaggggtgaatggttggtatacccaaaaactgaaaacttctagcagaaataaaagttaccctcaatttcgatgagatcggtctgaccggagtagattagccgatctgaccgaagcgtagtcgccggtctgaccggtgtagatcttccggttggacagccctggaatccctgccgcgcctgatgccgccaccggtctgaccgcaggtcacccgccggtctgaccaccgcgatgccgccggtctgaccactggtgtgccgccggttagaccgccgaaacccagtgaaacacaaatcgaagaattcttaaagtggatgacgactttattgattctctctgtgtttacaaagtg

SEQ ID NO: 31071 - DNA, 1088 bp, Oryza sativa
accgcgtcttgcgccccgctcgatgtcgggcatcctgccctgcgtgttgcttgccgtgcggagggagagaaaggcggcgacggccggagggtgagggacaacgtgggagaggggatcctgttaccgacgtggtggatggcgacgagcggcgggagagagagagggagagcgaggcgacgagaaaagatgaggccacatggggtggctggctggcgggcggagaaaaaaaaaagaaagaggagaccaggctgtaaatatagtagggacacacattgtggctggattcgagtactttcaaacagttgcctcagattttgtagggcccatttaagtgtgtcttccattgggagatatgtatcccatgccgtgtatagtctcgggttgtatggctcacctaggctactttatagctatggctttcgttggggatgccctaagctatgcagtttcctggtcatcccttgggtgaatctatatcaggctactgggtatttatataatggtagtgcgagtgcgcataggggttggcaagctcggatgcagccatcttatatatcatcataataaggtttaggcatagctacactaataaaaaacgattttcctggacatggacccatttagctagattgcagacggaccataactggtcgtgtctggtaaaataagctcattttcgcgtgcggtccatttaagaggaccgcacggaaaaatcaccgcacgcgaaaataccactctctttccctcctacccactttaaatttcccctctttctctcctctcctcccgagtcccggcggcggcatggcgacggtgcgcgggatcccgcgggcggcggccaacccccgcacggatccggcagctggccgccctctccccccgagatctggctcccctcccctccccttccttccctccccagatccggcggaggggagggccatcagcggcagcaaaaacagaaaagagcgcggatccgacagctggccgccctcccctccccttccttccctccccagatccgccggaggggaggggtgtcgacggcggtggagtatagtaaaaattaaagactatccttaatgata

SEQ ID NO: 31072 - DNA, 935 bp, Oryza sativa
gattcatcatcaacatggaccatgaactcgtcaatattggtctccatgtcgtaggatagctcccttacttccgtcatccaagcctggtcttgggcatcaggattctcctcctctgacatattgagaaggaacgcatggatggccatgagttcggtagagagagacttgatctccttgtgcagccccttgaagatcgtgtacttatcaccaagcagagcggctagcttcgcaaggacgggcttcaaggccccggttgctgtgctcactagagctccctccatctcttaaaactctgtctgttttgagggcaacaacaaacccgaaaattattttccattaggaacagaaacatgaatctgttgctagctgatacagaatacatgtacgaatcatatacagggacataattaagcttgcttaagccacaagcacgcaagacagagccttaagccggagggatatagtaggcatatagcacacaaacctgaaagtgatctgtataaagaggagatgacagatcagggtcagaagtcaccacagagcagaagaaaactcaacaaaagctgcagatatatcggtatatatgctgtactatgctattagccttctagagaatggtgtcgctggaaccgatcgaatttgccagggcatatatataccgctgagcagcgagacttgacgcgccttgccggtacgacacggccgggcaggaatgaatttttgctggggacagaacttgttgattcaggtgtgtcaggtttccctaagtgatcgacaaacaagctgtggaaaaacacacgcgaacacgaggaaacacgctgagttttgtggtgcgatgaagcttcaccttttcggttttttttcttctccttttattatgcaaataacagacttaggattcgatcccacgtcccggttctttcgcgtccatcccc

SEQ ID NO: 31073 - DNA, 612 bp, Oryza sativa
ggcgtgcccaaaagaccatttccccctaccgcggatcgactagctcgtggatcgacaactagctgcgaactcatgagctttttggatgcgtactccggctaccaccagatccacatgaatccagccgacatctctaagacagccttcatcacaccattcgacaccttttgctacctcaggatgcctttcggcctgaggaacgccgaggcaaccttcgctaggctagtgtacaaggtcatttacaagcagctggggtgaaatgtggaggcttatgttgatgacatcgttgcgaaaagccacaaggctttcgaccatgcgtccgacttacaggggaccttcgacaacttacgcgcggcgggtatgaaaccaaaccctgagaagtgtgtttttggtgttcgcatgggcaatttgttgggttttctcgtttctgaaagggatatcgaggcgaaccccgagaaaattgatgccattcagcaaatgaagcccccgtcgagcgtacgcgaaatacaaaagctcgcgggccgaattgcggcactcagtcgattcctctcaaaagcggccgaaagaggcttgcgtttcttcaagactctccggggcgcggaaaagtttacc

SEQ ID NO: 31074 - DNA, 462 bp, Oryza sativa
  unsure (1)..(462): unsure at all n locations
agggcgaattcgagctcggtacccgttgcgcctcggtaatcgtgcactctgtatgagtatcgacggtcgccatcaaacttaaaatctgagaaacattctgagtaaaacttgggttttacaaaagactcggaaaacccgacacctgggtcggtgcttgcgaactaaatgaatttccaaaatcgcagaccggggaacgtaccgggtgtacggttacccgctcttgcacttaaggaccgtttccttggaatttcatccgaacataagacaagtacgaccacatgggtggaatgggacacccctggctgagtaattagctaatcaggggagccttgatgctgagagacaagtggattcgccggggtggtgtcggggaggacccctgggcttcctggcacagtatggtccggnnnnnnnnnnnnnnnnnnnnnnnnnnnnnnnnnnnnnnnnnnnnnnnnnnnnnnn

SEQ ID NO: 31075 - DNA, 787 bp, Oryza sativa
cagtcggcggcggtcgaggcggccggtcggtgaagacgtagacgcccaacaacggcggcattaaggccacccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctg

SEQ ID NO: 31076 - DNA, 2621 bp, Oryza sativa
  unsure (1)..(2621): unsure at all n locations
nnnnnnnnnnnnnnnnnnnnnnnnnnnnnnnnnnnnnnnnnnnnnnnnnnnnnnncactttctatcatcacagcaatagacctatagcaacgactgctatatatccaaagcaacggaccttgggctgattagtaatccttgaggaaggtcggtgcgtttccgaatcttaatatatgcatatgactggcggtcttcatcgacctaaaaacaagaagatgtccaggcattgcaaaactttgggcaggcaactgggttgtgcgccaacatacaaaagtcacaggttgccctattagatgcagtgacatcggcctcgatgagatcctagaaaacatcctagtgaccagacctttgttcccaatgaaatacctcggtctaccattgtccattggaagactgcagaaaatagaccatcaagctttgttccacaagtcaatagggcggatggcgggatggcaaggcaagaacttcggaatggctggctatcacaacccgccctggcaccacctaatagtgacaccaaagagggtgcgccataggaaattggcgtgaactgaattccatggaaccgcattgccaataccagtttcagtacacaattattggtactcgtggtcaaccaagatatgcatcattgcaacttaggataacataaatagataattccaaattgccttaatcgagttttatctctaattggcaatgacggatattccaatctgggcccatatcgaacccaagtcaggccgtatcggccacttgccatatcggcttagtcaaactccgactctgtttctagctgatacgatgcctagacgatgcgcagtccgactccaaatccaactcaattccgcacaaaatccacttcaatcttgttccttcttttccaattctgatgcaaaattccgttgttaacagatggttaatttaaaaccgataccttccaaaaccgagccgagtcaagtggtggactacaaagtgcacgatgcaataggtcatcgagattctttttctcctcatcctctccgcgatcccctctctctccccctatctcttcttcttcttctcctcctcttacccctctctctctatccactctatctctctggtgatggaggtcggggagtgttgcaggggcggcgtgcttcccacggggaggtggcggcaagcggtggcgccctctcctctgccagatccagcgggaggggaggcggcagcagggtcgccacaggaaggcagcgctgtcgacggtgggtacccgtagaccagatatagagggtattggggtccattggtacgaggatctacatagtacgacaacaagcaaacaaaagacaaggattatactggttcaggctccttggtaagtaatagccataatccagttggtatgggattatatgatgaaaaccacagattataaagggaatagcagaactcgatgataccgacgagaccgtagtcgagttggtcccactagatctcccggtggcttggctcctgcgtgctccggctccgtaggctgtggtggatgtgttggtggtgatattcgatgccttaggtcctacccagggggtatcttatataccgcgggtcacttgatctccaagtaggactcggagatatcggacccctcacgatatggtaaagacccagtcttgtccgagtagaactccttcaatccgtagataccatccaaacaacgtatttaacaaccccacccctcaaacttccattcttttctaactattccagaaaccaaacacacacagagtggaggagaatttttttttaaaattacacagtacaatgcagacacatcgaatctttaacacatacatggagcattaaatataaataaaataaaaaactagttgtacagtttgcatggaaatcacaagacgaatcttttaagcctaattagtccatgattagccataagtgctacataaacccacatgtgctaatgatggattaattaggcttaataaattcgtatcgcggtttctaggcgagttatgaaattagttcttttattcgtatttgaaaatatcttttaatatccggtcaatgacaaaaataaatttcttttcaccaactaaactgttcgtctccccactaaaatccctaaccccatcgatcccagccaacaatcgaagcaccggcgccgccgcctcgtgaccggccggctgacggcggagagcgaagcgggaccagcgacggtggagagcggctggacaacttttcctgcctcaatgcgccgcctctttgccgcctcgtcctctccttatctcctgtctttcgtggcatctccatggtggtggccatcagcgcttgcgcgacgagttcattgctttgattccgcagccaatcgacctacctgtagtgtttcccggtgagcccttctcttctcacggtaatgtttgtgccttttgttgctactatatagattttagggcatgtttggatcaatgccaaaatatatagtattttttagtttaaatagttagtaatgtggtggcttggtttcaagccaaaggttggtaatgcccatgctcaatttgacacaattctagaactttcttcaccataatataaattttggctcctaattgacatcaatc

SEQ ID NO: 31077 - DNA, 12364 bp, Oryza sativa
  unsure (1)..(12364): unsure at all n locations
gatcaacataaaagaggatttctagaaaacgaaaaaagaaaatatatttcattacggggtgaaatgacctgtcttgctagttctgggagtatagtgaactgaggaatagtttagggggttataaaataaatgaaccttttcccttctggggtggttagagattactctcgttttagagttccagtacatttgcatggcatcaagatgaaaataacatcatatatgccaggttttccagagcacattccctctgcatcatttgcagaagaaaagctagatacaaccgtgcagtgcagctcagcacagcaaaaccccccttccagctcatcatcctcgcactgctctgattcttcaggctttcgttgctctccagtgagcaggaactcactgaaaggttcttcactgatttaaaactaatgcctacatggactccgatcttgtcaggttagctatatctgcgttctttctacttttctagtggagacaacacactggaagaacagatgttggataggttccttgcctgtacagaaaaaaaaaaacatgatcaatcccggactcctgatatggctctctttatccttgggatttcctagaagaaaaatttttcaagggagcggatagtttttcatttagatgagaggggaactttccaatgggactatggaatcctcaagaagcatgtttacattttgtatcgccagcatttgtttattgtgttattttaattttaacagaacttgtatttttctgtgaagctcggtgggaggcaatgatgttttcaaagcccacggattgcaacatcgacagcaatggaatttgcatgtcacacggaacttgttgtatgttgcaatttttctcattaaggttggctaaagtacctgcggaccatggtttggtggagttgtatggatacatagcagtgcgggataggctggatacatttcttaattattttgtcaattttagcagggatgatcccattgtcgtggagcaggcgtgcacatttatacatgtatgcaattattttatagttaataagtctgttaacatgttatcatcggagcaggctctggtttaacctagtcttctgacagtagttggatagttagtactgggccgaatatttggccccatgcttatcatgccattacaaaatctggcccatgacaataagccactaccttacaaagtcttatatatattgtgaaatgatgatttacaacaaaaacagatctatactatgaaactaagtatcatgtattccaaacaaaatcaaatagaataattctggactcttggttgctagcaagtaaacctcacaaaactgaatcatttgtttataggcatatgaacatgcatagcatgaatactaagtcttataggcacatgaatatattacatgcttatttgatttagtacctgtgattcagaacaaaatcaatttccctctctaacaccgttatgtattttgtacattctgtttgatacaggacaaagttcttggccatcaataataaaacatgtcttagatattccttactttcatttgattctgtagggtataaaaatattgctacaagtgaaacatcataagggaagcattcagctttagatatttcttactcttatttgattctgtagggttctctcatccacatggctggccctaagcgagggatccaattgatcggcactaatctaatcgaatatgacatgaagatcaagactggtgaatatatatatgaaaatgaagatctacagctgatcgatggtgtatcaatcatagatgacatagacaacatggaattatagctcgtttacatgccgcatccatggttattgtggcgcgattgacatagctgcaatatcacaagtgagtcgaccatagaggttgcaatatcacaagtgcaaagcagttttgctatgcgcctgatcggttgttttaccagtgggttacatgaagaaatccggctctttgatggcactataggtgagttccgtacgtggcttgaagtggcctgtggttgctgtagtgatgggtgctcaaatggatttgaagttcaaggtagccacagactcatgcatccctgctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacagcaatgaaaggcttcgacagcagttcttgcctggttttatgtatcataaaaaaagcgctgcatctgacagcactgatgatggacgtccatcgtttttgccctgattcgtgtaataacccaaaagagaaggtcaaagtggctgcttcaaagctccagtgtggagatccatttgctgcaattttgttgcttgcctcaacaagcgccattgaattctgttactgcctcacttaggaaaggccgtaaaaacttcaatgataaatcgtactagcatatttcaaacacactgcaattaccaacattgtccagagcaccaaacttctcattgaaactaagagaaagtcttgactaagtactacccccatcccatatatttgaaatttttcagaaatatccacccaaagtgcttcagcaaacacaaccagggaaaaaacaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtgagattatgggtaccccatacccacacggcatggttatccgactagttataggagataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttcatcgctgactggtttgttcgtcctcatggccagcctactacgctgctactgatagcaacatcatcttcaccgactggctcgcctccgtcgccgctgccgactggtttctccgcctacacggctggcctattatgccgccgttgttgggcgtttacgacttcaccaccggcctgccttcgtcgccgccgactggtgtcctcgtctatacggttggttggtcacaccaccgttcatgcgtgtccacgtcttcaccgaccggcctgcctccgtcgccgccgactggtgttctcgcctatacggttggttggtcacaccaccgttcatagctgtccacgtcttcaccgaccggcttgcctttgccgtcgccgactggtgtctctgcctacacggctagcctattatgccgccgttagtgggcatcttcgctttcaccgtcgaccgccttcgtcgccgccgactagtgtcttcattgttattgatggacgactttgttcccacattggccacctctgccatcaccaggggaatattacaaagctaagtcatcattaattttttttatatgatatttttttcctctgcctcactacatcaactggttcgccgttgactaatgagtcgggggctacagatgttatatcgtattttttaaacaattttcataatatttatcttgattgcttgcgacataatctgagtacaaaagtacctatcgagttatggagttctatcttcctatgctttccgtttggtttgtcgatggatagttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtctccgcctgcacggctggcctattatgccgccgttgttgggcatctacgtcttcaccgaccggctgccttcgtctgccaccgactggtgtctccgcctgcacggctggcctattatgctgccgttgttgagcgtctacgtcttcaacgaccggcttgccttcgtcgctgccgactggtgtctccgcctgcacggccggcctattatgccgccgttgttgggcatctacgtcttcaccgaccggccgcctcgtctgctgtcgactggtgtctccgcctgcacggctagcctattatgccgccgttgttgggcgtctacgtcttcaccgaccggccgcctcgtccgccgccgactggtgtttacgcctgcacggcgggcctattatgctgccgttgttgggtgtctacgtcttcaccgaccggccgcctcgtccgccgccgactggtgtttccgcctgcacggttggcctattatgccgccgttgttgggcgtatacgtcttcaccgaccggccgcctcgtccaccgtcgactgatgtttccgcctgcacagctggcttgttatgacgccaactgatgctatcttctttacggctggctacgtcgccgtcaccgctaataggcgtcatcatcttcaacgcaagctgtctacgtctactgccgactagtttcttcacttccatggctgcatgattctgccagtgttgattggccttatcgtcttcatcgccggtcgtctcgtctgctgctgactagtgccctcgcctctacgtctggtttataccgctaccattattgttggtcgccttcatcttcattgctggctgacctgactactgccgattggtttcttcgcctctacggctgtgcaactttgtcaccggcaccgacaaactctattgccgctacttcgctagttttgctacttcaccagccacgacgtctacaagagcttcgttatatcggcatgcgtcaccaaatatgatgccatgttattttactacaacaagtggtattccaatcttcaatatttctactcggatatcttcaacatgcatcttcactcaagcaatgactactcgacgacaagaagctaaagttttcgactctatgttcagttgtttcccaactaactaaagagtcgggggcaacacaaatacacggctcaaaattcgacaggttttatgtcaagatgaagcaatcaactaatcagccaacgagttctatggaatctacttcagcaactcttattatttcaccagtaattttggtttctccacgccgctacaatctactccaaatttctcaattatcaagtttgagatttaatctacatgttcgggagttgtatcagtcttcattatgcacacgctcgcatcaaggaaactacttgagcttcaatatcttctcaatagtttgatggattattgtcactggcatcatcaccagcacctctacttcatcggccctgacgtcttcgccgttgctaaggggtgactacgtcttcaccttcggttgcttctgtcatcactagctttcatcgccgacttgttatttcgttttcacggttggcctactacgcaaccgccgaggggagacctcatcattatcattaactgctacattgctatcaatgggcaacttcatcatcacatttgatcatctctattgctgccaatcgtcattaccatcggttgcatttgtcgtcgtcgactatttcctgcattttcatgattggaggatttcgccattgtatttgatgcacgtctacgtcttcatcgttggcttgttttcatcgccaccgactgatattctcgccttcacggctggcttattatgtcgccactaatgggcattttcatcttcttcaccagctgtctcgtctgtttctgactgattattttgtcaccatggctacaaaattctgtcgctattgctgggtgccttcatcttcactgctagttgatatgactgcttccgactggtttcttcgcttccatgccgattgcatcagctattaccgatggacaattttgactatgacagaaggacaagctatatgctcaggggcttatcagctcaaacacaagcgcgaggattatatcttcaatttggacttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttaggcaaaagtgcacgtgattatgtgcccaataccttaaaatccttttataccgcagttactcaactttttaggagttggtacaatgcatcttaaaaggtgtcaaacagtaaagctttatatagctgctccgctgacttttttatatagtcatgacactgtttgggtttatcaagcaattgattagatacaatatcattgcttttcgccacgtaagtgtgcatttttattgaccaatattatggcttaagctgattatatatcttggtcattttccaggcggttggtaaatcctttatgagtttatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcatatgagacaactagatcgtcagatctatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcaacaacgggttagccactagttttttactaatcacaattgcttagagaggtttaatgacatacttgaaaaaacaaatatatgatgtaggttgagtgtgaattcacttttcattggcaagttttaaatgtttttcctccacgatatttgcggtcagattatattgttatatactccctccattaacctttgttatgatgtttgaatattcatcctatttgctagtatgctaccaagtcctatatagaatcaaatgttatatgtatgacaaaattcctaagtagataagtaaggtgtcccatataagaaagagaagtagagtgtaaaatcaaaggtgtttttgattattattctgtgatgaacgattggcattgcagattattggttttgttatttggaatttattcacaaagtggttttggagatgattggattcacaggtgatcgcagatttatcattttatgtgaccggtcagaccgggctatgtatgccggtcagaccggcggtgatcgagcggtcggaccggccagtccgcggtcagaccggccgacgctgtgtcagtttcggttttgggttatttgtttggatatccgtgattatttcatgattatagcttctagatggatactatacgtatgtaatactgttgtttgctactaatgagtcaagttggagatagcttggtcttggaatatggtttctttgtttaattcatatgtaggtgactcgatgtctcggaagagtatttgcggtgatggaccgggagtcggcttggggataagacgacgtccgtggtaatcagagatcatgcgggatactaaggctagagttgatgcatgtggttgatggagattccatatgtcatacgatggaggtattgtgtgcgtatgggatgcggagtcgaatttggaaggagtccaaatttggtacgattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtctcgagtttagtcaaaattttgtaaaggantgctgttggtgcactttgtaaacacagagagaatcaataagtcgntcatccactttaagagttcttcgatntgtgtttcaccgggtttcgcggtagtaatcggcggcacacagcggttcagaccggcggcatcgcgacggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttgttttcttctttggatttttatcgatctagagtttttgccatggctactcctgctaggttttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgaagcttcttcatctaagtcttcttttgttgctgtttttaatgccacatccgatgatcaactcgaacagatcgaggaggaggatttggctttggttgctgacagaattgctcgagctatagtgccaggaacaggaaaagaggtggtccaaatcgttgctttgaatg

SEQ ID NO: 31078 - DNA, 3130 bp, Oryza sativa
ttaaaatatcttattcccaatgatgatgattgttcaaattgtgaggttttaatgaatgagatttcaaaatttagagatgttaatgctgcacatggtttgaaaaatagatcttctcttgcttgtagttttactttgcacacacgcactttggatgagttgtttttaactaaaaagttgttgcaaaaatatcaaattggttttcatgctagtttgatgtttaacatgatttctgctaaaaaagttaaaacaacctcatgatgttttggattgctcaacatgtaatttgaataagttgaaattgaaagattctttaggttgtgttgagtacatggaagatgttgtgaaaaacaatgaagtgctttattgcaccaaatgtcgtaaaagcaaaggtgtcatggtgattgtgaaaattgtgctaatttggaaaaagaggtttcttatttgaaaaattctttgctaagattttctgatggtaaaaagaacctcaacatgattttggatcaatcaaaggttagcacacataaccgtggtttagtttttaatccttatgctcataattctagacatcctcctattgtgttaggtgttggtgctagaagtggtgagattttggttaaacctgattctaacaaaactgtgtttagatctgctggtatcatatctaccttgaatgcatctttttcaaaatccaatgttgtgcattcaaaatctcctgttgttgcttgtgttgctaaatcttctaatgctaccaatctgtctaatcatcgtgaaaaatatacttgttctttttgtggaaaagatgaacatattgttggtttttgtttcagattagctcataaacagaaaaaggagagagagattgcttttgcaaaatcaaagtggcaaaaatcgggttttccctcgaggaaaccggtcagaccgcagtgggtcccgcggtcggaccggtgaccggtcagactggctactgagcgtcggtcagactggcggtacagaggcggtcagaccggccactgtacctcggtcagaccggcctcggaggaaattttccgaaaattctataattgattttgcacgtggatatatgcctattggatcttctagtcatgtgtctcagtactggattcctaaatttttattatcatctaaccccagtactgaggcttcgacttctacttgtgtgtaggctttggtggcaaggaaggagaacgtgtggatcgtggatttcggttgttcgcggcacatgaccggtgataaaaattggttctcctcactcaaaaaggcatccaagactgaatcgattatcattggtgatgcttctacaagtgccgttctcgctataggtttggttaaggtaaatgaaaaatttgaattgaagaatgtaactttggttgaggacttaaagtacaatttgctttcagtttcacaaattgttgatgaaaattttaaggttcactttaagaaaactagaagtaaagtttttgattcttgtggtgattttgtgttgaatatttctcgctatggaagagtgtttaaagctgattttgaaaatcctgtttcacctgtgataacatgtttggttgctaagtttaataaagatgtgatgttttgtcatcgtagacttggacatgttggttttgatcatctcactaggttaagtggtttggatctagttcgtggtttgcctaaacttaagaaagatcttaatttggtttgtacaccgtgtcgtcatgctaaaatggtttctacttcacatgctcctattgtttctgtgatgacggatgcaccgggacagctattacatatggacattgttggtctagctagagtgcaatctgttggaggaaagtagtatgtgttggttattgttgacgattttcctcgatattcttgagttttctttatggcaactaaggacgaaacttttcaaccctttcgtggtttgtttcttcgattggatcttgaatttcctggttctttgaaaagaattcgaagtgataatggtggtgaatttaaaaatacttcatttgaaaaattttgcaatgaaagaggtcttgaacatgaattttcttctcctcgtgtccctcaacaaaacggtgttgttgaaaggaaaaatcgtgttttggttgagatggctagaacgatgttggatgactataaaactcctagaaaattttgggctgaagcttttaacacagcttgttatatttcaactcgggttttcttgagatctaaacttggaaaaacttcttatgaacttcgatttggtcatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttcttttgatgaggctagtccaggtactagacccgatattgcaggtacactatcacaggttcagggggaggatggttgtatttttgaagacgagagcaacgacaacgacgatgacgaggtcggctcggccggtcagaccgggtgccaggccggtcagaccaccggcacaccttcggtcagaccgacggaagacgtgcggtaagaccggccagggccgtcggctgagggttctgttgacgctgttcgagatggtcctccggagattacaacttcgactagtactgatacggaacgtggatcaacttcagaagtcgctgctcctttgcacattcaacaacgacatccgccggaacaaattattggtaatacaggtgagcggactacaaggtctaaggtaacgactcatgatgtttgtgtaaattctgcatttgttgcttcttttgaacccaaagatgtttcacatgcattaactgatgaatcgtggattaacgccatgcatgaagaacatgaaaattttgagagaaacaaagtttggactttagttgaaccaccttctggacataatattattggaaccaagtgggttttcaaaaataaacaaaatgaggatggtttgattgtgagaaataaagctagacttgttgctcaagattttacccaggttgagggtttggattttgtt

SEQ ID NO: 31079 - DNA, 3321 bp, Oryza sativa
ttcgagctcggtaccctgtgtacttattttggagactaacaaaatcgttgaaacttgcgaagtttcttttgatgaggctagtctatgtactagacccgatatttcagatatattgtcataggttcagggggaggatggtcgtatttttgaagacgagagcgacgacgacgacgaggtcagctcggccagtcagaccgagcgccaggccggtcagaccgccggcatgccaccggtcaaaccaccacagggggtgcggtcagaccggccaggcttgtcgggttcgggtactgttgatgctgatcgagatggtcctctagagattacaacttcgaccagtgctgatacagaacgtgaatcaacttcaaaagtcgctgttcctttgcatattcaatgacgacatccgccgaaacaaatcattagtaatataggtgagcggactacaaggtctaaaataacgactcatgatgtttgtgcaaattctgcatttgttgcttcttttgaacacaaagatgtttcacatgcattaactgatgaatcgtggattaacgccatgcatgaagaacatgaaaattttgagagaaacaaagtttggactttagttgaaccaccttctgggcataatattattggaaccaagtgcctggtcaaaatattattggaatcaagtgggttttcaaaaataaacaaaatgaggatggtttgattgtgagaaataaagttagacttgttgctcaaggttttacccaggtgaagggtttggattttgatgaaacttttgctcctgttgctagaattgaggcaattagacttttgttggcttttgctgcttcaaaaggttttaaattgtatcaaatgaatgtgaaaagtgcttttctaaatggttttatacaggaggaagtttatgtcaaacaatcatcaggttttgaaaatcctgattttcccaaccatgtttttaaattgtctaaagctttgtatagtttgaaacaagcacctagagcatggtatgataggcttaagaactttttgcttgcgtaaggttttacaatgggaatggttgacaaaacgctttttgttcttaagcatggtgataatcaactgttcgttcagatttatgtggatgatatcatctttggttgttcaactcacgctttggttgtggattttactgagactatgcgcagggaatttgagatgagcatgatgggtgaggtatcgtactttttgggattgcaaataagcaaacatctcaaggtacttttgtgcatcaaacgaagtatacaaaggatcttttgagaccgttcaagatggagaattgcaagccaatttcaacaccaaatggttctacagctgtgttggatcctgatgaagatggtgaagctgttgatcaaaaagagtatagaagtatgattggatctttgttgtttctaactgcttctaggccagacatacaatttgttgtgtgtttgtgtgcacgctttcaagcttctaggccagacatacatcgtcaagtggtcaagcgaataatgaggtatttgaatcatacacttgagtttggaatttggtattctacttcatcttctatatgcttaagtagatattcagatgctgattttggaggttgtagaattgataggaaaagtactagtggaatatgtcattttcttggtacatcattgattgcatggtcttctaggaaacaatctagtgttgctcaatcaactactgaatctgaatatgttgctgctgctagttgttgttcacagattctttggcttttatctactttgaaagattatggtcttacttttgagaaagtacctctcttttgtgataatactagtgctatcaatattgctaagaatcctgttcaacactcacgtacaaagcacattgatattcgttttcactttttgagggatcatgttgagaagagagatgttgaattgcagtttttggataccaagttgcaaattgctgatattttccataaacctttggatcataatcgctttgcttttcttcgttgtgaattgggaataattcatccttttggcatggtttgagggggagtttgtatctcatggttttatcaagcaataatatgacaatgagaaaaaattgagaaaagagaactttgtttatacatatggtattttcttgcgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatgtggtttgatttataaatgctctatatatatatgctttattgaattgttattcctcaaatagctttaattgctcattgtgaaaaagagaataaaaaatatgaaaaaaatgaataccgaatccttggaaacagtcttgacgacaaggacgtattcgatgtgagcaaaataatgggtgccgaatccctagaaacagtcttgacgacagggacgtacccggaataaaagagaaaaatatgagaaaaaaggctcaagaaaagaaaaagttaaaaaattctcttggttattttgtgctaaaggttatttgagaaagagtgataaatgtaataggtatatgtgtttagtgtttattcttcaacctatgtgcttgttcagatgttgcattataaatcgtatgaaatcatgaatttcgattgttgattcaagcttaattgtaaaatctttggtttatggttatactttaatacatgcttgttatcttatagataggtttatcttctttttattgcaacaaatgacttgatatattatatgtatgctaagctcttgaacattaatgaacataattcctatgttggatgaaatcattgtcaaaagggggagaagtattgtgaaaatttttggatttttgggagaagcaaggtgaattttcggagttgttgagaagagcatgtttttgttcaattgggaatttctttcttttaaaaagggggagaagttttcttttggatttttgagcacgatgtgtacgtttgtacgacgtgtgctttttaccacttttgtttttatttttccaaacaccaaaacatttttgataggtttgccaatgtgttcatcaaaggggagattgtaaaaccaaatgtgtttttgattattattctatgatgaacaattggcattggagattattggttttggtatttagaatttattcacgaagtggttttggagatgattggattcataggtgatcgcaggtttatcattttatgtgaccggtcaga

SEQ ID NO: 31080 - DNA, 4463 bp, Oryza sativa
  unsure (1)..(4463): unsure at all n locations
ctttatgacataacaacatgtaaacactgaaaactaaagacaagtgtacttatttttcatctgatcattctgttttttaagatggtctcaggggcggatctatagtattagcatcggtgtcaggcaacaacgatgactttcgacaaaacttacggttaaactgcttatccatgtattattacattatagtctaggtataaatagcatgctatgacaccgatatacacattataacaccaacgaatcaattttctagattcgccactggatgatctcattatcttgtttgtacgccactcaagacagagatcggcaagtctgttattttggcgagcatgtcagttgaaactaggtccttataaattgccaccgctttacatcgaattgttagtgtcaaacaataatcttaaggcaattttaattttgaaacaatattgtttgaaaattctattgccaacgcacacccccacccacccccacacacaccatgtcgatgattgataatggcactgtcacccctctgcaacacgaatgtccagatgcaaggaggttgaagctgactttggtgcatatcgagtttttttttttgaaaacaaggaaattattataagaaacatagaacatgggttattttacaattgataggagagagtagacttctggcatgacagagtctagtagggtaagcaatatgagaaatatttggacagttaataacaggatttgaaaacagactggttctagcttctttagctaacttgtcagccaccttgttgattttccatggaatccatgccacctggaacaaattttcagctatgtctctttgaatttggctccataaaggtctgaggctccaatggcctggttcattgttgaagtctcttttcttgatcgtgtccgctattactgaattatcagttaaaaaactagtgcctgcaaagttgaagaatttggcaatctccatagctagttgcagtgccaccagttctgcctgcaaagaatattgagctacctcgcttttggctttaataaaagagatttgctgaagtatgtcaaacggtactaaatcattttcgatcgttggatctagctaggcagggtattagaccagagcaaatctcttaataaaaagagcattgtgtgtcatcggcatgtggaagaaaataccaatccctatgaaagtgttctcccaagctgcatctatataacatctattgccctccgaaatggtttccattcttcttttgttttcctcctcctgagattccacctgcaaattatgatttgtagagtatatgtatttatcatagcttctgccgcaaaacacaaaacacacttgggtcggctcctttaagatgccctgaaatttcagatcatttctggccttccaaagctaccacaagataatgaaaagatttatggatatcaattttattagtactattttttttagataaaggattataaattaacccggcctctacaccttttaggaggtgaccatttgaggaaatgtaagcaatgatgtgagccagagaaacattatcagggaaaatgtcagtagaaagatttgcttcagaaattctccacgttattctgctaaaggaacaacgaaagaaaagatggaaatatgtttcaggttgattgcacctacagcaattagctgaaatatcagaaattctgtgatttaacttttgcgctgaatgcagaactttctccgagcagtctccaagcaaaaactttaaccgtgggaggagtaagcttgtccttccagatgattttgatgatagaagtcaccaggggatttacctgttgaaagttatgaatctgatcacttttcataatctccttatatgcactcttagtattacaaattccattcttagaatgcttccaagttccaacaaagcaattcattatcattatgaatgatctggacctgcaaaattttgttcacagcttgattttcaaagattaaattaagtttctcaccatcccaggttttattatcagtccacaggtcagcaaccatggttgtgaatagggtcaagtttaatgaaatcatgaatatcagaatctagctcacaccatggttggctccaatgaatgcttctccgtggctggccagctgtatgggtgttagggtgtatggcacgaacaatacaaatcataaaaaaaaaaaagaggaaacaatattaagtcccagtggatgcccttccagtgcgtctgaattcatccgatgaaaccggtttgcagtgtgatcctcttctctttgctcattcatcgctgccttccggcttaaacttagtgtttttagtttgatttgacccaacaataaaccatgctgatgtgtcgatttttctaatatatagttaaatggacggaaacagtcaaaatcgacatctctccggaaatgattctcctttggttgagaaaattaatcatatttttcacttttattattcagtgctgacagcaataagatgctacaagaacatagaaaaatcaaattatatatatatatagaataataataataataataataaagaaaaatagtagctcttatacgaaaatgtcggttggtcattgaggaattttcatgattacctgcattcgtttggagaacaaagggagtttgtttatttcgttttccgcgtgcgtacttcccaaactactaaacggtgcgttttttgcaaacattttctatatgaaatttactttaaaaaatcatattaatccatttttaaagtttaaaatagttaatacttaattaatcatgcactaatggcttatctcgttttgcgtatcttcccaattttcttaatcccctctccctcaaacacagacaaaattttatgtagatcgtgcattctacaacttttatgtagttaagtagttagtacacactagagctcaacatgtaagaatgtcaaatcatcattccatactattttcatgatatttcaacatatatttatccatcatgtgtataatgtctaacgtaagttcatctatatatttcacacttgcatctagtttacatgaggtcaacaaccagaaccttgcgatgattgacatatatagtaataattgtataatgcttcttctgagaataacacttagtctctgcaattttcgctaaactatttgtggcagctggctttattggatatgcctatgccagtagttggttccagtattaaattgctataaaaatagtatattagcaaataattacatatatactacccggtagtcaacccttgtattcttcactactaaaaaaacattttttcatgcgatcaaaataggtttttccatgcggaggaattgcctgtctgcactagaagtatgggaaaatcaatattttcacgtgcgggcagctcaaccgcaggggaaaatcatcttccagtgcagtcaggttaagtggactgcatgggataccgcccacacgtaaaagaaaaacaaaataaaaaaaataaaaaatcctaaccctagaatcgcctgccgccgctcccggctgccatcatcgcgccgtcgccgcaccctgttgctgtcgtcgtgacgccgcagcgaccgtcgtctacgcccgagaccaccaccgtcgcgccggctgccaccgccattggatccgcacgcatccgggtgggggacggccgccgccgctggatacgggcaggggccagttgccgccgccgtctgtgcccacggtagagccacacggtgcctcgctgccatccgcgcccgcgcctgctggccgccactgccgctcgtcgtcgccgtgatcgcgccaccgccgctcccgattgagcccgccgctgctggcaacgccgcgaccaaccacctttgccgctagctcctgcgggctgcctcctactcctccttgtgcgatcggtggggaggagagggaaggagaggagaggaaagggaaaagtaggagaggaaagtggaaaagtaggtgcgtacacagagagagaggggtgagagtaattgagggatttaatataagggaaaagaaggagagaagttgaaaattttgaagtgagtaggaggaaaaagaaggagaggtattttcgcgggcggttcagttaagaggcccgcacgtaaaatcgattttcgcctgtgggccttttaagggtctgcatgtgaaaatacccttatattttcgtgatggttaagaggcccgcatgcgaaaatcgattttcgtgtgcgggcctcttaagggtccacatgcgaaaatgggacgccaatttatccgtgcgaacgcaaaaacagtccgtctacaatctaaatagctcctcgtacaggaaaaatccttttttagtagggcttatgaatggcgtgaaatntagggttttatgaacttaaactgtatatttaggttgtagataaatacattttaaaatttactagaaggagcataaactgtaattcaagaaatggatggcttactgaat

SEQ ID NO: 31081 - DNA, 27128 bp, Oryza sativa
ccccccccccgtgcgcatggtccgcggtgagccgtgaggctacgcgtgggcccgccgcaccgcgtcctccgcgaaccgcgcgcatgcgccgcgcctccctccaaaaaccctagcacgccccgcgtgcacctcgctcacggtgagccgagtcgccgacaagcgggtcccacccgggaccacgcgggatggacctggcccaccggctctctcactctctcctccccgcccgcgcgcgcgctttgggccgccttcttgggccggccggcccattaagctcggccgagccgcccctttctctcgggccgcgccctagccgcccgaggaaagtctaatttccctccctccttcttttcctttcttttctttttttttaaaaaggatttaaataaatccttttcctttagaccaaaaatccaataatcttagaaattcaatatcttcccaaccgtaagtccgtttgactccgttcaacttccaaaattcctcaaatctcgaaatctatctaatggcacgcttagaggtcaataatagggctttatttttcgccgtttgttgagttgtcccgtttcgcgtgtagtttcggagcccgaagacccgcagtgcgaggatttcgaggatcaagctcaagatctcgagcaaggcaagccacctttgaacatattgagcctatatttgaacttaattatattgcttgcaaaatattatgcattgaaaggattgcacttaatctgtttgcaccgtctgcaaggcagaccggtgggcctacctaacttgttgcatctgatccttccattgttaattgttatatcatgttcccttgcaaccccttagttgcgcctcggtaatcgtgcactctgtatgagtatcgacggtcgccatcaaacttaaaatctgagaaacattctgagtaaaacttgggttttacaaaagactcggaaaacccgacacctgggtcggtgcttgcgaactaaatgaatttccaaaatcgcagaccggggaacgtaccgggtgtacggttacccgctcttgcacttaaggaccgtttccttggaatttcatccgaacataagacaagtacgaccacatgggtggaatgggacacccctggctgagtaattagctaatcaggggagccttgatgctgagagacaagtggattcgccggggtggtgtcggggaggacccctgggcttcctggcacagtatggtccgggacctaacctgttgttggtctgggacccctctcgtcagcatatggtgaacctgtgtcggctttcgaaatgccttgtcatgaaagccttaaggtctctagacgtggccgtactacacgggctggatgatccgggttagtaatgtcgtgtgggtaaagtgtaccccctctgcagaggttattaaactgttcgaacagctgtgccctcggtcatgggcggatgtgaggtgatttctagcgtagttttgtttgactactgctttgtgaaatttgctgatgaggtttgggattgatgtttggaaaatctgcggctgatgggatcagccaggctcgggtggccgtttgaaagctgttggccgggtgccaaccttgatcaattcaaaagactgatacattgcacatactccgaccggacgagacgcactgtctcatccgtgtcgtttgagaagcactcacttagttgttttcagaaaagagtttaagtaaaatcaattgcaaaaacaacagcctttccttgaagcctgcattaaacacttatttcccatggcttgctgagtactcctgtactcacccttgctctatataaataatcccccccagttgctgaagaagatgaagtagatcccgctgacgaggagttcttccaggagcaagtcggctacgatgagttttagggttttggcctagttcccaagtcgcgcctgtgatgtttggtccaagtcttggcttccgcttccctcttgtaatgtagttgtgagctcgggatctgtccgcagcccaacatgactgtactcctactctataataaagagacttctgttgctctgatattctgacttcctgtgataccagcactgtttcctgggactggtatcgattaacaggttaaattggagcgtcacgggctaattccgctcaggactagttcggggtgtgacacctaagtatcctgcatgatatctgaccatcacggacatcgccttatccccaagtcgactcccgatccatcaccggcaatactctcccgaggcatcaagtcaccaacacatgaatcaaacaaagaaaccatattccgagatcaagctatctccaacttgacttattgttagtaaacaacggtattacatatgcatagtatccatctagaagccataaacatgaaacaatcacaactatccgaacaaatcaacccgaaaccggagtcggccggtcagaccacgggctgggccgatcagaccgtgggctgagccggtctgaccactcgatcaccgctggtttgaccggcaacacatgcccgatctgaccggtcctgacaaaccagtaacacctgtatatcacctgtaactccaatcatctccaaaactacttcaccaataatctccaaatttcaaaaccaaaaatctcaaatgccaattgttcatcacagaataagaataaaaaacactttgattttacaatctaccccttgatgaacacattggcaaacccatcaaaaatgttttgttgtttggaaaaataaaaacaaatgtggtagagagcacaaaagtggtaaaaagcacacttcgtaccaaagtacacatcgtgctcaaaatcaaaaagaaaacttttctcacttttaaaaataaagaaatccccccttgaacaaaaaacatgctcttcccaaactcttctcccccttttgacaatgatttcatcatgcataggaattatgttcagtaatattcaagagcttagcatacatatagcatatcgtgtcatgtgtcgcaataaaaagaagatgaacccatcattaatatagcaagcatgcattaaagtataatcatgaaccaaagattttacaatgaagttcaaatcaacaatcataattcatgatttcgtactatttataatgcaacatcttaacaagcacataggttgaaaaataaacactatacatatccacctattgcaatcatcactctttcttgaaagagctctagcacaaaacaaccaagacaattttttaacttttatttgagcctgtttgctcattttttccctcaattatttcgggtatgtccttgtcgtcaagactgtttccaaggattcggcacccattatttttgctcacatcgaatacgttctggtcgtcaagactgtttctaaggattcggtattcattttatctctcatacatattttttattctcttgcacaatgagcaattacaaagctatttgaggaataataattcaataaagcatttataaatcaaaccatatgctagcatatatattgcatttttttaaattcaaatatagaatttaagtgtcatgcatcatctccattgaaagcaatatctaagcctcataaaaaaactaaaatacacacaagctatgctagatacaaataaaccttcatagtattgctagcatgcacaagaatataccatatgtataaaacaaagctctcttttctcaatttttcttattgtcaaattttgcttgataaaaccataatgtacaaaaactccccttcaaatcacgccaaaaggatgaactattcccaattctacacgaagaatagcaaatcgattagaatccaatggtttagtgaaaatatcagcaagttgcaactttgtatccaaaaacgtcaattcaacatctcccctctcaacatgttccctcaaaaagtgaaagcgaatatcaatgtgctttgtgtgtgagtgttgtgcaggattcttagcaatgttaatagcactagtattatcacaaaagagaggtactttctcaaaagtaagaccataatctttcaaagttgatataagccaaagaatttgagaacaacaactagcagcagcaacatattctgattcagcagttgattgaacaacactagattgtttcctagaagaccatgcaatcaatgatgtaccaagaaaatgacaagttccactagtacttttcctatcaactctacaaccagcaaaatcagcattggaatatccactgaagcatatagaagatgaagtagaataccaaattccaaactcaagtatatgattcaaatacgtcattattcgcttgaccgcttgatgatgtgaagcacgaggagaagcttgaaagcgtgcacacaaacacacaacaaattgtatatctggcctagaagcagttagatacaactaagatccaatcatacttctatactccttctgatcaacagctttaccatcttcaccaggatccaacacagctgtagaaccaattcgtgttgatattggcttgcaattctccatcttgaaccgtctcaaaagatccttcgtgtacttcgtttgatgcacaaatgtaccttgaggtgtttgcttaatttgcaatcccaaaaagtacgataactcacccatcatgctcatctcaaattccctgcgtatagtctcagcaaactccacaagcaaagcatgagttgaacaaccaaagatgatatcatccacataaatctgaacgaacagttgattatcaccatgcttaagaacaaaaagcgttttgtcaatctttcccattgaaaaacctttcgcaagcaaaaagttattaagcctatcataccatgttctaggttcttgtttcaaaccatacaaagctttagacaatttaaaaacatgattggaaaaatcaggattttcaaaacctggtggttgtttgacataaacttattactgtataaaacctaaaaccatttagaaaaacacttttcacatccatttgatacaatttaaaatcttttgaagcaacaaaagctaacaaaagtgtaattgccttaattctagcaacaggagcaaaagttttatcaaaatccaaaccctccacctgagtaaaaccttgagcaacaagtctagctttatttctcacaatcaaaccatcctcattttgtttatttttgaaaacccacttggtttcaataatgtgcagggtaaccaagaaacattccattggtagagcgtgcttcaaacttattcaaatttgcagatttcaatataaagtatttgtaaccaaaaacacgcaaatgtgaaactttgggttgacgttcaaatcgaagttcataagaagtttttccaagttttgatctcaagaaaacccgatttgaaatatagcatgtagtgtttatcgcctcagcccaaaattttctaggagttttatactcatccaacatcgttctagccatcccaaccaaaacacgatttttcctttcaacaacaccgttttgttgcagaacacgaggagaagaaaattcacgttcaagacctctttcgttgcaaaattgttcaaaagaagcatttttaaactcaccaccattatcacttcgaattcttttcaaagaactaggaaattcaagatccaatcaaagaaacaaaccacaaaagtgttgaaaagcctcatccttagttgccatgaagaaaacccaagaatatcaagaaaaatcatcaaccataaccaacacataccactgtcctccaacagattgcactctagctggaccaacagtatccatgtgtaatagttgtcccggtgcatccgtcatcacaaaaataataggagcatgtgaagaagtaaccatcttagcatgacgaaactgtgtacaaaccaaatcaagatctttcttaagtttaggcaaaccatgaacaagatccaaaccacttaacctcgtgagatgatcaaaaccaacatgtccaagtctacgatgctaaaacatcacatccttattaaacttagcaaccaaatatgttatcacaggtgaaacaggattttcaaaaccagcttttgtcgaaacaataattcagcaatataaagggggtagcgcatgagacctaaaagtggatggatgcggagacaaagatttagacaggtcaggacctctcgatgagaggtaataccttactcctgtttagggatttgaattcgccgtgtgtattatagatctgacgatctagttgtgtatcatgccccctagagggcctcctgcccaccttatataggatgaggggcaggattacaagatagaaatcttaaccgatacgatatcggtttcctatatgtactttacaatattatcaaatcaggactttaggccattccataatatataaggaaacgtaatacccaagtcatgatccgttacatatttcatagatataagttatcccctataactagtcggataactatgccgtgtgggtatggggtacccataatcttcacagtagcccctgagaccttcacagtcgaaaagataatcttctttcgaactagattactccaaagccgagtgcttcaatcatcttctcatcttcgccatggtttcccgagtacttttaccaaatctaaagactgtggagagctgaaaaataactgaatgtaaacttaggtgcatcaattagattcacctaataggtgtagcccccgactatgtgattagttgaacaagctaaacatatagtcaaggagtaaataatccaaccaaccgagtggttttgataactgtagtcaatcaagtgacttgatattaatatatagcatatgcggtgtgaattcccgaataacatgatccgagtgatataccgactgctttgtaaaatatgatgcgtgcaatctaaagttgactacatcattgaaaatttacatagcaaaacagctataaagaagcttgtatattgtgaataaagaaatttctaaagtattgggcatacaccatgcgcacactgctttaacagatgtgcttaagtccctaaaagacacatgatttcaccacacttggaaatatatggcatatgtggtataaaatccgagtaaataaactcataaaggatttaccaaccacctagaaaaatgaccacaatatataatcagcctaaaccaataaaaatgttcacttacgtggcaaaaagcaacgatattgtatccaatcaattgctttaaaaacccacacagtgccttgacttatataaaaaagtcagtggggtagctatataaagaattctggagttgtcggtaatcctctcttatctcttgtactttatttattactctgatttaatagaaatatcattctgagtaattaagatttacttagtgagaattacttcttggttagttcctaattagcatacgggatcattgttcactatagtccatttatttatagtgattgctttagtgtttgatcggcactaaagtagttattaattgcgtagatgcggtgcctgggtaattaatctccagtggttgatgcatatcccacagtacgtttgaggtgggtctagaggtggtgacagccctcaagagcacttaagtcctccctgtccgggtacgtagtagagcgaaatctgagaacaacgggttgccagtgcctgaagtattgcgttaggattaaagttaagcttttcctagacacatcacttctgaccctaaagggaggtgttcggcggtggacgctagggtttgttggatgcaacctgtagctgtcgttctacgtctattatagtttttagataataaattaaaacccaggcctttacatctaaaatggatgtacagagccatcctagatatatactccctccgtactcgtaaagtaagccgtttaggacaatatttaagtcaaaccttgagaacattaaatcatgaataactcttaagttgttgagtttgaaaatttaaaattatatgaatagatttgccttgaaaaatactttcataaaaatatacatatatcacttttcaataaatattattatagaaacaagaagtcaaagttgtgttttggagaccgtgtcgctgtgcaaaacgacttcctttatgagtaaggagggagtatatatatctgagaggtcgaagatgcattctatcccttgtcccacaattaagctcattgatcagctttcgtcatcatcccactgctccccgcatgttgcccaccttgttggaaataaaccttacacgatgtatctagtagtagctagttttacgttcctttctgttgatgcatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagcggcgggagcgaccgcgggctggtgatccaccgcgtggtcaaggaagcaggaggtgcggcgaactacccgctgttgacaagaaccaactacaacgattggtctttgctgatgaagatcaaactgcaagcccggtgcctgtggggcgccatcgatccaggcggtgtcgagcttcatgaggataggatggcgcttgacgccatttgcagcgcggtgccccccgagatgatctcgaccttggccaccaaggcctcggccaaggaggcatgggattgcatcaggatcctgcgaatcggcgacgaccgaattcgcaaagcaagcgcacagaaggtgcgcatggagtacgagtcgctcgtccttcgcgacggtgagaccgtggaggacttcgccatgcgcctgacctccaccgtcaatcaactcgcgacgctcggcgatcccgagccggcagacaaggtcgtcgagaagtacctgcgcgtcgcccgtcccaggttcacccaactcgtcctttccattgaaactctccttgatatctctacactgtccctggaggaggtgaccggcagactcaaggcaggtgaggacgccatgccattgccatcttcgtcctcagacaacgccggcaagctctacctcaccgaggaagaatggctagagcgccacaagaaaaaggagcaggaggcaaagaagaactcaggcagcccaagcaaccgtggcaagcggcgaggcggcaaaggccgcaacggcggcggcgctggagtcgccggcgcggagaatacgaactccggagcggcccgtcgtgaagacaaatgccgcaactgtggcaaatacggccactgggccaaggattgcaggagcaagcccaagcgggatgaacaggtccacgtggcccaagacgacgagcccaccttgcttctcctcacaggaggagtaatcacacatgcacgtgaacaggagcatgcaccagcgccgtctgcgccaactccgtcatccgatcccatctacctggaggaaaagaagctgttcgcggcgctcgacgacgccgcggagcgtgatccgggcagctggattgtggactccggcgcctccaaccacatgaccggctgccggacggccttctccgacattgacacaggcatcaccggcaacgtccgactaggagacggctccgtcgtccgaatcgaagggcgaggcaccgtgctcttctcctgtaagaatggggagcatcgaaccctcgccaacacctacctcattccacgcctcgctgctaacatcattagtgtcgggcagctagacgagaccggtttcaaggtggaggccgaggatggcgttatgcggatatgggatgagcagcggcgcctgcttgcccgtattcaccgcaatcctggacgtctctacgtcctcgacgtcgagctcgcgcgcccggtctgccttacggcacgcatcggcgacgaagcatggaagtggcatgcacggttcggccacattaacttcactgcgctgcggaaaatggccagagagcagctggtgcgcggtcttccggctgtgtcgcaagttgaccagctttgcgaggcttgcctcgccggcaagcaccgtcggacgccgttcccacagcaggctcaacagcgctccctggagccgctccaactactccacggcgacctctgcggcccgatctcgccaccaactccgaccggcaaccggtactttctccttctcgtcgatgattacagccgtttcatgtggttgtcgctgctcccctccaaggatggggtggcggcagccatcaagcgcatccaagccgcggctgaacgcaagagcggcaagaagctacatgctcttcgcacggataggggggagagttcctggtccaccacttcgcggattactgcgccgagctgggagtccgacgcgagacgacggcgccctactcgccgcaacaaaacggcgtcatggaatgtcgcaaccaatcggtggtcgggacggcgcggagcatgctcaaagccaaagggctgccaggtatgttttggggggaggcagtcaccacagctgttatctcctgaacaagtcgtcatccaaaagtattggtgggaagacaccatacgagctgtggaacagatcgcccgcgcccgtccaccacctgcggacgttcgggtgtttggcacacgtcaagaccaccacgccgaatgtcaagaagctcgacgacaggagtaagcccatgatctttgtgggttatgagccggggtcgaaggcgtatcgctgctacgaccctgcctctcggcgcgtgcacatctcacgtgacgtcgcattcgacgaagaggcgcaatggaggtgggacggcgagacggcgagtgagctggacttcaccatcgagtacaccactgtgtaccacccagctgtggcgaacgtgccacgagctgactcggagcagccggagctaccgactccgcccgcgacatcgacaagtccatgcacacctgccgccacggcgggcacaactgcgacatcggcggaattcgcgactccaccaaccatcgccgcggacgacctcgacgccgatcatgatgatgctccgcttcggttccgccgcgtcgacgagatattaggaccggcgaccccgccgggactggctgtgcgcgagttcgatgacgaactcatgatggcaagtgctgaagagccagcgtctctcgccgaggcgcaacagcaagactgttggcgtcaagctatgctggatgagatgaaatcaattgaagaaaacggaacctggctgctcgtcgatcccccacctcgccagcggcccataggactcaagtgggtcttcaagacgaagaaagacgccgccggcaacatcaccaagcacaaagcgcggctcgtcgcaaaaggatacgtgcagcggcagggaatcgactacgacgaagtgttcgccccagttgcacggctcgagtcggttcgtttgctgctggcgtacgcggcgagcgaaggttgggccgtccatcatatggacgtgaaatcagcgttcctcaacggcgagctcaaggaggaagtctacgtcgcgcagccgcccggtttcgtcgtcgacggcaaggaacagaaggtgctgcgcctggtgaaggcgttgtatggacttcgtcaagccccgcgtgcgtggtacaccaagctcgacgcgtcgctgctgtcacttgggttccatcgcagtgcctcagagcacgctgtgtacatgcgcggagctaacgcacgtcgactggtggtcggggtgtacgtcgacgaccttgtcatcaccggcggcaaccactccgagcttgatcaattcaagaaggagatgcgggagacgttccagatgagcgacctcgggctacttcggtactatcttggcctggaggtgagtcagaccgacgagggcatcaccctgagccagggtgcgtgcgcaaagaagatacttgaggcagcaggcatggttggatgcaacccgagccagactccaatggagccacgcctcaaactcagtaagttgagcacatctccttgcgtggatgcaactgattacaggaaaattgtgggtcgctgcgctatttggtgaactcgagaccggacttggcgttctcagtggcttatgtgagtagattcatggagaaacccactaccgagcatctggcagccgtgaaacgtgtgctgcgctatgtcgccggcaccatcaatcgcggctgcagctaccggaggaagaaaggagctgttcatcttgttggattcagtgacagcgatctcgccggcgacgtcgacacgcggaaaagcaccaccggtgtcttcttcttcctcggtgacaacttgattacctggcaatctcagaagcagaaggttgttgccttatcgtcctgtgaagcggagtacattgcggcgacaacagctgcttgccagggtgtgtggctggcgcgtcttcttgccgagctcaagggagaagaagccgacgccgtcacactcaatgtcgacaatcagtcggcaattcaactcagcaaaaaccctgttttccacgatcgcagctagcatatagagaccagatatcactacatcagagaatgcattgaggaggacagggtgaagatcgagttcgtcagtacaaacgatcaactggcggacattctgacgaagtcacttgggcgtgatcggttcaataaactgtgcacaaggattggcctcgtcgaagttaaagggacgtgcaaggtttagggggagatttgttggaaataaaccttacacgatgtatctagtagtagctagttttacgttcctttctgttgctgcatgcatgttagtttttctgttgttgcatgcgcgagctccgggttgtggatgcccatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacacacctgaatcaacaagttctgtccccagcaaaaactcattcctgcccggccgtgtcgtaccggcaaggcgcgtcaagtctcgctgctcagcggtatatatatgccctggcaaattcgatcggttccagcgacaccattctctagaaggctaatagcatagtacagcatatataccgatatatctgcagcttttgttgagttttcttctgctctgtggtgacttctgaccctgatctgtcatctcctctttatacagatcactttcaggtttgtgtgctatatgcctactatatccctccggcttaaggctctgtcttgcgtgcttgtggcttaagcaagcttaattatgtccctgtatatgattcgtacatgtattctgtatcagctagcaacagattcatgtttctgttcctaatggaaaataattttcgggtttgttgttgccctcaaaacagacagagttttaagagatggagggagctctagtgagcacagcaaccggggccttgaagcccgtccttgcgaagctagccgctctgcttggtgataagtacacgatcttcaaggggctgcacaaggagatcaagtctctctctaccgaactcatggccatccatgcgttccttctcaatatgtcagaggaggagaatcctgatgcccaagaccaggcttggatgacggaagtaagggagctatcctacgacatggaggacattattgacgagttcatggtccatgttgatgatgaatctgccactccagatgggttcatcagtaagtgtaagaaatcgctcgcaaatatgaagactaaacgtcgaattgccaaggcaatagaagatttcaagagccaaatcaacattgtcggagaaaggcatgcaaggtatagatcagagaagaccatctgcaggaccagcaatacaatcattgaccacagggctctctctatctttgagcatgcttcaaatcttgtaggtattgaagggccgaaaaatgaagtaatcaaattattgtccgatgatgatggctgtgagtcaaagcaacaacatccaaaggttgtctcggttgttggttttggaggacttggtaaaactactcttgcataccaagtataccaacagctcaagggaaatttttcctgttcggttttcgtatcagtatcacgaaatccagacatgatgagaattctgagaactattttaagtgaggtgacacaacgtgattatgctgtgactgaagctggagatgaacaacaacttattattaaaatttccaattttctttcaaaaaaaaggtaatagtgtggtccctagataaatattcttttacatttccctcaaaaaaaatattcttttacatgaaaacgttggcacaattgaatttgtaatttttatttacatatgatctaatttagctatgcatgtttatagaatgatgtatgacgacataatatacgttgccaatatatagtttgtacagtatttagttattcggatgccatgcgaacgagaggggtatgtgctcaaatgacatgcatgctacctccgttcggaaaaagatgttattgcgcagaccaatgaaattgtgttagatgcagcaaaaattgccagtttgcccctaattaagcattattattagctccaatcacctacttttcgtcttggattgctacaaagaaccatgcgtttagctgtgtgccaactggaaattttcacctagaaaaccgaaaacgatatatctatttgagaacggagataatattccttatatagatatttatttcttataaattgattttggtcactatggatgttataaaattgaacacgtggattacaacttatggtcattttaattcttattattagttaattatatctcttgagttgctagctttccaaaaattaagtgcatgcacatacacttagagaacttttacaatacaatataatggaagtatttactatagctagtagtgtactatatcaggactagatcattatggtaaattatgtttgttgctaatctgtctctaattgcctagatatactctctccgtactcctgtactcctaaaggaagtctgtcacttttcaatatatgaaaagatttgtcttgaaaaatacttttataaaagtatacatatatcacttttcaataaatatttttgtagaaacaaaaaagtaaaagttgtgttttggagaccgtgttgctgcccaaaacgacttcctttacgagtatcgagggagtacaattttaattggttagaaaaattactcaataccatttgatcatttatactagcggtatatatatattggcagtacattataatggaggggatttggcctaaaataatttctttacacgtttaagtgaaaattgatagccaaatgcttcttttttttcgttcagagtagtatatattttccttaatctgttctaggcctaaagagaaatcctagctagaaagttcgatatatctaaatttaggagggaaaacattaaactaagtttaggaatagcatccatggtatatgccgtgttatccgaaagttttgttggacctaaatctatgctaatatatatcacccctaatatttatgcaggtactttgttgtaattgatgacatatggaacgtggaaatatggaacattattaaaggtgcattctccatgaacagtcgctgcagtaaaattatcaccactactcgcataagtgatgtcgctagatcgtgttgttcttcatttcgtggtcatttgtataatatacggccccttgataccgtgcactcaagaacgttatttcatagaaggctattcaaccctcaggaaaaatgtccatcacaccttgaagaagtttctgaccaaatattgaaaaaatgtgacggcttacctctggcaatcatagccatatctggtttattggccaacaaactaaggacaaaggatcaatgggaacatgtgaaaaattcaattggttgtgcacttgaaagaaatcctacggttgagggaatgataagtattttatcattgagttactttgatcttcctcctcatctaaaaacttgtcttttgtatctaagtatatttccagaagactatgtaattaggaagaatgacttgatactgagatggattgctgagggattcattcataaagaggacagtaataccttgtatgaatcaggagaaatgtgtttcaatgaactagtcaacaggaatttgctacaacttgagaagcaaaactacaatggatgtcgagttcatgacacggttcttgattttatcatctcgatgtccaagaaaaataactttgttactttagtgacttctccttgtctaactattgagggacagaacaagatccgtcggctctcccttcaagttggcagcgaggaaggaaattcaatccaacgaacaatgttgtctcatgctcgatctcttgatgtgttttggctgcatctacaggagatcccttctctagtggagtttcggcacttgcgtgttctgagctttcaaggttgcaggtggttgcagagccagcatcttgcaaatataggaaagttgtttcagctaagattcctgaacctcaggaaaacaggtctaaatgaactgccagaagaaatcggatttctgcagaacttgcaggcgctgaacttagaaggcagcaatatgcatcgactaccaccacatattacaaggctgggaaatttggtacatctatttactgacattcggattcaactcccggaaggtattgcgaagatgcggtcactagagacattaaaatgggttgacctatccaaccattcatctaacattgtaaaagaacttggccagctagagaatttgagggaactgaagttgtttatgcccaacgatgatatatgcgatgagcacgtgaaggttattgcctcttgtctagttgaattaggtagacataacctccgtcgtctatatatcgtgggttataccgaattgcctaacagcctcttaccagatccgtggtgcccttcaccacttaaactcgaagaacttgacatctctgactcacctatggtacaggttccgagttggatgcgctcattcgtccagcttaaaaggttaggccttattctaaaggatgtcagtgatgaagatctaaccaccctcggtcgcctaccttctctgctacatcttcatctcaatataccaagaggagaaccagggtacgaggataggctcctcatcagtggctgccatggattctcatgcttgaggcagttttatctcacgggtcagcagccaatttttacagcgggatctatgccaaggctagagctactcagagttgaaatggatgaatctaagccagagtttctaactaatgcttctcttgaaaacctcccctgcctcaccactgtgaaatgtttgcttttcaactttcaacgtggtgaggtggctcaaaatgggaagactgccatggcgagagcaatgagttctcatccgaaccaccctagccttgtgtatgagtagagctggcggtctttcatattatatatcgagctatatatttgatgcacaaccaccaaggaacagccagctggtaactgctaaccacttaattctctcaaacaacacatgattaatgcccagaatttgatcacctctttacactatcagatgatacaattattgtactgatgatggccttggggcacggtttcacgcaatctgcagtgacaaggttgcttatttactagcgtacttagttggtcatcctaaactcgatatcttttacagtgtttgcgaggtacttaaagatattaagagatagaacaatgtaaaccattgatcaagagaggggcaaggtacggaataaaagttaatgtaaccgatagcaacgaagtaaataactagtaaaatatgggtattttgggttaatcaaatacctagctgaattgatccgtattgtttggtagaaaaagttgtaaatcttacgaggcattttgtctccgatacattttgtatcattcggtcgaaaatgtaaatcttcccataaattttatctcctaaataagttttatcattttctaatatttgaatgtatttgagagaatagctactttagtccctaaagtttttctgtaggatcagtttagtccctaaccttttaaatggtccaaaaaaatccttaacctttgtcataagacctagaatagtccttggatccaccaaaaccatcatatggatatgccatgtcatcattcatgcaaaatctataatgaattgtccaatttacccttacgtatatcatagaaaaataaatataagggtgaattagatataaccataggaaaaaatactttttttcaccattttgaggtatatttttgctcttgcatataccatatatttttttaacattttccttttgttttttattttcctatgcgtaagggtaaattagacaaatcatatagattttgcatagaaaggtgacatggcatgtccatgtggcaattttggtgggaccaaggactatattagcccacatgacaaatttaaaggacttgtttggacaatatgaaagaataagaactaaaatgacccaggatcgaaactttaggtaccatattagctattctcccaatgtatttttgtgttgtttcatgtatcacaaatttataattaagttgacatgcatgtgtctatataatgtagcgtatgtgttcatgcatgcacgatgattaagttggaaacgatgatgttcaaattagccccaaatttctagcatgcttaacaagagtaacgcaagttattagttagcaagttcaaatatttgggacgaagatgtgagaataagatcaggatcccactaattaacacagttaattactatagaattaaagagaaaacattttttcttaaaagaatttcctccattgtagcgattgcaccctaatcaacacaataataaaaaatgacacattttttttgtccaaaataacatggctgcatgatcaacaaaacatatcaatttccttcttcacttactgtcatatatgttgtactttgatattttttttaagactttgtactttgaaattatagtatctacctatgttcatgttattgagggagaatatgcaaagatgaacaaacatgtaaatatagcgtattgacaatgaattacatatgaacctacaaaccgatgatcttttactgagtttatatgttctttgtgataaaatatcaattttaaaataaccacacgaacattcggtcatattttatccgattgtgttattagacacaaaatatcgggggcgtctaatgggcgggtgatcgctcccccgtccgtccagcgatcacccgtccgcgccctcacttatacaatacactcctccctcctctctccccttcctcctcccttttttctttttctactacagtaaaccacaaaaaaaaatttaaaaaaaaagttagaaaaatttatgcatagaaataatatatataataaatttgaattcaaattcaaatttgaatcgggtatgtaaacttttgacttataaactttgggtctataaactttaggtatataaactttagatgtatagaaatactatatatagaaaatatttaaattcaaattcaaatttgaatcggatataattcaaattcaaatttaaaacgggtatgtaaacttttgacttataaactttaggtctataaactttaggtgtataaactttagatgcataaaaatactatatatagaaaatatttgaattcaaattcaaatttgaatcagatataattcaaattcaaatttaaaacaggtatgtaaacttttgacttataaactttgggtcattaaactttaggtgtataaactttagatgtatagaaatactatatataaaaaaaattgaattgaaattcaaatttgaatttgaatcgaatatataaacttttgacttataaactttggttctctaaactttagatgtgtaaacttgaggtgtataaactttagatgcataaatttactaaaataatagagtaatacggtgccaaaaaaggaaaccaggtggagggagggagggaagaggggatcgatcgctaccccatagccaaggcgatcgattgcccattagaggtttcgcaaaatatcaacttaaaaaaacatcacgatcatactcttaaaaagaaaatgtaaatctaagaaaaaaaacacgtaaattttttttaagggaaaccgaaaactttattactgaggcaggccagccaaatcgttggtcaccaaatactcaaggcccggcggagtgccggcccagctacaagggtcaagcaaattacaacccagtttcgccagttcatgcactacttgttacattccctggggcaataattaaccaagaatgaaataaatcttctagaaatgacattcttgatctccagaatcacaccccccatgacagagagattgaaagagttctcctggagtgtagacttcagcagcagcgagcctatttcaaactctaccttcattatccccctttcacttgccgcccctacagccgctgcacaagcaataatctcagaatggaatgcatccatcatgttatcagctccgccagctccagcctgaaccacccgtccatgatgatcccgaataacatatccccatccgccttgtttggtgctgctgtggaaggccccatccgagttgatgttcaggacatcagaggtgggttttctccattttgccattctcctctccttcaacttcccctctttccaattcaacttcaagaattcctctccctggttatcaatgatatacgccaagtcaattgggtctctggctttacctccttccctcacttcattcatctgcttccaccattgccacaaacaaacgacagctctcatctgtatattctctgggcacccccaaatggtctccagcacacttcttgcattaggttgttgcgctagagataatctcaggtcttccaagttcatcgcctaccaaactttcttaacaagcttgcacttgaaaagcacttgaaaaacacgtgaattttgtaatgcaggattaccgacgatcatgttcctaggaaggaaatgtaaatctttttagaacacgtaaataacggaaatgagaatcacgggtatagtagagatgaggtaccgatgcggaacctgtgtacctagaactaagaagacaattatgcccttctccatcttaaaaaaaatatccttttacacttactacctaagtacctatatcagtacttaaatatcttttaagtggtatcttttattatggaccattagatttttaccaaacaccgtaaaatctctccttcaacatatagggaatgccttggctgtactctcgagcttccgttccatgaagcggacgttgtagaacaccggcctcgtcgtcactggtgatgaggacgcctattcacccattattagttgcaggcattcattgccgctaggtaagctggccaccctaccaatgccagcactccagccggcgccaccaacgctgctacgccgccctcagcaccctccattacgtgccccttcgtccacggaatcgccgccgcccatctcaaaccccttcttgcccagatctgtcaccctccactgcttctgcagggactccaccaccaccacgccggtcaatgtggccgccctcccctggggaggtctcctaggtctcggaaacgccagatcggggctctagcaccccttaattaaggcgttgtttaggcctcgtttacttggcaaaaacttttgcctatacgtaccacatcggatatacggacacacatttaaagtattaaacgtagtctaataataataaaaaaaactatagattccgctaggaaattgcgagaggaatttattaagcacaattaattcttcattagcaaatatttactgtagcaccacattatcaaatcatggcgcaattagacttaaaagatttgtctcgtaatttacacgcaaaatgtgtaattgattttttattttgtccacatttatactccatacatatgtccaaacattcgatgtgatgggtgaaaagtttttgttttggaaactgtggccttgtttagttcgcgaaaaaaaattttaggtgttacatcagacgtttgaccggatgttggaagggtttttgacacgaataaaaaaactaagttcataacttgcctggaaaacgcgagatgaatctttttagtctaattaatctgtcattagcacatgtgggttactatagcacctatggttaatcaggtgcaattaattgcacagtttgcatggaaatcgcgagacgaatcttttgagcctaattagtctatgattaaccataagtgctacagtaacccacatgtactaatgacggattaatcacgctaaaaagattcatttcgcggtttctaggcaagttatgaaattacttttttcattcgtatccaaatacccttctaatatccggtcaaacgcccgatgtgacccccaaaaattttcttttcgccaaactaaacaaggcccgtaatctagacacgacgctccttcaatccgctctgccaaccagctcgtctccgcatcccatcgagccttcaagaagaagacgcaaggaaggtgctttatctaccttgcgcatgaccatcaagtggtgactatcagggcaatagcaatgcgtcccatgtatataccgaatctcagatgccacatgggctaaggaactgtggtagtcacaagattcacaatgtagcaactccaaagtggggtccacaaaaataaagttctccttttttttctccacttttccccatctccttctccctttcctcgggaccaccgctatccttcttctcccccatctctcacgccttcccctctctctcctctcatgctcgggtggcaacctgactcagtcttctctccttacaccgtgttgggtcggccaggcggagcagcagcctgcggaaacggcgccgaggtggccgggcagagtggcagcctctgaggcaacggagctaggcggagacagcgccgatgcggccgggcggagcgccggcctctgcggcgacggagccggacggagcgccggcctctatggcgacgaagccgggcaaagaggcgacggcaaccgagtagagaggcgaccgaagcggtgacggtgcaggccggagcagcggaggggtgggctcgccggatctagcctcaggttctctctggcgcggatgcggctccctatccctacccccacctcctctctgtctctctcccgctttctccccacgggcggatgcgatttttttagcaaaagttgattttttttttgacgaggttcttggagccaatgttgatcacgtgaacccggcgaaggaatggtcaccacttccctctctcctccacgcaagcactttttctacctggacaaacattgacacatgtcacgtgcgtgcaccgtgaatggcctcagagacccaatctgatgtttctcctgccatcgctcaggttattgtgcctatgaatgcactaaggccattcacagtgcatgtatgtggcgtttggtctcgatgcaccagctcggcgattcccctctacacaagcgttggtcgtaaccctgtgaagtccgcggaaccaattttgtgcactcgttcttctcacaaaatcaaggtcgcgtggcatgggggagaacggtgcagacgcattgtgaggttgtggccttacgggttcgtggctccgcgcttcccctccccatcccccgagctggcgatgaaggaagaagaagagatggcggcggaggaggaagaggaggcgacaaatctggtgcctacctacttgacgccccccgagccatgttgtcactcattgtcgtgtgtcgctccaacccaccggacccatcctcgttttctgatctatgctgctgctcgtcatcatcgcccactccaagccgcaacgacctctccttgacccctccacagcctcaatgggagcctccacgacccatccagatcgatgcgccaccgaggagagggtagaggccgcgctgccgctcgtccttgttgcccatagccatgggcgccgacgaggagagagaaaggatttggcaccgacgaggagaggggtgaagggatttagcgccagagaggggaggagagaggggagatctggcgagcttcgggcttgttttggccgcccggcgctgtcgcttcatggggaccaccgctgcaaacaaccctccgcctggctcgccgtcaccgcttctgcctttcacgagagcatgtgggttggggaaaggggaagcatcggttttggggagagagacggaaaaaggcgagaaaaatattgttttttcatggaccccagttaaggctacatagcacggtgaaacttgtggctaacattattctttggtgttcttggacctacgtgacatatgaggtctggcaaaattcgatgttgcactgctaatgccctaagcagtggtccctaggcaccacctgccgtcaccccccatctctagtgcaaccttcaccgcagagcacctggacggactggcagcgctcacttcgatgacaagctatgcccttgccaccaccacctccaagaactatgcatggaaggcaatggcacttctcggcgacacgcccaattgatgacgagtatctcagcccaacctcctacgcccttgatgaggagcactatgtgacatcctggccctattaggatatggactgtgtggctcatgagagccgtgtgctcctgtttgataccaccttgctaatgtagtgaaaagctggaaccaacttataatggtttgtccctctagtcgtatcactcctaggttaaccattttacacaaagcaaggatgaaagtatatgtgtgctatgtgtaagtgggcccacccataggatggactaggttgcgcggttccaaagggcgtgttgttacatgcttaatttttttccattttggttcgcgttaccataacatatcccattctctaattttatttattcttcaggagaatccaatgatgtgtggttttactttatggatcaacaccgtcagcccgacgtatgatggcagaagagtaactaaagctgaatgcaaacaaagtacaagagaatgaaggagcacaaagttgcagtacgtgctaaacgacgtagaagggggtagtagagaagcttaggcccgattcgttttcggccatttcttttgttatgttggtgtatgtgtcacgaatgtgttatgtttatctgtgtgttagctaatggttaactctctttttcatcgattaagttgatttgtgctaccgctgcaatatctttattctccttctattctttatccaccttctattctttttcatcgattaagttgatttgtgctacggcgacgtgaatatgtgattgtcttacgagggtaaataaattgcgacaaagctatgaaaccaaaaaagccaatgaaagtaataaaaaatatgtaaataaataatacctcattagtccaattattttaataaacaaataaatactagaactacaaaataataatgtattttccacctgagaaaaacataacatatattaaaaaattgctaacgaaattaaccaaacaaacatgtattaaaaaaataatttcggctgtacaaaggtaaagagaggacactcagattgtattgaaagcccgacagacaaaccatatatagtttgattgggattctatttttacaggatgaagaagtacacattacacaaagagcaattttacggtacatgtagagactcctagcagacataggtcgcgactacaaaagaaagtaaactaacgacagaaaacatctgtttttgtgcaacatttctaaacatatccaaggcagctatcagacatccaaacacaatcagacacatcatcatcttgctgcccatagagaattgcttcgtactgccgcgcatgtccaccttatacatggctgggccacttctctccatatttctgcatggcatcacattgccgcaactctttagtagactagtagccatcttatttgaggacattgcacttttctccatatttactgttccattttcacagttcatttgcccatcctccctgcaagtgacagcattattggaatatgatagagggcattgctcccgcgcaactctgctacctggacattatcgaattttcagcggttagattctgccgcgagagttgatcagttctttccatgcttcatcgatttacatatatggtgctacatggtgctagacaatctgcagtttttatcatgttggtttaagacaggtgctaccgcttgaatttttttccctataatatgtatagagagttgatcattgcattagtattaatatgtatagagagttgatcattgcattaagtataatatgtgcaagattaattaagtattaacttaaaaaacttgaaaataaattaatatgatttttatagctactttcatatagatttttttaaaaaaacaacacttaacagttcgtgaagagtaagctagggagtcgaagatgggaagaggtagattcaaactcaaccttaagcgtactgcccatacagttattgatttattagctaaacaacatcaatcaattcttttcatagttcatttcaaatttaagggtgtacagaaaaaaaaacaatcgaccatatgtctaggagtgaggaaagagcctgagtgagattaattattgatgtcgactgaactgaagcttgcatgcctgcag

SEQ ID NO: 31082 - DNA, 338 bp, Oryza sativa
catccacaaatttacatcccaaaatcattcacataaacatctaaaaatcatccccaattttatgacacaaaattcacaaaatcattcacaggacccaccgccgcctagccgccgtccttcgcgacggccgcgccccgccgcccgtagcctcagccatgaccggcgccaccgcctaccgccactctccactatggccgctacatcccgcgacccgctacccacctcattctgccgcataccagattccgccgcccgccggccgcagccgacaaaaaggggaggggaggagaggggagggcctatgggaggaagaggataagaggataagatgataatga

SEQ ID NO: 31083 - DNA, 1869 bp, Oryza sativa
cgccggcggaggaagaaaaaggaaaaggaaggaagaaagggggcttgccccttcccactttcggaaaaggagaaggggatgggggcgacgcgacagaggggggaggagctctgcctccgtcccttggaggctagcgcgcggatgtgacgggggccggatctatgttgacgtcgatgacggcggggccggtttggagcggagcaacaacacggtcggcaggcgcggcaggcgctgacggcggcggcgactggccggtcggccaccacggcgcgcgcgcccgggtggcgcggcgatttgggcggcatcggcgggaacggcagcgagagcggagagggaggagggcttggcgcggctcacgggcagagcggggagagagagagagagatggggagggagggagagatgggccgagaggaattcggcccatcgaacccgagggaggcaaagtagacttttgcggagggatttgatttgggaaggatttggattcgggattgaacttgacgatagatcggggattcgagatctgagatggcacggacactagacaacaagcaaagaaacagatttcgcaattaggatttttaagagatagttttcccgctaggcgccacgacagaacgggcgctacattaggctagagttcaatgcacgtggttggtgaatattccataaggcatacgatggacttattgtgtgcgtatgggatgcggagtcgaatttggaaggagtccaaatttggtatgattggagtttgtaaagtttgtttcttgtacgagaaggtttcctaggtggattaggacttctagtaggagttttgttcgtgcctttaggctgcctacctcatgtataaatagagagggagcgtgaggcttcccggtatcggttttgagagcattgagttgagagttgagttagtgtttcaagtttagtcgagattttcgtgaggggtgctgttgttgcaacttgtaaacacagagagaaacaataaagttgttatctactttaagagttcttcgatttgtgttttctcgggttcagcggtctaaccggcgagacaccagcggtcagaccggcggaatcgcggcggtcatactggggggtcagcggctgtcagaccggcggcaacttcaggcgcggcaggtgatctcggcggtccgaccagagttccaatcttggttagaccgacagcttccaggcggccagaccgacgcaactacttcggtcagaccgcgatccgtcgaatttgagggtaacttttaattccgcataaagtttgggtttttgggtatgccaaccattcaaacccccccctccttcggttggcttagttcttgcgtttcaatcctacgtttatatcataatctagaaaagaaaaaggactaaacagactcatctcgttggtcagacacatgttaactgatttgaaagtagttcaaacaaaatttatacaaatttgaagaattcaagtagacgtgaaatttttagcttgtgcagaagatctcgagagtacctgagatagacagatttcgctgagaaactgatccatcgtactacctaaacaatcttggaagtctatactatagagccatagagggctaataataaagaaggaaaaacgattcagtaagccatccatttcttgaattacagtttatgctccttctagtaaattttaaaatgtatttatctacaacctaaatatacagtttaagttcataaaaccctaatattcaagccattcataagcactactaaaaaaggatttttcctgtacgaggagctatttagattgtagacggactgtttttgcgttcgcacggataaattggcgtcccattttcgcatgtggacccttaagaggcccgc

SEQ ID NO: 31084 - DNA, 655 bp, Oryza sativa
tgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacacatgcatctaccaattttgagatatattatcgattttgtgcaacattcagagcaaagatatgttagattgataagttcatcccaataaaagaagagacatgcggacattgttgttgatttcaacttggatattagaatttagaagtgctccctgtccgctgacctgaaatttgtgcttttttcaggtttcagaagaagtagagaaagcaattttcagacaagtcagcacaccagcgcctccaaggtgaggcttgagacatatactagctttcatttattatgattactaaatttcacatgtaataaaaaaaatttgatgtttagtttc

SEQ ID NO: 31085 - DNA, 11174 bp, Oryza sativa
gatccccctcttgttgttatctagctggtagtgaaagagttgataagtctgaggttgtaggagacaggctgaaggaagcacagtacataaacaagtcactttcagcattaggagatgtgattgcatctcttgcacagaaaaattcgcatgtcccttaccgaaacagcaagcttacccagcttttgcaagattctctaggtactatctgaagttaatatgctaacttttcactcaattactacatatattcatagggtaactattttattccaatgtcaggaggacaagcaaaaacgctgatgtttgttcacgtaagcccggaactagatgctgtcggtgagacaataagcacattgaaatttgctgaaagggttgcttcagttgagcttggtgcagcaaaagcaaacaaagaaggcagtgaggttagagagctcaaagaacaggtgttcacttaactcctgattgctcatttatataaactatctagatgtggtacttctgtttagatttatataatcatcgtttttctctgctcttgtttcagattgctaccctcaaggcggcattggctaaaaaggaaggagaaccagaaaacattcaaagcacacagtcaagccctgacatgtatagaattaaaagaggcaatgcaatacctgccttccctaaaaatagacagccaatggaagaagttggaaacttagaggtattaactgctctttcacacaagatcaactctttttcttggaaatcacaaaaatatttccttttcacattgaagtttttttgtgagtgctagttatgattccaatcaatgtcaaataggaaaataacctaccaaacattctaaatggagatgggctatttatgcatttgtacataagtttagagtcattttgtcaataatctgaacaactctaaaactgaccaaagggtagttcatggtcttattgagagtacttatgtttaccttcagtagatttatgcatttgtacatcaagttcagaatcattttgtgaatgatctggacaacactaaaactgacgaaagcgtagttcatggtcttgttgagagtacttatgttaccttcagtagattattattccttttaatcttttcacaagaaaggtaatgatgttcatttaatgaatattatatttctttatgtaaaaggtccggaacaatgccactccaatgcaaaagaaggccagctttcaattttctggtgtcctcagtgagaacaactcatccgacttggctgaaaattgcaatggcattcagaagaccgatagaatggctgtcggtaataatcaatttgagaatggaaattccattctagagctggagcctggcgcaactcagcttccaacatttttctaccaaagatatgatcccgacaagcaaaggcgtagggctgaaccagtagaaactgatgactcagatagctttgatgctgctactagctcgccttccgaccaagaaatgttgttgtccaccagtggcctcaaagctgatggtattgccagcagaggtgcctttattataaagaaacctcaaacaaagaatacgaaaattacagcaacgaagtaagtccaatttaaatcctgtattttccatgaaaattgtgtgcattggattgctttaacctgttgtgctgctttgaatttactcaggattccaaatcttgcaatgaagtcgccaatgtcagagaaaaggctgcaaaccccaatcaggaacagcaagcagctacctttcagcactacgggtggaagaagaactcgaaatggcaaaattaacactccaaaataatcgactagtgcgaaggtggatcccactatgccaaggtgagatcaataggaaactgaaagaaggatgtttctaaaaccctgtataaggatcagtggattgttcagtctgatggaaaaatggttttgagacatcaaagatagagataaacagataagacctccaacaggacagagaaattgtaaacccagaaggaatttttcaaatttgagatcagtacatagctcacacgcagaagttacggttgtattgtatgtacattagcctggaatagatgcccgccatgtgccattacaacaaagagaagttcaatgacaagtttgtacgcttcatcatgttaattgtcaaatttaggccaattacaatttttttaccattgcatcatagatgtgaactttcttaaaaggaaatttctctcaaggatcattaggtgcaaaaaaggaatacattacatggtctttttgtttacatggttctaaattcagagataacaaagaggtcagaatcctctgctgggaaatactaacactaaatgaagtacaagcaggctctactatgtacagattacatacacctaactttttgacaaaatcattagtttcagttgaccagatgtctctagaacttctgcatcaacaccaagatcgatctttaatctaaattttttacaacctgttttcaccaggctcatactattgggacaagccttggccttgctggggggcgatgcgaagcctttctcgaggctctggagagcctacccacagatgccagcttcagcgctgccctgatcttgacccacttgcgtggggacaatggcaccgcaactctttcgttgctagaaaactgagaaatgaaattctgtatgagctgatcacatgagctggagtcaaagctgtttgttcttgatggctggaatggagcggcaatttgctgtgaggtttggtcattgcttgataggttgagcaggttactgaaattctcgcctgcagatgccatccttagtaattagcatcaagatgaatgaatcagatgtagccaaaaaaaaatcagcatagagtaattactgttgcttggaggcactaagtgaggttgcatcaaagccacaacttcatctgtatggaggaaattatctggagaaaagcgctgtcaacacaaatacagaatggattagttctgttgaatgaagagcacaagtaatgtcaaatttttactcttcgatttctatctagacaaaatacatagatttttacataaaaaaaggttcttaccttgtatgattcttcaggtgaatgagatcgctcattatgtgcatactggccaattcgtgtggcagcatgatcagcctggatgctgctatgagcgtttggattaaaatatgttttttcggtattaggtatacacagaggagtgattcttggtctgggtatgaatgttccttgatttgaatgatgtgggataaaattgcccatgcccaactgttggctaaactgcacgttggaggtttgaccctgcacaaatcttgacatatccactgaagcctgctagaaaattgatgaaactatcttagactaacatgcatatgtattttattatgtactgtattttgtatatttcaaaatatcttccttacattagaggcttcttggaatgaagaaaagttctccgttgattcaaatggttgaccagccagggctgaattgtattgacctgtaaacaattggaatagatgaccaaaaatccccaaaaaagtaattatcgctagtgattgaaattctcagaacaagatattaccacaagttgggatctgctgtttaggaataaagtcagtcaacatagaagttcccccacaatggaacctatgaagcggtacaggatagttgttgaccatcttatggtcatactgaataccacttatattcgcataagccaattgcttcattgtttcaactgcactctgtgaacaaaaaacaccaaattattaggaaaatagtgagaaaatctcctgttgaaggaagtgaggaaacagtacctgctctatttcgtcgagctcatttatgggcttgtaagaatcaccaaacttcaccccaacaagctgatatattgcatcgaagaaaagtcccacgttgttgcccttcacttcatacaagcaaagatcgtcaccgacttcacatgtcatggcatggcttatgatggttttccaagctgcctgtgacatcttgctaaaagtctatagacaaatatcaaagatcttctgtcagtcactttttttagggaattcggtgagtctatttttttctcttttgaaaccaacggctcatctatattatcaggtccttgtgttatggaaacatcatctgaaatttaatatttaaggaaattcatagaacctctacctgaaaaagcttcttttcgtccgtaaaatatgattgtaagaacttctgtacagtatcaactccactgtttgtcaaggcctggtggtgagctccattgcggccgatcttttccaaacgccaaacttcgtcatccaacattggcgggtagtgcttttcaaatcctgcaaaaatagtaagttgcatattattagtctcagctataaggtccaaaagacatttctgaagaaacaaacaatctgaatcttagggacaatggcataccctccaccctacgctcctttacacgaaaaggttcagtgattccttcaagaaccctatcttcagaattgttggctagcctcaaacccagcctgaacttcttagtgctagtgaagctagagttatcagtgaaggttgcattctcaagtaatgcttcccctccattgagcttcagtgtcagatttccggtgagaagttgtgcgcttttctctcgcccgcatactatctgcttgctgaagtcttcaggggtccattgttcctcatttttagcattaaagttgccgtggaggactacaacttcaaccttagcagaagcaagatgaccgaacctgacgatgcgcatctgattgttttcgagtctttcgactatagccaccttaagacccggtccatccttggcttctaatttcatcagtgtgtaaacaggctttagttcattcaggaacacgagttgataccttggacgctgctgattcaatcctgctagcagtctgcagatgaaagaaccaaattaagtatgttagagcagaaagaaactaaacatcaaattttttttattacatgtgaaatttagtaatcataataaatgaaagctagtatatgtctcaagcctcaccttggaggcgctggtgtgctgacttgtctgaaaattgctttctctacttcttctgaaacctgaaaaaagcacaaatttcaggtcagcggacagggagcacttctaaattctaatatccaagttgaaatcaacaacaatgtccgcatgtctcttcttttattgggatgaacttatcaatctaacatatctttgctctgaatgttgcacaaaatcgataatatatctcaaaattggtagatgcatgtgtaaattgcaccaatttggggtaaaaaaaaacttgcaaaagaaggaaagggaaaagggtttttaaaattggggctatttgtgttattcttgaagccgctaagccttttagagcccgtccccccccagggcgaactttgggcaacaaggggggctaaaaataaagggacgggactttttttaaagaaatttaagaaaaattgaggggtttaaagtagagtatggaatgagaaatccattgaccactattactgaagccatgcttggccaaagataggggaaggaaacatggcccatgaactcctcccccatcatctccctgaacccgaacaccccctccatgctcctcttcctcctcaccccgagccccctgcaaccaaccaaagaacaaaaaaaacacaaattcatgagcaaccaaaccatctctgaacccaaccaagaacgcagggttgactcggccgttgactcacaggacaagcgcccgccaccgcctgcgagggcgggacagctcgccgccggcgccggcgccgtcgtcgtcgtcggaggaggaccaggagaggagactcgtggaaggagccatcggtggaggaaacaatggaggagaggcatggttgcggggtgatatagaggagaagagaatgggagggaaagctcctggaacgagctgggaatgttcgcttgagctcacattttgttactgtgttcgcgagcgagtgcacaagtggagtgtttttgagtaatccatgacgtgttttgagtaatctatgactctgttggctcgtaattgtcgattggttttgggtttgatcccttcttttgtggcaatgggtttttgcacttttttttctttttcagtttgagatgttaaaagtacactttagatagcataaacttttattttgcatatttgtgctcatttaaaagaagacagttgtggtggactccgcctactcttattacagtaagtttttacaaattaccccttgaactccttaatattaaaaggatccaatctaaatggatagccacataaaattagattaagatgaatatttcgtttagaaaaagatgggtaacacattaatacattttctttaatccatagcaaagcaccgtcatttagctagtatatatatatacacgcacagatactcattcactacgataggttagatactcattcactacgataggttgtttatgaatgttactctatccgtttttaaatatatatggtgttgacttttattgtggtagcatttgattattcacaatgtgaaaacatttagtgcatgataaaagtcgtattcaaagtacatttaacaataataaaatataagtgacaataaaatgaagaaattatacttttatgtttctcttaataaaacaaatggtcaaagccatatctaaaagcaaacggcatcatatatttaaaaacataagcaatatatatatatcatttttaagaataaaaactttatattattggcgtctaacagaccatatatcgctagtagaaatgcttctcgaaatctttagctcactaaataaaccagtgttgatgtctataatttctccctctataaaaaaaatgaaattctaagaacgaatctggataaacacatttgtacattcgtttttataagttgaatttttttcttttacggagggtgtactctttataataccaccacttaccagcaactacttcgcttaaaagcttgaggtgttttgcagaagaatggttcgaatttcaaaacttttgctcttgtccgttctattgatgcatgtccacttcatctaggctgcagtctacaaaaaaggaagaagaggcgaagctgcagcctgcagaaaatggagagaacgatttacgtcgactgacgactacgacagcggtgatgatctggccggccttgtgattgactttggattttggattactgtatgtgtcgtctcgtgggcttgatttgttcctcgtttagtcccctaatttgaagttgaagttgacaaatcgcgttcacagcgctcaaaccaaccatgcacgtacgcaagcaagtgttcatatgcaactgcacttatgtcgtcaaacttttagattatattgcacttttagattaactgcactgtgctatatggttttcttttttttagattatcttgtaattcctccgtttcacaatgtaagactttctagcattatccacatttatatagatgttaatgaatctatatatataataatgtctagattcattagcatctatatgaatgtaggcaatgttagaaagtcttacattatgaaacggagagagtagttgtatgagagacatgatgtatgttttggcgaaattttgataaatgttatccttttagaaaatttatttgaagggtaaaccgtgccagaaattattttaaaaataaaccatacctcagcaccatcgggattagcgatgaggtccaacggcatagtgctaacgatcatggcgctaagcgctgccaccttggcagggccgtatgcaaggttggataggatcatttcatattatgaaaagatatagcgcaagatataaatcacatttaaagtacctttaacaattattaaaaattcaagtaacaataaaataaataagtgatagttatattttttaatatggcaaagggtcaaagtcatatctgaaaattaataatatcgtatatttaaaagcagaagtagtgtatatctatcttaaaaaaaacttgatgctaatggtgcctcagaaagcacataaatatccgtcgtagaaatgcttctcaaaatctgtagcttctcaaataaaaccaatattgatgtccaaaactgcattttataataatctctacatgccaaccaaataattcacttaaaaaggttgagatgttttactctagactagttagaatttcgaaagttctgcacttgtccgttctattgatgcatatccacttcaccttaggatgcagagcataggaagaagaggcgaagctgcagcctgcagaaagtgcagagaacgatttatacgtcgactaccgacgacgacgacggtgactacgtccttgccggcttatgatttgactttggattttggattagtgtcttgtcgtcggcttgatttgttcctcgttttaattagtcccttaatttgaagttgaagttgataaaatcgaattcacagcgcgcatagcaataaccacgtttatactgaagaaagtgttcatatgtatgtgcaattctgtcgtcaaacttttaatcttttagatcatcttgtacttgtcttgaatagttagttgtatgagagaattgggagagatgatgtgttttggtgcgctctcgtactagcattttgatagtggtagaaacaattaattccatttttaggcctttttccaaattaagactttatatagcttcggatttgtctcctctcatgatccggacagtttcctatgagcaagttaggcttggattatcgtaatttcaagttctcaagtaccctaaatgagtgttccaatattagtgcaacactagttgaagtgtcacttcttcattttatagagcattttcatctcttttcttttcttttctttttatttcttttttttttttggaaaagctcttagctctgagatcaattactcatcatatgtaatatactcatggtgggaattttcccggaagaatctaagtgtaagtattattttatcggtgaagggggatccatcttattatatatctattcggagttttcatggaagattctgttaactgtaaactgtcatggaggtgagcagggcagttgatgagatctctgtcgcctgctgattggctgtgtttagatccaaagtttggatgcaaacttcagtacttttccatcacatcaacctgtcatacacacacaacttttcagtcacatcatctccaattccaaccaaaatctaaactttggatccaactaaacacagcctgagtgaggccagttgttcggcagaaacctctgaactttcctgaatggttcttcacttcacaagcatactagttgtagttcttataacagcttaaaagtcaacgtcatgtattctatgcctttgttggaaaaaaagttaattattagcgtatgattaagaaaattagtcattcaccaatgattaattaattattaattatttaaaattaaaaaataaattaatatagttttctaaaggaacttctctaaagaaaattttttttaaaagaaacatatcgtttagcagttcgagaaacatgtgcgcggaaaacaaggaagttttcttccctttctcggaacgaacacagtctgtgttcggcataagctggtcgagaggaaaggtaccccagtttttgcatacttcccgaatggtttaattgtgtgtttttaaaaaaaattatatatgaaagtttctttaaaaatcatattactctattttttaaatttaaaataattaatactcaattaatcgtatgctaatggttcaccttattttgtgtatcttctcaatcagcttctctcaaacatttgcttaagaaagtggggaatgacaactcgcagttgcctcaaatatgacaccgctctagtacatcaatgaactctcgaagttatatataaataacattttcaatatacgatgagttgtatgtgaatggattagaaaactggggtggttcaaagtgacacaaaagataaaagatatgtttacctagtccaaagtgaaaaatgttaggtaaaggatggttcaaacggaaaaattttctgtttataaatataaatgtgtgtgtttttatttggtgcagagtctaaaacgttgtacttcaatcgttaaaataaaagataaatgagtcgtaccgtgaagccattagctgtaaccctacgccaactagtcaaccctagtggtctttagggggaaaaaaaatcgaagatccataaaaaagttggatcttggcattttgcttcgtactcctactactgttgtttcaccgtgaagtatagttggccataacgcccgaggcccaacggcccggcccaaggcaggggattttggcctggcccaggcacggcacggcctgatcgttgtcgggcccatgccggcacggttcgggtgttgggctgtgcctggacctatgcctcggcacggtgggccggcccggcacggcacgaactttagcgaggtgaaatagacttattttcaaccatatagacgtatagacgtattatatggcacgactagagagtagggacgtaaaatagacttatttagttttttatatgtcacaacccaaagagtatggaggggaaatagacttatttcaaagaaaacatgatgggctgcatgtgccttcgggccggcccagcatggcccgacccttattgggccatgcctgggccacagtggagcacgtgggccgacgtggcatggcccggcgtattggtcgggttgtgccggcccaacaaatcttggcccgagcatgatcgggcctggaccatgccatgccgggcagcccatatggccaactataccgtgaagcatatgaggagagaaaaagtcatgtatataccggagtagtttggaaagtagagtgcaaacacttctccactattataaaaattgaagatgtttttgccaggaccttggtaagtcgtccgaatccgtatgtgcttccttgcatatatctctctatctcttcccaatagctttgtctgtcgcccggtatctgacctgtaggatgtatttagttcatgctaaaattgaaagttcggttgaaattggaacgatgtgacggaaaagttggaagtttgtgtgtgtaggaaagttttgatgtgattagaaaa

SEQ ID NO: 31086 - DNA, 19497 bp, Oryza sativa
agttggaagtaaactcggccgtccatctccgatctataatactccttccgtccctaaatatttaacgtcgttgacttttttaaacatatttgaccgttcgtcttattaaaaacttttgtaaaatatgtaaaactttatatatacataaaagtatatttaacaatgaatcaaatgataggaaaaaaattaataattacttaatttttttgaataaaatgaatagtcaaatatgtttaaaaatatgtttaaaaagataaacggcgtaggtacggagggagtgccttcctttccaaggagccgaagccgacatcccgcctgccgccagtggctgcccgcttacacgtacgtttgtaggtgccctgtataggctgcaacctgcaatactgttaatggctttggatcacgttaatttagattgccagcagcccatggagtgatttggactgtacatgtatgaagttggttcagatgctgacgaacaagtaataatcacactttttctttgacgacctatgtcgacgggtgatacccgtagaccggatatagagggtattagggtacgttggtacaagcatctacgtagtacgacatcaagcaaacaaaaaataagaattatactggttcagaccccttgataggtaataaccctaatccagttgatgtgggattatatggtagaaaatacaggttacaaagggaacaagggaacttgtcggatccggcgagattatagtcgagttgtttcgactagctctcgatgacttggctcctcgtaggctctggcttcgtaggctgtataggttgtgttggctctgagatttgatcccttaaaccctccccggggggtcccttttatatcgcagatctggaggtctccacgtagaactcggagatatcagaccctatacgatacgtcaacgacccaattctgcccgagtaggattcttctcgtctgtagatttcatgaaaggttttcttagaatatacaggaaatatccgcatgcgcgtggtatgccatatcgatatgtaacgtatatcgaagggtaaagggtatgcctaacccgtaaccctgacagtagccccccgacttctgcttaaaatgaactcgtgcaaccatttacgacttcgggtgtcgagactgttgtcattcccggtgtgaggaccgcggagatagaccatagtcgagcacgccatttgaagcccaacggtcacgagcgaattttatactgaagtccagaaaaccgccgcgcgtaacggacccagaaatttctggcgggcatctctctctattccctggaatttgcaccgtcggtagtgcgcctatttaaaggaattttgagagtccattttgaagtccaccaaacctgttaaacacacaccacctgcaagcactatttgccttctccgccaccacaagaaaccctagttcaacaacctaggctcgttttccggcgaccttcgatcagcaatggacctcggcaaatcggcttccaccagtgcaacgttgaagaaactccaggaggatggcgctcttcctggccgtggaaccatggagagggaagcaggaggtactaatcctcagctcatcttgggtcgcatggttgcgatcgaagattgtgttctctgcggttttctccctccatcttccgaatttcttctcctggttttgaatttctatggtctttctcttctccatttgaaccccaattccatcgccttctttagcatctttgtgcatctttgtgaggcctacatcggggtagagccttttcttgatctttttcgcttttactacgaactgcgttggatggaatccaacagggtatctggttgcgtcgggttccgacttcgggatggcctgaagtcgcgttacattcccttccagtgcccttcttctcgcagcaagtggcggaataggtggttttatcttgagatcaagaactcgaaccctgtcttcgtggttcctgaagatcaaccggacaagattccgtcttggaccgcaaagccccccttgaccccctctcttcagtcgtttatcgacatcatcgacgatctccgagcacagggtttgtcgggatatgaagttgttgcagacttcgttggtaggcggatccagccgcttcaggctcgggcccatccagcttatgactattccgggccagaggacgcgacccgggtttctcctcggggtatctttctcgcatttatcttgacatgcttgtgttcgcgttcctcttgatttatcgaaggttggttctcgattaacaggtctgagcagcgaaatcgtggagcgccgcgtcggccaggtgatgatcagtggcccgaccacggcgagtgacatccctgtgcccctttatgaaaagggggcggcggaacgtgatgaagccatcaacgtaagtatattcgataagcatcccgcattctcctttcgaaatcactttatgacttgattaagcgtaggcccttcctttgactgacatcattggaccgctcgcggaccatcaggtggcgacatctctgaaagtgaaggtcgtcaaggaggcatctgatgctgccaccactagcggtggcaatgttccgacaaagccgaggaaattctcgtctgtaagcggacatcgtcgcaaggcgtcgaccccctcggtaatttattttgtcgttaaatcatgcagcaagaaggatttttccttactttgcgttgattgtctttcaagcctcggacgcgtctcccccacctccacgacgacaacgcattgtgacgattagcgagaagtaagtagatgaattcttgaatccccgcgcttcttattcgattgttgtctgactcgtggtcgtcctgtagggaggcgcgggcaaaggctgcgcgagccaagtccggatgagcttccagtgtgtcgcccgtcgtggcctcgacggatgtcgtgcccgcagccgggagccgggaggcgacgcctagtggcccagtcagcgaccccgcggcaggtcgtgatctgccagttgcagtcctcacctgggaggagctccaagtcgagatggggcgcctccttgaagctggtgctcgcggcatcggccgcgagattgcggaggcgaggtcggaagcggcgacggcgaacgcgcgtgctgacagactagtacgcgagttggtggccgacaacgagtgacaacggaaggggctcgaggaccgaatgtcggaactcgggaacaacctatccgagatccggggctcattgagggtcacctacactggccttcaccagctcgccggggagtgcggcgtcaagtccacgatcccggtgaatcccgatgagttttcgctgacctcctctctcgcggaactggtgacggcgatgggggaaatcccctccaagcatgcggccaggattgcggaggagacgtcgaacaggatctacaccggggcgtgtcatgtcctcgcgtgtgtaaggctgtcgcgtcctgaactcgatctgcgcgagatcttggaccagagggcggccagcgacacgcgtaaggaggtgatggaagaagtcggtgatctaggggagtctgttctccccctttttgaagagtaggacttcttgtatttcctagataatgtgtaaaacttgaactctgaccgccttcgtgcgtgcgattactatcccagcttactttggtatgctgacctcgggaacttttgtcctttctagagatgctgatgacgaggatgtccagcagcgcgggcagcctgagtcactggcaataattccggtactcgagtttgaaccacacgtctcgcctgaccatgtggatcaaccccttgatatagaggggatggcgacgacttcctcaggttagtagtcccttcaccccttaatgccctcctgactaggttagccatgttcccgaaagagatgtatagcttgacttagtggttattacgtttagtagatctcgagggtgcccttgctagccaagatcgtcatatccaatactggaagacgaagtttgaagtggcggagctcgagagaaccatgctggccgtgaagaaagagcaggctgtggaaacgctccgaggtcgtgaggtgtggtttaactcgtacttgaagagttgctgcacatccatggccagagtatgcaaggagcttcgagtagtccgcggagatcccgaggagtcggcggccgggtacatctcgtggcttaatggggcctgtgcccaactcgatggaatcggcaagcgtatcgacgaggccttgaagcaggagtgtcgtcgatcgagccgatacgccggagggcacgtgttggcttgcctacgaaatcatcgcccgcgcctggacctcgaatatctccgtgagggttttgctcgttctcggaggactccggcggagatagaccatctggcaaggtcaatgtcgccgttggccgatgtggacccccgtttttataacaggaatcaatcgtgtaaacagtaccatttccctggatcaagtagtttggtacacacgaattcatagctggaatatcaagtgcacatacacgagtatctaatacgaattattacatcataggcccgcaggcatagtcttaaatcatcggaccgagaggtccggaatacatccaaaagcagaaatagataaggcagcagaattcaggcagcggcatgccattgccacaggcaacgaccatactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccatcccacacaagttaagaatttagagtctagccaagtgtaatacatgtcccggggctcaataaccgtgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaggccctcatgcactctaggcgtacacggtttctagcagtgagaggagttctggcgctcccgagggggaaaactcacgcaagcctaacatcgcattctgtagttgaacccaatccacgctgtccccttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggtcgtttcatgtttaacttcatggctcagtccttaactgaccagggacggcactagcctttaccggacaccacccaagtcctccagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattgggatcaacatgttcaaggaatagtgatgacttgccttgctcgaggtcttgcgggtcttggccttcacctggatccgcggctccctcggtctctatagttacgtgcgaaaattgatttgaattcggttagaattcaaataaaaatccaagtaaatccaaatggaagtcaaatgcgaaagtcaattcctttttattaattttactatccgcgaactatggcaaaccccaattttggtttaaattattttgcggttacaatattttgttgtcgtatgtttttaatttaatctaccctagcattatatccatatattaggttagaaatttcttatcgcgagctaaatgtcggacggaatcctaaaattatcttataatattatacgactcaatttagtctatgattaaatataatacacggctaacaccctagtaattaaatccgaatcgctaccgttgatcgattatttatagagatttcccagaaataatccacaataatttacgagaattcatacatttgtttaattattaattacatctaaattaataccgcgaattgatttcttatggagagtactaaaagttatctataatctataggaatttatccaattatattttcattaatcctatatttaaatgctagtattttaggtatttaattagtaagagtttatctaactatattttcattaatcctacaattaaattctaatatttgtaaatattttaaatttccctcttaatttttttttctttctctttttctttccctttttcctctcctctcttttcttttctttttctttctctccctttcttttcttttctctcctggcttcctcctcccttcctctccttctctttctcggctctccctctctttctctcggctctctctctttcccacccgagcggtggcgacggcggactcgagggaaacggagggcgactcaccggcggcggcagcggcgatgacggcggcagcgacggcggctcacggtggcgcgagaacagcggtgcgggcacggaaacggtcggcgcggcagcacgacggcggcggtgcggcggcactacgatggcggcgcggcggcactacgatggcggcgcgacggcgtggaggagtgggtggtggagacggggagaagggggggaatagtgaggcttttataggggaagggagagagataagggggaaggaggaggagggaagagggaagaggggaagaggggaagaagaagaggggaaagagaggagggggaggggcggcgacgcggctgtggtgacgggatggcggcgctgggctcggggcggcgcgcggggctcggggcggcgcggggctcggcgcgcggcgggacgcgagacgcgacggcgacggacgagcggcgacgggacggcgacgcgacgggcgacggcgctcggcgatggcgacgagcgggcggcgcggcgcggggctccggagcggctcggcgcgggaggggactgcgacgcgacgggcgggacggggtgcgtgggcgcgcggggcgaggtggcaggcggcgatgggacggcgacgcgacgcgggacggcgacgcgacggggagcggcgcggcagcgggacgggcgcggctcggcacggggctcgacgcgacgacgacggtgatgcgacggcgagcgacgcggcagaggggaggcggagcggcgcgcgtggcaggggaggggaaaggttggggaccaggtcgaacacgtggcgggcaatgaacaatgcacttttccaataaaccgattttagagtgtttctcatatgaatttcattccgaaattcttaattttttgtataaatgaagttttaccccatatttatattattctaattgaagattcacctaatttaatatcactcatattttgtttatataattcatttgaatttttaattaaagttaattctcattccatcgtattaaaatttaattattgttaatatggttgcgataacattttatttatttccaaacccaccgaatctttattttaatttatattttaattatttatttagcccacttgatttttagggtttattcctagttaatttcctcccatttgtgatcgatgaaatccgaaatcaaaatccaataaaatcttcgaataaaattggcatgatgcaatttatttaaaaagtttttttttttgaagatctgaatttttggagtctttgattttgttggtcgaattttcagaatgttacagccgagaagatcttccagtctatggactggcgttggccttcttggtagtactcgtaccctgtgacaaatatcttaggaaaagatgtaatgtagcgaaagatttttgaaaaaattgtaagaagtattttgtgaataaagaaatctatctttgacaaatgtctcttactctagatgtcatgtgtaagagtgcgttctcagttaacgactttagtcagccgtttgagtcgtacactctccctagcccccagccttgtcgtcggaggaattttctcggaggataaggctcttggacctttgaactgccttggttgaataagctctgatcctagcccccagccatgaagttggaaagttgatttccgatttcacggcttggttaatacgcacggcgagaactcttacacgaccagatcttacatggtctttcgtctctacaggatctgacaaggccttatcggctctgggtgtccccagccgaagatcccttaggttcctcggaggccttgtcgagacggcgtaaagggacataaggacaggtttcaacgctaggtgtcatcagagtgagggatcatcgggcgaaacactttaattgtgatatgggcctagaaataggctttattgatactgtaagggtgcttacaggtatggatggtattgactcatacatagaatttacgtagttggtcaatgttccaagaatttgctaattcgcgaccgtcgccgtctgcgattttgaatgcgcctggccgcaagacttgtgtgatcgtgtaaggtccttcccatttaggtgagagtttgtttcgccctgcttggctttgaactcgtcggaggacatagtcgccgatcgaaagtatgcgtgcacggatgcgcttctcgtgataacggcggaggatctgttgatagctggctgctcggacggcaactcgttcacgatgctcctcgagaagatttacatcgatatctcgctgctcctcctggttctcgtcggagtacttctgtactcgtgtactctgatgttgtagctcgcctgggagcatggcctcagagccgtacacgaggaagaagggtgtttccttattagacgttgtcggtgtggtgcgtacggctcacagtactgatgggagttcttcaacccactttttgtcgtgtgacatgagcctgttgtagacgcgggttttcatcccttgtagtactatgtcgtttcccctctcgacttgtccgttgctttgagggtgagagaccgaggcgaagcatattttgacccccagcccgatgcagtagtcctggaaatcggcgctgatgaactgggagccgttatcagttatgatgtggtgtggtagtccgtatctgcaaaatatccctttgatgaatttgattgcgttgtcggccttgatttcccccgtgggtattgcttcgatccatttggtgaatttgtcgatcgccacgaataggaatctgtagccgccctgtcctcgtgggaatggcccaagtatatctagcccccagcacgagaatggccaagtcagaggaatagtctggagcgcttgcgcgggtagctttgtgtgtttactgtggaattgacaggcttcacatcgctggaccatgtcgcatgaatctttaagggcggttggccagaaaaagccttgtcgaaaagctttgccgaccaatgtccgaccggcggcgtgtgacccacatatgccttcatgtatgtcgaggaggaggtgtctgccgtcgtcggtcgagacgcatttgagaagtaccccgtttggcactttcttatatagatcattgtcgaccatacagtagatctttgctttacgggttattttctcggcctctggatcgtcctcgggcaactcctcactgctgatgaatttgattagtgggatgcgccagtcgtctgtggtttcgatgtcggcaatggcgcgttctgcctcggtgacctccgagctaatgtcgggggtgttcgggctgacttcgccgctaacctctttcaccgatggcttcatcaggatgtcgagaaaagtgccgggctcgagcgattctcgtctggaaacacgtcgtgctaggtcatctggctcgacgttgtccttgcggtagacatgtcggacctcgatcccatcgaaccttttctctagcttcctgacttctgcgagatacttggataactcggagttagagcatttataatctttgtgcacctggttcgtgactagctcggagtcccctttgacgattagtcgcttggcctcaagtgtagctgcagctcgtatcccggcgagtagtccttcgtattctgcagtgttattggtcgccctgaagttgaggtggattgcgtgcttgaattgatctccggagggagacgtcaagataaatcctgcccgtgctccttggctgttgagtgcgccattgaacgccattgtccatgtttcattgtcgccttggttgtctgatttgttatctggcatagtccaatcggcaatgaagtcggcgagtacctgggacttgatggctgttcgtggcacaaagtggacatcaaactggctcagctcgactacccatttcgcaatgcggccgacaacgtctttgtttgtcacaacttcgccaagagggaaagaggagacaactgtgactctgtgggcttgaaagtagtggcgtagcttccttgatgtcatgatgactgcgtaaagcagcttttggatctatgggtatcttgtctttgcgtcgtggagagcttcgctgacgtaataaactggtcgatgtactttctctctctctctcgacaacaatgacagtgctaacggaatatggcgtggcggcaatatagaggaataattcttcattaggttggggagcaacaagtacaggggggtttgataggtagcgcttgagtgcaatgaatgcctcttcggcttcctgtgtccatacaaatttgtcttgtttcttcaacagagcgaagaaaggttgtcctcgttttcccatcctagcaacgaatctgcttagtgttgccatgcatccggttagcttttgtacctccttgagtcttgtaggcgacttcatgttctcgattgccttgatcttctcgaggtctgcttctattcctctgccagagacaaggaatccgagcagcttgcccgacggtactccgaacgtgcacttctcaggattgagcatgaggcgatatcgtcggaggttgtcgaacgtttcccgcagatcgtcaatcaatgagtcgcctgtcttggttttgacaacgatgtcgtcgacgtaagcctcgacattattgccaagctggttgctaagtgcgccttggaccgtgcgctggaaagtattcccagcggttatcagtccgaacggcatcttaacaaagcaaaataccccgaacggcgtgatgaatgctgtcttctcttcgtcctcttttgccatgctgatttggtggtagccagagtaagcgtcgaggaagctcaatagctcgcaaccgactgttgaatccaccagttggtctattcgagggagtggaaagtgatccttggggcacgccttgttgaggtcggtgaagtcaacgcacattctccattttccgttggccttccgcaccatgactggattggctagccactctggatgaagtacttctctgatgaaaccagctttgagaagtttgtcgagctcttctcgtatggcttgttttcggtctggtgcaaatctccgcagtctttgctttactggcttggcatcgggttgcaccatgagtttgtgctcaatcacctccctggggacccccggcatgtcggacggctgccaagcgaacacgtcggcattgtcgcggaggaaggtgatgagcgcgagttcctatttctcgtttagtgtcgccccgatcttgacggtcttgtcggggttggcactggagagtggaacgatcttgatggcgccgtctggtttcggcgtcttgtttgtcttggtcattttcctgggtggctcagtcgtggcgggtgggctaggcgtttgctcgaccatgtcgaggctccgcttgtcgcattgcaccgccagctttgcgttcccctgaatagtgaatgttcccttcggtctcggcatcttaagcacttaatatgcgtagtgagatgcggccatgaacttcgcaagtgcagttctcccgatgatggcgttgtaagctgtatcgaattcagcaacatcaaaggtgatctgttctgttcggaagttgttggcttggccgaaagtcacgggcaacgtaatcttgcccaaaggtctggacgatgattggggagtaattccatggaagggttgatcagttggtgtcaactcgctttgcggaattcccatcgcgtccaaagtgctggcgaaaagaagattgattgagctgccaccgtcaatgagaactcgcgctaccttgatgttccgaatagtgggttcgatcacgatcggatatcgtcctgggataacggcggtcttggggtggtcttcttccgagaactctatcttctgcttagaccacttcatcttgggtgcagccccctgccatgtcgagcagacttcacgttccactttcttgtattctcgcttggaggagtacgttgtggaaccgccgaagatgtgtgagacgtgcaggtcagagtctgaatatgctgaatccgattcgtgaggagccgtctcttcgttcttctcgacaatgcgtactcgcttgcctttttcaaatgccatgtgcttctcgagcgactttttgaaaacaaggcaatcttccagagaatgtttgtccgtcttgtgtatggggcaccatgatttctttgtgtcgctgctttgtgggtctgggcttttgggagggttcgcgtattctgctgcgaggacttccgcttgagctttccttttcccatttttgcgatttttcttcttgcttgactcagatgtgtccgtggctggtttcttctctcccccggtcttcggcttatcgttcttgcgtcttagcgcatcatcagcgtgggcgcatcgctcaatgatctcgaatcatctccgagtggttgtgatgcgtcttatcgccaactcttgggtagtgtagcgatctctgacaccggatttgaaggcgtgaattacagaagcgtcggtgatttcaggaattgtgtttctgcactcgttgaagcgtcgaacatattccctcaatgattcacccgagttctgtgtcaacacgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacgcggttggtaaatagttcgctaacgcgttgtcgtctgctccggcagcatagagtactgtggagtagacttgaaggaactcctctgggtcggtgctcccatcatacttttctattgctccgggtcggaatctctcaggccatcggacatcacgtagggaacgaccgaaagccctacacccagcgttgggggcggtgggttgtcggcggtcgtgtgtccttcgtggatgtctgtctgacgatgaggaggacgcggatgatgacgatgacgatgggtcgcttggttccggcgtacgattacgaggatgacggcctggatctcgggaatcctgtcgtcgtcttccgctgttgtctcggcaccgatctccatcgtcgtcgtcgttacggcggcagccatgaccagtattgtctggcacccatcgttcgcgatcattgtgatcgtggtggttgtcgtggtcccggtcctcgtttgagcggtctcctcgatttccgttatcatggcgctgtgaagagacatgacgccgagagcgattcacgttgtctcgtgtgcgtcgtgcttctcggcggccgttgatttgatctcgaagatcgctagtgccgcgaggtggaggggtagctcgttgaggtgattccctccgttccggatcttcaccattggcatcgccagttggtggctgctccttgtgtgctgcggtagcggcttcttcaaacgtattgctgaggttagtcaccgattcccgtagtcgttctgtccaacgatcgaggtcatcgttcagaacgggatcgtaaggagtttccctcagtatcgcttgaacggccctgatgtgctgggctggagtagtcgattgattccccgcttctgcgttggcgtgcactgacgtgccaacgtcatcgatagccaatacctcccgcggcgcgctcgttgtcgatgacccatagtcctcgaggagatgtaagaccgatggttcgtgaggatcgattaccccaacgaatcgatctgaagttggagtcgctccttgttccttgccgttatccctgatggggacatataacttaggagacggagctttcatggcgccgagaaagactttgcagctcgagaggtcgtgattctttgtcttgtgaataggacaatagacctcccgagttggagaagtacgccgaattccacgttctttgtaggcgcgaatttcagcacggacgttgaggaaaacccagcaatcttgcagagtgtgtttcttggttttgtggataggacaccaagaccttgtggcttcggaagtcatctttgtcggctcatggttcatgtcggaaggacaaggtttggccgtatcaaaatccttcccgagcttggatgtcgtcgatgttccgttctccgtctcaacgggaggatttttcgacatggaatcgccttggtttgtagccactgcgttctcgtctccagtccttggaggaccggttgagatcagcgtcgtggtgtaaaccgggaagacgatttcgccgacttgagtccataccagcattgttgaagcagggagtacttggctgaggctggtgctgacgttgttgtcgacgaagctggatgacgtagtagtagaaccttgagtaccaaggctccctacctggcgcgccactgtcgacgggtgatacccgtagaccggatatagagggtattggagtacgttggtacaaggatctacgtagtacgacatcaagcaaacaaaagacaagaattatactggttcaggtcccttgataggtaataaccctaatccagttgatgtgggattatatggtagaaaacacaggttacaaagggaacaagggaacttgtcggatccggcaagattgtagtcgagttgtttcgactagctctcgatgacttggctcctcgtaggctgtgtaggttgtgttggctctgagattcaatcccttaaaccctccccggggggtcccttttatatcgcagatctggaggtctccacgtagaactcggagatatcagaccctatacgatacgtcaacgacccaattctgcccgagtaggattcttcccgtctgtagattccatgaaaggttcccttagaatatacaggaaatatccgcatgcgcgtgggtatgtcatatcgatatgtaacatttatcgaagggtaaagggtatgcctaacccgtaaccctgacaacctatctttaggtgtgtttagttcacgctaaaattagaagtttggttgaaattagaacgatgtgatggaaaagttgaaagtttgtgtgtaggaaagttttgaggtgatgaaaaaattagaagtttaaagaaaaagtttagaactaaactcagcctttatttttttttttagcgtaaagagagattttattaatggcagaacataggatttacattcctggttaagcgatgcaagaatttctggcggagcgcataacctccactccgcttcaactcctgatctcataaccatttgagctaacatatgagccatgttatttgaatctctctttatctatcttgtgcacttgcacctgcaccaaacatcgcatcaccgcttttgcttcagcaattataactccccagtctgctcttgagtcttgtgttgaattcagtcctgctacgactttggcgttgtcggattctaaaattattggcatctgtacccaattggcagccaattggacaccctccaggcaagccaaggcttcaacctgagcagctaaactgcatctcgatactccctccgtccggattttaagtttttgctttaacgtttgaccactcgtcttatttaaaaaaatttaaaattattgtttattttatttgtgacttactttattatctacagtactttaaacacaacttttcgttttttacatttaaaaaaaaatttgaataagacgagtggtcaaacgttgtaatcaaaaactcaaaatcccttatattatgggacggagagagtagtttcttacaaactgcaaacaaaaccaaacctctgcaatctctagcgatgatttaaatattccatgccctcaccaatcaaaacatgcatggatattttttattagattggcggagagagaacataatactaatagtgattctcatttctcacatgcgaaaacaaaaatatgttttagatattgcataatgcataccacccacactagccttagctcatgtttggaggtggtgtatagaaaatagatgtaggtttcaaaagggcttccataatcaaaactaaattctctatttaatgttaattgctattttattttttgttccgtagcatcgcacaagtattttctttctatctattccctactattataaaaattaaagatgtttttattggtacgccattcgtgtatgagtcaatttttaagtttgttcgcttttagaaatacatatttgtatttgagtcggtttctaagttcgttcattttttaaaataaaaaaggagttgtataagaaatttcttttaaaaaaacattggactcctaatagcatctcattattctctactacttaaaaaatacaaaacatttccttcgtccatctaaataaaaaatagcaaaaaaaaaaagaagtccaattcccaaaagtttgagaaaaaatagcgaataaaataaaaaaatcgtagattcagttccccttaaaaagggaaaaacaacaaaaaaaaatgtccgattcctatgcaaggcggaaaaaagtggcgaaaaaaaaaacatgtccgatttgcaagccggaaaaaaacagtagatctaattccccttaaaaaggggggaaaatcctattcctatataatcctattcccacgtatggtttttctgttttccttctttttttcgtttcttttttttctttctttttttggttttttatttcctaatactatatatgtatacaaactttatatacacgtatacaaactttgtaaactgtatatttttttatacgcatgtatataagctttgtatgcttctctatcactgctacttaaaaaattcaaaacatttcattcgtccgcccctacttaaaaaattcacatctaaaaaagctccatctgattccctaagaaagtggcgaaaaaatagttcgtaaaaaataaaaaagaatgagaaaaaaagtaaaaggagcgggaaaaagcgcggtaaaaaaagttcgatttctattcgttttagtagtccgcatatatctcttctctatctctaatctaatctaatctaactatttgaaaagagaagttttcatagtacaactaaaaagagaagttttcatcgtacaattataaataaaagttttcaacgtacaactaaaaataaaaaaatacacgagaaaataaaaatggttaaaaaagcgtgagaaaaaaatgtcagaaaaaagcgctaaaaaatgtttccgtcatccctaaaaaataaaaaaaacatgcgaagaaaaaactgttagaaaaaacatgccatttctaaaaaaaatggtttggaaaaacctcgcatgaaaaaaacactgtatataaaaaaacaagctgctctgaaaaaaatatcagaaaaaacactaaattgatggacgctcaaaaaaaacactaaattgatggactcttaggtcggataggatcatcaattttttttcatctcctaccatgcttttgtttcgtctctatatgcaattattagactatttttgttaagtatagctaatatttctgataacatatgatatagaaataatactgaaaaataaacatatttttaattgttatttagagaagagtgcatagtgactctattttgtgtagacttgaccatgcgaggtaatgtagtatctgattaatcctattattggttgcaagaataagattgaaagagtattttagattatatatatgctgtcacgtggataatccaattattttaggtaaagcaggcatcggtaaggttgtcatcgttgaggttgggccattacattgaagatgttccaactttttgattgtcttagctataaacaatctatacaaacattatcattgacatggttatgtatgaaaaaaataaattatcgttagaattttttcacccgttgcaacgcacggacatttttgctagtttcttaaaaaatatatctctaagcgaatttccacagtaaatttcacattaactaaacagtatagcaataataagattaacatagccttcacccgttacaacgtacaggtattttttctagtctctataaaaataaaaataaaaatagtaactgtttagattgaaggatttgatcctctgcttcagaagaataggggatgtcattatctaaaaaaaagaataggggatgtggatcctctgctatatcaacaataaactgagtctaatactgtactgtaagacggtactcccagatatgattgctctaacatttctcatatttatatcgatggtaatgaatctaaatagatatatatatctagattcattaatatcaatataaatgtgaaaaatactaaaatgacttacattatgaaacggatggagtatatttttgagacgaagtccatatttgggacttcgaactttagtaggctaagctagtgagatgagttgaaccatgtgaggtgtccaccgcagccaatcaggtggaaaacatggaggtacacgaaataccgcacccaaaccatgagcaacgccgacatgatctccgacgagctcgaccggtagatcgaatgcttgcctgtctccctcgccatggtgatctcccccgcgatcacccgccccagcagcacggcggcgccggcgtccatggcccagaacgcgccggcgatgaccgtggcgaacgtgccaacgtctccggcgttcgtggcggccgaggcc

SEQ ID NO: 31087 - DNA, 7394 bp, Oryza sativa
ccgttcgtgaggcaccaccacagcgccgcggcggcggaggcgttcgcggcccaggcgagcgcgacgtcgtcggcggcgagcacgggcacggccaggacggcggcgaggagcgcggcgggggcggcgacggcgcacgcgagcatcgggtagggcgtctggtggaggccgcgcggcgcgcggaggaacgcgagcgcgtagacggagaaggggagcatgaagaggagcgcgccgtggccgagcgcgaaggccagcgccgccggcgcggcggcggcggcatggtaggacaccgcggcggcgaacggcgcgtaggcggcggacacggccatggcgacgtccgccgccttcctgaatatgaacaccttcttcttcttcgccatgtgtgatgcgctagtagccgcttaatttctctctctttcaaatcaaatcaatcgaattatataaatcaaattgatttgatttatatggaagagatcgaattgggggagggggggtcgtcaattatatggactcatcagaatcggttcttgtttctcaagaagagaattggttctggtttaagtaaaagtagaagtcgattcctatacgtcggtacaaaattttgacaacccgttatatttcacagtcctaatcatatctagcgtacaaaatctctatttaggcgtagacatagctcaattcaaatagggttgctgaattgtttggcttagatatgtgtgaaattagagccaagctgtgtcaggttttgggcaacttcggtccctgatgccgtaagttggttaggttgggattctgcctcgatctcttaagttaatggtaatttgctgtgattagttaagctatggctataagccgtataaatatgaaccaagcaaacaaaaaataatttagggttaaaacttttatatctttactatttgtggtttaaaagccaacgctacaaataaactacaataaaataattctaaattaactctaaaattgtatttctaaatttaaattctggctccaactgataagcctacaagtaaagaatgagaatgttttactactctctagctaaaaaagcataagagaagtttctaggatttgattattttagaagttccctttttactgcacatttcccgtttcaaataatcaacagcttccactaaaccattttccactatttttcgaaacaaatatagaaaaatacttggaacccttcgctattatcgctcctttgccacatagtttgatggcatcctataaataccatgaagttggttggctttgctaaaatgccatattgattttttttttgagaaagtcatattgataatctaattcgctcattagcacaccatcagatgaaatgtcaaaattgctcacatatcaatttgtatgtatcctggtgtggtttgagtttgttttttttttttaacaagttcgcccatctgtagccatgatttttatacatttcctgcttgcgaacctgaattccactataagaagttagagtattcagtcaagagacatcgcaatcttcggtgtaaagcatatatactttcatgtcacatccaaactaaggagaaaatgcgacagtaaaattgtttcatctctctgaacatcactaaaatgcgttaaatatatactccatgtacaaaaccgtcagcgagaaactgagcttgtaattttctcctaaaccggtcaaagttagcatcataaacacagcctaatactgaccatcaggccaacctaaagcttctgccatatggcacgctaattctcatcgtcggacccaaacggctcaagccgccggaccgactccagcacagcgggccggcgcgagccgacgcccagcatggacctcaccttgggcacgctcatcgagttcagcggcggcgtcggcgtgttccggttcacctccttgagcaccgacctcgccgtggccctcgccgagccgtccgccgccctcttgccgccaccgttcaccgccggcgaggctccgcttggcccagcctccgcagcagctgcggccttggccttgcccttgccggcgacgtcgagcttctgcatgtcgtagaggagctccttctgcagctgcttgtccgccaccagtatctcgtcgaactcgttcttgtagtccttgagcagggtccgcaggcactccatcaggcagccggtgagcgggctgttcttgctctcgagaaggcgcttcagctcgatgaagatcgggatggcgatctggatcaggttcttcttcgccacctgggtgacggctctccctttcgccgcctggagagtggcattggacgacccgccatcgccgcattcctcatccatctcggaattgtccgtgcaaatgttggggtggatgcgcatctccttgcatgccagtatttgtagagcatcctgtgaaaatgtagctaaatggtcacaaaggaaagaagcaaaggctaaatggaggaaattgctgagcaaacattttgatacgattgagaaaacgtagaaacagaaaaaacgtaggattttgatacgagtacaagtgtaaaacaaaggattgcaaaacacaggaaaaacacaggaatgaccgtttgattggaccgcaggaaaaacgtaggaattagaggagagatgaagactcgtaagaaaattttcatgaggtagaacctcatgctagatttcctccaaaacttccatgtctttagacattccataggaatttcataggatttcataggattcattcctttgattcaaagggctatataggaaaaattcctttaggaatggaatcctttaaaattcctatgaatttcctttgaatcaaaggggacctaaacgtgtaaactgtaagcatgaaagttaatctcagttccttggctgcatgtgcatgaacaatttacttcacattagcgtgaaacttgtccaaaatatcaatattggtatggtatgtacctgaagtacagcccttccagcggcatcatcgacattgagcaagccatcacaagcagctgccaagatctcggcacataacttggcagacgtagctaaaaggtgctctggtgccatttgcttcagcagagatacatatatgtgcattcttttcgacctcgacctttcgtcagtgcctctgcagcaaaaagaaaaaaataaccatgatagaactcaggagaggatgaagcacagctttttgcaaagtggatatctttttttttctcaaaaacgcatgaggaatttctacatattttaccgtattgcaaaaagggttggtcctccgtccaaccttccctgagattcggtttgcgcaccattacccaagcaattgtttaggacatagatagcttctatgaaactattatatgcaaggagtggcgctttagctgcaaaatttatgtcaacattagacagataacacagaaagggggtaaatccttcagaaaaagaacttgagtgcttgactttcccaagaaaaaagaaaacgtgtggccacaatttttttcaaatttcaaataaaaaaaatcaagtaaaagataaaacagaacgcagggtaaacctttcaagatgttcccaaaaaggaagtctgccaaatgccttatcttctctgactcatcaactaaagatggcaggaaccgaaggaagagcacacctctccactttacatagtccctctaaataaaagaaaagtttcaataaaccatgatccaaacatgtggaagtgatattaagaaaattattagcacctgcagcaactttgagagtaggataaatgtttgcctcctcactacctcacagggatcacgcaacgattttgttatttttgacatataactgcagagtgaataaaaaggggaggtcagttagaagttgaactattttaatgttttccctgtttcccacgtgcagtttaactgataagatcttaatcaaacagtaaagcagttttacatcttttgcaactgaagctgtaacaaagataaacccaaattttgtgaatattgacagtatgtgctaattttacaaagtatgcacacactagtgatatctatgctttatattatgtgactgtgtaagcaagcaaatgcaaatccacttgaaagaaacacagtaacaggattttggaaggacataacagatataaaagtcaaccaatggagatgtaagctcaccagtcaaccattgcggtataacggacataaaagtctgccagtgcaatcatgatgttattccggagggtagccaaatcactcctctcaagttcctgagtcaaagaagtagcattgagtgtttctattaagagtagacatggaagtgcaaccatgcaaggctacgcacctgaacaaaaagtggaatatatcttttcgcaagtttgtcatccacaaggcatattttagccattgtatcccaggactgtatatataaagatggagctagctctttgaaagaaacagtcccaccagcaagattttttggtcttggctgagagtttccagatgttatgattgtgtgcagcgaaggaatgacgccttgcacattagcagtggggcaagctaggatcagcgatccaatggtgaatacagcaataactgcatgtgacattgacttttgtgcagatgcatcttttcttcccttgagttttccactcaaaggtgtaaaaaatttaggacccttagcagcttctgatgtctcctttatgtattcatcaagaatgttaacagctttacatataagttgctgcacccacttcaggatcagtgtttcgccctccttagctgtttttgcttttcgtttgcataacgttttcagggattttacatgagcatcaacctgtatgtgtatgaaaataagacattatggtgaacatatcacaatgaattacttatatcaagagcgatgtggtacacaaaaatggtattcatctaacaaagaaggtaaaggtagcaatgccatgaataaaaataatacaagtggataagtaacaccattgcagaactatggagagaaaaaaaaaaagggcaggtaaaaacaaggtaggtaacaaataatctgagcatacagatacgggataatcttgtcataacaagtaggtttccacagagcaattttgggagttgggactatgatgtgaaccttcagataagctagaaggatacctcattcagaaaactaattcaaaatattgtggattattatagttatgggtatatatacccagtctttaccttatagatcactgacatgttcaccttcattcaaattaaagacaccattaaaagcactggctagatcaaattcttcataaaaataaatactccctagtcccatttccaatagagtaacatgactagggtggaatgcaatgtggcatggtagatttcagcgtagtgccatagtggatttacaaatcaagatgattaatgatttagtggtttttacaactaaattgcagcctagtcctgaccacaaacagagtacatgatttgttgctatgtaataaatctattgtactagactaaattttgcaattgatacattaaatgattacctcactaaggttcatgtcaaaattttcaatccgtgtgagcaagctgtgtgcaagttctgctgcaggttccacaggcagctccatggaaacatttgaaatagtttgcaagagtgaaacacgatccacagcccataatgcagaatttggttcccctttaggacgaactttgcctttatcttggccaacattatcaaggagtttccagtggtgtgagaggaatttccagttaactgatttaggtgcaaatgatgagacctcagaaagaagccaccatgccccggctggtgcagtccacatctcaattggtttacaacctctcaaccacaaggactctgatattgttatgatattctgcaatgaacttgcaagcagtggtttcagctttttcttcttcccaaggcttgcacatatcttttttatgcatggtgcaacctctccatcacagatacttttcagcaaatccagtgtccctttaggaaacacttcctccatatcattggaatcatcatttagattcaaattggcagcttgacagaccctgttcaggaccaattcaagaaacaaattctcacattcctcttggatacttgtctcactatcaataaccagtggtggcacagcctgaagccactcttttgttaccctctcatccgggaagttcctgaacacctctgagatggctgcaagagctgccttgcgtatgctgactagcggatcagagcacgcagcccccatagcactgagtagcgactcgtcaacaggcctcccgatcaatctgattgacttagtaatgagcacaagcgcagccttcctcacagcagccttatcatcagcgcaccgcagcctcagcaactcgccaaggcctatgttccctatcctcatcacctcctgcaaccggtcaacctccatgcctctttcagacaaaacgtcgagcgcctgggctgcgttcgtcaaggcccgagccctgacccctcccaccgtatccgagcacctctccacaagcacccggacaaacttcagcccccaagaaccctcctgtagaccacaatcatccccttccgatggcagcagcaatggcagcatcgccaagatcaaatccacagcaagcagccgccctttcgccttccccttcgccatagccaccacatacccagcaaatccctccatctccaattgccccattgctcgcaccacctcgactatggcctccaccgccatcgccctagcctccgacttctccggcgccttcgccgccagatacctcggtaggtaacccaccgccttcctcaccccatcctcccctccctccacacccaacggcacaaccttcctcgccaagaattccaccgcggacgcccgcgccgccgatctggaccctgagagcgccacgggggccagcgcgcgcaccaaatcgggcatcgcctcggcgtagtagccagatccgaggacggcgacgaggacatcgaaggcggcgagctccgcggcggtgtcgacgagcgacctccgcgcgtccgggtgctccccgagcggcagcctccccgcggcgtcggcgaggagcgcgagcgccctggggaggagcgacggggccgccgccggcgactgacgctgctggtggctcttccgcttccggttccggtggttccccttgccggagccggagccggagccggagccggagctagggttggccgccgccgccgcatcgtgcgacgcggcggacgacgacgccgacttgcggagggcgaggaggagggagaggaaggggagcggcgagaagagggagaggagaggggaggccggggcgaggaggaggcggaggtaggcgacggcggcggggagcgggtggtgcgcggaggagaggaggcgg

SEQ ID NO: 31088 - DNA, 11888 bp, Oryza sativa
  unsure (1)..(11888): unsure at all n locations
gggaggagagaggttggtgcggtgtgctgggtcctgggtgggtttaacgttggaaactggaatgtgggtccagaagtctagagggtctaagaggaactggataatggctttttccttaggccatgtttaggtcccacgcaaaatttttttaccctatcacatcgaatgtttgaacatagatatagagtattaaatatagacaaagaacaaaactaattatacagattgcgtgtaaattgcgagacgaatcttttaagcctaattgctccatgatttgataatgtagtgctacagtaaatatttgttaatgacggattaattagccttaataaatttgtctcataatttgcaggcggaatctgtaatttgttttgttattagtctacgtttaatacttcaaatgtgtgtctttatatccaacgtgacatcccaaaacttttcatccctggaattaaacagggccttagaccctatttagatgggattaaaacttttaagtccctatcacatcggatgtttgggcactaattataaatattaaacgtagactattaataaaactcatccataatcttagactaattcacgagacgaatctattgagcctaattaatccataattagcctatgtaatgctacagtaaacattctttaattatggattgattaggcttaaaaaatttgtctcgcaaattagctttcgtttatgtaattagatttgtaagtagtctatatttaatactctaaatacagagactaaagttaagtccctggatccaaacaccactttagtatatctttgtacggaagacgtgtgcaatgctatatttctactctctcagttttatattataggtcactttgacatttttttcctagttaaactttgttaaatttgaccaaatttaaagaaaaatttagtaatatctaaaacaccgaattagtttttattaaatctagcattgaatatattttattaaacgcacgataggacggcgggatagtgtgggccagttaggttgggcttggaggggaggggttgggctaggataggatgtataatagttattctatactcacatcaaattggatacggacgatatataacaactcaaaaacggatgacgtatcaaaatttcgacaaaaaacatctttgatttttataatagtagatatatgtttgttttgtgttaaaaatgctactatgtttttctataaacttggacaaactttaaaaagtttaactaaaaatgtcaaaacgacatgtaatacgaaacagagagagtactttgtattacctctattcaaaatgtaggtttttttagtgagcatgggtatttaaaaaatcggtagaaataattaaagtaaggttgtgattagctgagaacagacagtagacgagataattaaatggagaatggttatgatttgttgagaggaggggaagagtgaaaaaatagcttcattttgggtgaagagtgaaaaaaatagtttcattttgggacaagactgcctgtatgttgcaatggcaaaaaacaaagtcacgttgtgcacacttatctttttgaagattctgcaaactggctctttctaatccttttaactatatggattaattccctactccctccggtttcatattaattggcattttagatgaggttgagatcgaacttttataactttgacaattaataactttaaaaatatttaatttaaaagaactagaacaacatatatagatttgtctttcaaagcactacaataaaagtaaatatgcaattatttattatatatattataatagaaaaataaggtcaaagatatattttgtagaccgtatcattgtccaaaacgtcaattaaaatgaaactgaagggagtacgtacttaccggaccttaaaaaaatattgacattattttgcttagacatacttttttttttacgtttgaatccagtgagcacgtgagtttcaccgataaggaggcctaatatgttagcgatagaggtgatagtagcagactcactgctaccaccagtccatcactactatattttaaaatagtatagataaaaagtacacttatttgagtcggatggtgacaaatgttagtattatagtcacgttgatgaaaaaagaatggaggtgtggcattcatttgtggtgttcattttttgtggcctgagtcaggcaactctccagataagtaaccaaacaaatttgtatgttgttcagacttgttacaggtgtggcatctaggctaccaaccaaacacactcgtaatgttgctatgaatgtggaggatatcatggccttaacggatgtatggagatgatcgagaaaagcatgctaccaagacgtggttaagatatgatcgaggaggacaccctgacgtatggaaatagttaagttgataaacaatggaaatagttcaaatccatccagtgaccggactttaagttgataaacaatggtggaaacataatagctactcgcctactctctctgtcctaaaatataatcatctctagctatgaatctggactgggctataactcgttgagcaaaggttgagatggtattctattccattattggccctgttcggcagctagggctgccacagtcgctgcggccgcagttcaaagtcgctgcaagctgcagcaattttgaacagttgcagccgcagccgctgctgaaaaatgacagctgaacacacccattagaaaaaagaaaatagttaaaagaagcaaaatgggatgaggttaagcttgattacacgagttactggatccgatgggaaattgggaatacacccaaatcattgtcctttaacgagcaaaagatataaaatagtgagaaaacaatatacttgtaggtagaagtaacatgaagatgatgaggatgcgagtgaaacgagaaaagaatttgggagatcgatgcaacacggtggcagacccatgatttcatcaagccactacactataaaacacttcccaatccaacctttaataaactattaaaacacttcccaattcaatctttatttgagttaacagatctgttttattaaatatcacataaccctatttattatggttttaaatggaacaagatatatgggttttggcatattgcacagtgaccatcggtattagatttcacaaaaccacactactagtaatcaatctgaattaacactatagcaaaataaaaaagaattaacttagattactataacttttatatgatcgaattaaagaactcagatgaaattttggttactgctgctgttttctgaagttataggagcataataccattataagcaacatgccaaaacaaatgacttatgcacaattggttaatacatgaagttccgtaaaatttactctttaaaggaaactctacaggattttgtgatactagcgttatacgttcaaggaacgagcaaataacgaagcggtaacagagaacaagaggaaatcaaaattccagatcaactttatacaaaatcacacaggaatcagaggaacatccccaatgtgtgttccagaagttcactataaacaagataattgaacttacgaaaagcccatggcatcaaactggcaacattcatgatccatgcaatttgggccctccatggtaaataaaccctgtgcctaatccaaaaaccacaacactggccaccccaaatccgctgctacacaaccctggatcaaccgagcaaaaagaacgctaatatacacctactggatgagggtctgccgcagggccaccacatgtggctgtgaaatgtcatttgaatcaacacatacagaagggagaagatgagggtgtataataaaacaaacaatattggtaataacaatacaattgtaattatggtggaactttcacttcatcgtttcatgggtccgccgaccgactgctccagctcggttgttctatgaggtgctgtcccaccccgattgcctcatgcaggtgaagattggtgagcaatatgtttcatttgcgcaggccgtttagaagagttcctctgagttgaatttgttccatgcctcctgttttgtgcaaacatagaggaggtttaattaaagtttataccaaaaggatgtaatgggaaacactagaaaatagaactctttaaaagtcccggcacttggtaaacaattttagggaaaacaattgagtacaagctcttttttcttgctaaaaataaataataagatcctaaatatgcaacattgtataaagaagtaagctaatgtaagatatactagccaaagtactaaatatcaacaagatcaatctgatgtattaaattatcgtatcgtgtatatgtcaagcatttgcttttgggttcctctaggcagactatcaggccattactaaggtttgcattaatttggttgtgggcatagtaggcagggcatgccagatatacttgcgttggcaccaggtggtggtccaggtggacacaaaccaaagtttgcattaatatgggttattctagtgtaccatcaatcatatgaaaactgtcaaaccttggcactttccatgtgaaatcatagaggaagccttatttggctcaatggaccacacatgaataataatatctcaaaatgtacagtgaaagatcctaaatattcataattgacaaatagtcagtttccatgtagaggccaatgtcctaaaattggaaaaacacattaataagtcctgttaggctctgtagctaggcagtccctaatttctccacaataaactaaaagggaaataaaaacatacggttgaccattgttagtgtgaagcagcatgctgctattatggtttgtgaatatattttggcagcatacacaccttaaggagatcaaacaccttctcggcaacatatttctgctgtagatttgcccccttttgctgcaccttgtcaggatgtatgcacaatgttgcctttctatatacctttttaaccgcagcagcagtaatcaagtcagtcagggatacaggttgccatccacattctggccaaagtacctgtcagaaagaacagaattaataataattctcttcaaactagccctaaaatgcaatgtttgttgaataggagtaattattagtccttcacaattttctatttacttacatacagagtatgtattatagcttgcgaggaaggagctactgtatgcaggtaatggcaaaccaagagaataacaccagataaacgtttttactggaagacttagaaaaacaaaagatattcagcccatccagcaatctggtctttgagccactcagctatgttacattcaaacatcagcaagaaaccaaaactatctgatatcacctattcacctcaataccatggttttggtcaccacaggtgaaaacaaagcttacaaaaagctgtagcagggaatacaattactggaacctgcatgcttaacaaaattacctcggaactacccttggatagaaaatatcatgtgttgaaatgtgaccatgataaaggaacacactctacgttaaaaattgcactaccaaactgatcagggaaaagtatggcttccagaagacaagcaaaagagtcaagcaactttctttgcaagaataacaccgagagaatgaatagaaaaattgagaagacaaggataattgattcaatttttagcagcatcaggaataaggacttacatattgcaaagttgatagcaatgcacgcaaattgccttcttttccagcagcccatcgcttaatctcaaagtccattgtttctgaaattctctggattaacagataacgaaacaaaggaactagccattagcaaaatattgatagagagtgcattcatggtacactaacttgtatggtgggtgcaaataggtacaataacttgcaaattgcttattccagtacaataacttggccagtttgtgcaaacctgggccaaaccgatccacaagtaaaattgatcaaatatgatacattacatactggtgtgtaattattgttacacatcaaaattttatactgacaacgtatattttcaagatttagaccaacaaaaaagtaaaataattaaaaatgcccaatcattaaatacactttcgatgaaagagtatctgaacatgaacatgaaaattaaagtgttcttttaggagttaaatgtacagataaaaattgtcttggtcttgaacagataaataaacattagacgagttatatagaggatcaaattttcccaataaatgaaataaatactctatcctggacatgaaaaataaacttttgcacatctaattcctctttttatttggattcgaaataagatctccaaatcacagtcatacgtgtatgctgtcatatcattagtgtgtgctaatttagagcaattttacttgtgtggatcattttggcccggtaaacaccaactagccaagttattgtatcaaagtgagcaatttgcaagtggttgtatctatttgcacccaccacacaagttccatgtaccgtgagtgtaatttactcaacaaataaaatgcaccacaacatcatcagtaaacttgtatatgaaaataaatggagactaaccagtatgacaagtatttaaaagaagtaaaattgggcaattgaaagataaaaagtacttacatgtctttcagcctgctccctttgaacctgcatatcccgttcattcttttcagccagggcttttgcctgcatacacggtgaagttaataaatggcactgcaactcaaattcatgcatcacaactcttaataaatagaaaaaaataacatgtaaatgataaaattcaggaacataaaatgaatgtccacagtaccaaattataacagcaagttacaaacaaatatctattttagttactaaaatcattagcaacattaccgctcgttcacgggtcctttgatgccgttcgaacctagcacgtcttctttcttcactctctccttcaatttcttgaaattcttcagatgatgtgggagctaaaagaaaagaaatcaaccaaatgagttatagcgatagccaataatattgcaaaaccttgtatgttcagaactgctgcatttgggttgatccgtacctcctccaaatattgcagataggtcatctgcaatatttgttgttgatgatgccttccgcatagatgctgaagcagaagatgctgcccctctattttgagtttgagaattgaacatcgaatcctgaaacgtccacagttggtaaaacaataacccaaaaattgccatgaacaaaattttagcatgcatgttttggtagagtaatcaccgctgttggagccctttgcttcggcgcactattggctcgagctcccataccaaagaaggactcaagatcgtccggtttactctgtttttcttttgctgcagctgctgcagcagcagcagcagcagcctgcctttctcgagcctcagcagcttgacgttcccgagcctcagaagcagccctctctactgctgctctttcagctctcctccttgcttcttgttgagctctctccactgcagctctttctgctgcagccctatccctggcttgagttgcaaccttctccttggcttcagcagcagccctctccttcgcttcagcagctgccctctcagctcgttccctagcgtctacagcagccctctcacgtgcttccttttgagctctttgaacagcagcccgctctgcacgctggcgtgcctccctctctgcttttgcacgtgcttctgcagctgctctttcccgtgcttcctttgtagccctttccacagcttgcctagcagccctctctctttctctctgtttctcaagttccctctcctcttcaagtcttctttgctctctctccttttcctccctttgtctcatctctctctcccgttctagtctttcctgcctatctctctcttcatgatcctgggtgttgaaccttgcttcatcatcttgttcctgctgttctctatttctatgttttgcatcgcgttccctttcccgtacaaccttcgcatgcttgaactttgcctcagctttatccattgcttccttcatagcagctgcagatgctgctgctgatgaactatgctcaaattcttcctcattaaaaggatttgcattgtcataggcagaactttgagacttgcccatggcaaaatcttccagttcatctattgaagaagaaccagcttgatttgacgagcttctgtgatgattgtggttttggttagaccggcgtggataattgtcatcttttctttttgcttgtgatccatgtggtttttgcttaacagcaagaggtggtggtgttcttgaaggtggtggggcactagttggctgtgtgaagaggggaatctcagaaactgtaagccagatctcatcttcggactcatcagatcttggagactggtcatccataccattcccactgtatttctctgaaccagaggcaccaatgtcaacatgaacatcagaatatcgagcagactgtgacttaggaaagatattttcgaagttctccacagaaggtttttgggttgtattttttctggaaaaattttgcacaggacttgaatctcgatctttggtggagccattcctatctttcaagtcatcattcaactctgaggtaaacagaggttctgattttgggacctgattaaaagtgcttgagtcctcgaataggccactgtcaacagcagtattatcatgttttttcccttgagattttgcaggcctgcccagttcatccaagggatccgtgaatatccctgaagatgtatgctttgaggttgaagttgtaccaagaacatcaaatgggtcacttgccatgctagctggcttagacgttgacatggacacattcttatctttagttccaacagtctccctatgattcaaaaaaaaaaaggatgagggaatttatggtaacaaatctgtatatgattgacatattttagattaaaaagatccaaatcattctttaaacaaagcaatttcagaacctcgtagatattcttcttgcataactcactacatattccatcactataaagcgttatatttgaacctaaggtaatttgcaatcaaagttgtgcagcctatgaacctaccacatccggtcattaatgcatgctgaacattctctatgaactatgtgcaatttaaataaaccataataaacctagcatacactgtattatccacataacgcaatatagaggccaaagcaagtttgcctgagaaagtgcactggtatctttaggaaagtagggaatgcttataaaaagcatagcatatgttcctaggcgtttctaatagtaaaatcgaagtagagcccataaaattcacaagatgcccataagtttatccacaagatgccattgatattcaatggtcaacacagatcatacctaatggaaaatagcctataaattcaattaccaaatagatttgaagatataagccatcaatgaatttcctacctcaactggtataagttaccaattcaaacaatcgcacgtgcacattaacaagctaaaatctaagcaaatgcaacataaattagatatgggagtccataatttgtccaactcaactgaattatcacatggttctctcgttgccgagttggctcataccgacaaagcttccgcttgatccaaactactactaaatttactcctagattgcacatgtagacaacataatgcccgaaattcccatgcaaaaaggtgtgctcacctggcacgcatcgggatcctcccgccaaaccctgggatcaaatcatcaaacccagccgatgaagcggccggctcaggcttcctcttctcctccggcagcacctccttcacctccggcttgctcccaaatcccccaagcagatcatcgtacgcaggtggcggcggcgcgtggctgccaccgaatacatcgtcaaaccgcgccgaggagctgctcttcaccccgggaaccccatcgaagatgtcgtcatcgtagaccggcttgtcaaacaccggcatggacgagtgcttcggcttgggtggggcatccggggcggagggctccttgaaggagtcaaagatggcgtcgagggagggcgagggcgcggccttgggcggcggggcggagggcgccgcggccccgaagaggtcatcgtacaagggcgcgggcggggcggtggcggcggcggcggaggacgccgatgcggatctggagttggaccaggcggatccggaggacgcggcggcgcgggcggccgacatgggcgccgccttcccctgcgggcgcagcccaaagtcgcgggccaggaggccctggaagtcgtccatggcaaccgcaacagcgcacagatcaccggatctgactcacgagctcaccccccgcccacaccaccaccacctcccgccgcggaggctaagagcgagtacgcgagggggggggtgtggatctgggggaaaggaagaggaggaggatcggggacggcgacgagacagctaccgatctggggaatgagggggagcgctccttggcggcggcggcggtggcccggtcgccggagacgccgccggagagatcgccggagacgggaggggagagagagagacggtgagtcgaggaggagagagagagatggggagagagagaagagagagaggtggtgtgtgggcgatatcatcgggacccgtgctttccccactgccacgtggagcccacgaggaaagttggagatcgtgttacggctacgggggattcgtccgaaccgcgtcactgacaggtgggtctggtttttgttggtcccacctgtctgtgaggtgtgagggtggtgaggagggcttgaacgtgggagtgccagcgcgtcggtggcggcttacgcgctgtgcggggggattcggtgtgtggggccgggggatgtttggggggtacgtggacggatgtgattggtcggaaccggtgttgtgtggtttgtgcgatgcggtgtggtggacgaagtggatgggcccacgggtgggtgggtccacttgttcggtttgttcctttctcgcgctcgtccgtctccaccgtgcgtgatccgcctgaaggcgtaaaccttgaggtaccgcgttgctgtatagaaagcgtcagactaggtttactaaaatgaggtgttccgtttggtctatgcatgtgtacaccggtaacatgtgttttgaatacaaagtgtatcatttgactttttacggtaagtaggccagtaggcctcatgctttttatactggacggtcgtcagatgccacatatacaatatgggctaaagagtttacataacaacgggtgaaatgagctagtactatataaaaaaaagtatattacaataataattttgttattgacctccataaattaggtgtaggaataagcacctcggcaaccactggacaagtgggcagtgtggaggaagcagtggcaacaatttgacttagcttttttctgcacgtgaaataaaaacatttaacatattattaattaagtattaaatcgataagctagatttgtttgattttttttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31089 - DNA, 795 bp, Oryza sativa
gtcaagagatccaccaacgaagaataatcgtgcgagacgtgtgatgcagcgatatttttttctcaccgcgctccaagtcctacctctttttttttactcacctctcccacctacctctctcccagattgttctcttcaccacctctccctcaacctctcaagctcgaggcacgactactaataggcggcaaacagtggcggagctaagtttggaggagaggggggcctcagccttcttcttcctcctccagcccactctctccccccattttcttcttcctctccctcttttccccctctcctccctcaaatttccatggagtccagctgggtagcgggggctcgagccctccccccttcccccgcccccatactggctccgccgctagcgacagatccagccggcggcggagctcgaggcgcggccgtgtgggcgacagatccggtcgacggcggagattgaggtgcagctagggcgacggctcggagtgtggtggagctcgaggcatggatccagcagtcggcggctcgaagtgtgacggcggatcctgggcagtggctcgatcgtgggccacggatccggccgacagcggagctcgaggtgcagctagggcgacagatccgggcggcggcggttcggagcgtggcagagctcgaggtgtggccggagtgcgacgacggatctagccatgcagctcgggggacgggcggcagcttggattgtgggcgaccgtggctccgggcacgggctgcagatccgccggcggcggaggcttcgggagtgggcggcgctgc

SEQ ID NO: 31090 - DNA, 595 bp, Oryza sativa
caaaatatgtgaaagatgggtgcaaatcattcagttttaacagggtctttggtccagcatctactcaaggttaaacttataagttgctctggatttcccttttttttctcaaactgctttgatttgtatggaccactgaactttgcttcttttttttttttgttaatgcagaagaggtcttttcagacatgcagcctttgatccgttcagtccttgatggtttcaatgtctgcatatttgcatatggccaaactggatcaggaaagacttttaccatggtaatgaactgtactaaaaaaatattatttccatatgtcttgataaccttttcaaaattgttcaaaccactttatgaattttgtgcagagtggaccgaaagttttgacagaggaaagcctcggtgttaactatagagcactaaatgacttatttaatattaaagcacagagaaaggggacaatcgattatgaaatttctgtgcagatgattgagatctacaatgagcaagtgagggatctccttcaggatggtggaaacaggagatatccttttccattgaattgtgtttttctttaccagtaaaacgtcttctttt

SEQ ID NO: 31091 - DNA, 3720 bp, Oryza sativa
  unsure (1)..(3720): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctacgcaccatttgtcgccgaagattgatccattggatctcgatcaagcaacacaaaattactctcgctgcaacatatattttctcggctcaccacccgaaccctagatctagccgccagaccctcatccctcctcattcttcttgcctccgtcgttccccgctgccttttctccgccaacccctagacaacaaccctgccggcggccacctcccgccactagacaacaaaaccgccatcgctagttctctgggggcctttcgagggcaaggcggcaaggtggcgcgcagccgcacgaatcgattcaagctctagctagatgcagcactgaggtaaacatcctcacacataaaacttccctagttaaaatgcaacacaattgccccagcagcagcaggtagtgcatgaacaaccacgcaaacagtattctggagggctagggttagtacgacaaaggttgtgggtggcaatgcaagaacgctggaacaaattcacgggagtgagattgcgtgcagcatcacaacagagtgagattgcaatataacttgcctgtaactttttagagaaacactaggataaggtcacgggatataataccctcacctatgcatgcactgtgactttttttccttcctcgcttgcgtgaatcttggattgagtctaatgatctaaaattacgtgaaaagttacatacaagttacactgtatagtatgtatgttacaatataattacactacaattatgatactgtagttacatttgatattttttcgagaaattttgtcaagaaatgtaaataatggttcggaggtggctaggcgatgaagctaaagacctgaggtccggcccaaccacctgatgtacagcacaattctttccagcttaaccaaactgggctgcacttgtgttacaactatgccataataaatttaatagttttgagaaacacgattataattcaccttattgtaaggatgccattgcatccctttcaaaattggactcatgcttgatatctatttggaatccttttttggttattgtattttttatggaccaaaatacccctgcatacactttagatccatatgaacatgcttcattttagatcaaaacccaaactgcaacgaatcattgcgatgatatatctatcacacaaagagagaaaaaaaaagggagaatctaggataagaagaatttacgaaggaaaaaagggaagaaaaagagccagtcgaccccgagccggccatcccctccatgccgtgacctgccgtccccaagctcgcactgccgtcaaactcgatcaccggccccgacatagctcgccaccgccagatatgctcttcaggtctagctcgtgcctcgtacaggatggcatgaaaccaattttgaaagagttgaattagcatgatgaattatattagcattctttgaaattagcaaatttataatggtttggatccaatgaaccctaaataaaattggccaaatatacctgcaatcccattgaagcccaattaactggatatgtgagcctccctctatcctgcttgggcccaactgaaatgatcacggctcacttgggctgaaatttctgagcttttaagggctattttggtttgaagccaaaatgtgccttaccaatgcaaattgtttcgcactttgaatagtattttattagtgtttggtttgataccaaaatataccaataacatacaaaaagttactaaaattttagcacaccaaaacttgcctacgttttggtagtaccaatatttttggcatggtagcaaaccagacacatgctaagtgacaaattgttctttcgatgcccagcactagctaggccatggcaattgcttgactgtcccttgtatagtacacacgcttaattattgagcattcttccccacaaaaaaaaatattattgagcattcttcactagcacatgcacatgtacacattggatgccatccaaaggcttatgttaccatgtatcatatatataggagttttacccccaaaaacttgcaacatatgctacttgctacttctgtactagataaaatgagagtggagagaggcaggaaatttgaaacttctccatggcatcaaccgtccacgttattccaatgagagatttccacaattcgcatgcgtgtaccttagctatggaataacataggattaggagatatcgtgaagcacatgagtgcattgtgacccagacaagtatctagtcgtaaacctgttggagcgatgaggtctctagctcttgattcagtaaaacatctccagtttgactgcaacacagctgcctctacacttgtgtcctgaactaaacagccaagcaaacagcgtggagggatggagagaagcagtgcaactgcatcgaattctactctgctcgtagacgggaaggcaaacaagtctcccagatgataacttctttggtggagggatgaacgagacgtcgagacactgagctgggaggcaaccaacttgtgctttctcttacttaactaaatattgaaagtagctagcttgttgatggcatagcatttgaacatttgttttttctgcgtagatatatatgcagcagggtaacatgcagacatattagaacattttgaagctagaaccatccgtatatcccaattagcaagttcgtatgcctctcatatacggcatcatcgatccttcgttagaaaaaaatatagattacttgtacgaggaatcaaaatgcagaggcagcagccactaataaaaaaccctcataggtatcggctcataggtgtcggttcatttaaaaccggcacctattaatattttcccacttttgtgggatgaaaaaaatatagaactggcacatatgagtaaactatatgtggtagttcagagaacaaccggcacttattaatattatatgtgccatttaaattaaaaattgatacctataatatattataggtatcggttcttaaacaaaatacacccaatgaattaaactgagacgagccaaagacctggtgggaacttttatttgactccaccaacgcacctaacaatcttaaccactcataatgtctctccaccgacaccaaactcatctctctcacactcttctccgccgtccctctcctatgacgcctcctctccctcctctcctatggcgcctccttcccatcatctcaccgagcaactgcagccgcggtcatggtggcgtggaggccaagtcgggggattcggatcgtctaacttcgccctgtgaaggtacgaacgtacgtgtgcagtcacacttatccaccatccatgcaatccaccatccgctactgccttcaccctcgtattgattgttgaagctttgccattccatcttcctgctaggactggatgcatcaatcggcagtcatgcaccatgcttgctgcgtggaatatggaacacaactaaaatgagcggagcaaagtatgcattattgcattggattctatattgagcatacaaagcacgcattccatcaggcaat

SEQ ID NO: 31092 - DNA, 6021 bp, Oryza sativa
cacgcgcttgctcgcttgccgggccgggcaggcggcgcgcgacgtacgcatcgaatagatgcagcctgcttttgcagttatgttttgctgtgtgaaattcggatttgttttattttggaaatattctgaaaaatccgagaaaattcggatttgttttgttttggaaatattccgaaaaatccggtgcgtgaaaacagacttaaaattggatcctcacccttacgcagatgcagcctgcttttgcagttatgttttgctgtgggaaattcggatgtgttttgttttggaaatattccgaataatccggtgcgtgaaaacggacttgacaagggtgtgtaatcacctattatttatgcatagtatctcctccggtgcgtgaaaccggtcttgacaaggatgtgtaatcacctattatttatgcatagtggcttctagttctcggaaatattaaaaagagatagagaagcaataggcgagaataggctagctgggaacttcacagtaagataaataacaatactactctgagattcatggcttgctacttgcctatttggcatgcatgtaccgtggctacatacataggattcggaagtattgggaatcaacagagtgcgctatgagttggacaaccatctaatcccaaactagtgtccactgcgaggtagagaagtcctgatagagtaaaatctatctgttttcactgtaacacaactagctgttgatgcgaaaaacacacattgatctgtgagatctgcttagctccagtcaaattttggcgttaacatcagctcttcccacaggctcttatcaagcgagcacaaagtgcggaggaaagacttaggccttcttttcttcaactccaacattttagttttccgttagcacgttttttggttaaatagtgcgcttttaaaaaaatttctatagcaaagttatttaaaaaacaaaaaaaatccatttttaatgtttataatagttaatattaaattaatcatctcttaacgagctttctcgtttcgcgtttatgaaaaaaatttcctccaaacgtttgcaaagaacatgcttgcaattttataacccatacacaatttatttatgactcatattgggtttattctaatgttataatgtttaacattgattgacaaaattggttggatgttgactatttgtggaaggaattttttttaacgagccacaagtaattaatttgggactagaatgacacattgtaacaagttgtaggacttatatccatgagcatgtgggctatcccttaaaaaataggatcatcctattcctcatagcaaatggatatagatgaaacgtaccatctcatccaaaaataggggtgagtccaacaaatctcattttgttactgaaccaaacatatgtctagataacatagacgagcaaattttggggtttgccatgcactttactctgctttgtcaggattcataaaaagaataacatataacttaaggactatataaaaggttctaccaaataaaaaggatagctgaaaaaagggtgggaagtgggaagccgacaacttctcgacgaggccatgtagttacattacatacatggaaatgggatgcatcgtgaaccacaagagtgcactggcagcgtgtccatcatccaagatctcccgtgtaccagtgctttcgttgcgaagtgttaactgtaacagaaatgcctcaacgaatccctggagatcaacaatgtaaacagtgttagaggacgacctgaaaaaaaggatgctctcagatctctgcacgttggaagctgcatggctgttatagcactcactgaattgttagtagtgggagaacaaaacgttgccatagaaacagtatttgagaggtacagtaaataggactatttgatgtccatcaatctacaacacccttcttactacatgcatccaaataattagattcagttttcttatgacctgaacatggtattacactggcactggcttgacgcctgacgcaagagccagacagtaccgtggtgcatattgatgcagcaagacagggatggagactgctacaaaccctgaacctgaactttcgaaattgtgggttcctagatgttggttgtcccaggcatgcatcatatgcatagagtatatttttgcatggaagggatctcctgtaaaggggacttatttggagaactgtggatggtacaactatttttagataatggaagttctattggtctcagtcaattacatcaaagtgacccaattatcctaagaacactctcagcctctgcatagctaagatgcacacagctaaaacacactaaaagaaagacatcaacagtagtattaaggaccatcaattctgagactagatcgccactcatgtttccgggtaaaacaatccttgaggatggtacaactattgatgtaaagaatgataattggatccctaggattggagtggactgcttaaaccactgggtttaaggcaaaataatggtgtaatcaaagttaacgatctctttcccccagtaacaaaagacaatggagtatggaaagttaaccactggttccttttacttcagctgtacccgtagcatctaatttttgcaactactacttacaaccacaagttttgccagcatgcgcatattaaatgacattcaagttatggacttgacaagggtgtgtaatcatccattatttatacatggtatgtcctagttcctggaaagattaaagagagaaccaagaggcgagaattggctggctgagaacttcacaataagataaagttactataccgtgagattcatggattactacttgccaatttggcctgcatgtacctcagctacaaacataggaatgggaagaattgggaatcaaaggaacacaccgtgagtttgagaatctcatctaagcctaaactagtatccatgtagatttagagaagtcgtgatagagtaaaatctatctgatttcactgtttagggcatgtactaagggagagtcaggtgtgagctctatatcatcaaaggctattatcttaccgcagttgagacaaccattaatgtaccaaaataatcttatctttctcttctttcctttctttcaaaccacatccaacaaatattttctaataaatgttaagagtcgactctgaactagtgttatgcgtaatgatcatgtttctctttccatccctctctttgttccatgtcatcaaatttatttgcacgataatagcgagagcccactagtaaagaccatcgtacataccctaacgcaaccagctctttccatgggctcttagcaagtgagcacaaagttccgaggaaagccaatggaagttaaaagatttcgatcgactgtagcctcctgtatgccagctagcgggcggacgagttgatcggttagatctgcactcatatggaaaggtgcctgtcgtcccttttttcgttccttattttttgttcacgttaattttttgttttccctcctatattttgtattttgtgtatataaatgccttggaaattttgttccgcatatatgaacttttgacacatctatatatatacatatatgcatatataggcacacccaatgaaatttccgtaagtatattacatctgagtagttttgaaggcaatcaagtatattcatccacaggtattttaaaactttatacccttcaattgaaagctgctcccagcatatggtgcacatctgaggtgaattattgctctgcaggaagccaagcatacactacaattatgtgcatgaatacattttttagataatgatgtgtaatacgtactggcagataaaaggggacttgacagaggacagaaaacattcagaactacaaacgggtttggagctcagacatgagagacacaaacaacacttttagtatacacatgcataaggcatacaaattaaggattggatcattggaaggtatcggcaatcaagctagttgctttgcaatttctaacagcttccccactacaaaaagaggcagtatttaggtagctaaatcttgctggtttactacattttaggctggtttctatctcaactggctagtgtgttttatgttcaagcgaatgcactatggagggtgcgtgcatgatgctgtcaggcgccttgcaactatattaccctggcatctgcttgagtaagctccattacaagaatctatcatcaacggtagcaccgatttccgataaattgatctgtcttgtacagatccgctgatcaagaaactttcatgtgcgaagaagatcagggggtacaaaagagatatctgaaaagtttattcaagacaaatgagatcgtgcaggatacaaccattagaaatttagaatttagccaggatataattaacttgatagttgacatggccataataccaagtatgcttgtagaaacaattttttcagtgttctccactgatgatataatcaatttagaccttccatcttttctcatccaatagacattatatatttgataaattttaccaccgaaactactagtagaatccattgaaaaaattgttggtagttggaacattttcttcagtagctaatagatatcataaagcaattgttcatataacttctggtagtcataatacttgtactatttatcgtaaaacattaccattagagataaccctaaaaatactcgcttgcaaaatgagaattcgttgggtgctgaatatgaaggacattgatactccaattgccccaatattagtctagtgaaatattttaaaccgttgacaaaaaatagagcgaaatttgattttgtttattggagtaatctaatactattttagctccgtcaactagtagcaagtgcatgcttgataaataaaggcatctaagctcaacgtacgaatgagtttactaggggagtacatttttgacagatttattgttactttggtcagataaaaagagagcgagagggcattgtgtcgtccctccacatagctgcagtcactacgccagatcagtcaatctttgatggtccatctctgatgcacagatttatatgttaatttaaagttttctttatactcttccacatataaactctagctgaagatcaaaattcagaacgtattggtgggagacgttaaaaagcgcttgtcatgcatatagtgaatttccaaataggattgggaggcattggtaatgaaagaactccgagagcgatggatccagcatccaagactttttagctgtagcagaaagtgtgaagcaaactctctctccatcgatttgccagttttcagatgttttggaagctaagttgcctctcgcgctctggggcaagtgtcagttgctgttcagaactgtgcacagtacgactgcctcaggtgaagctagctgtgttgtgcatgtagcttcgacgattggaaggagagatctagcagctgtacgactttccaggatggggttattcgagtgatcgattagggctctgtttagttccacatcaaaattagaagtttggttgaaattggaatgatgtgacggaaaagtttgaagtttgtgtatgtaggaaatttttgatgtgatgaaaaagttggaaatttgaagaaaaattttacaactaaacacagcgtaggtgttctaaacaaggataatcgctaaatgaatagagcatgcacccataatgctcttactccttaatggaaaaatctttcgaaatgagcttccctcgtttagtttttagagggctttatttaaagctgatgttcttctgcatatgtgcagaatgaagaaacctctaaaagagatagttttttattggttaccaacagtgtaatcttttttctagtctcttgtaatttgtaaatatctttttttctataaaatcacactgcgaggcaaagtcatgcagtatttccggtaaaaaaaatattcgtcatgtagataagtaaccgtcgtaagcgtaatctgcataaaatctcgatcttaattggctttctacatata

SEQ ID NO: 31093 - DNA, 3492 bp, Oryza sativa
cggatcttccattgtaagaaggcacgatgtaatttggcaatgcactcaaagcaatatgggtaaaaatctaacaaaaagtactagtaccatacttcgtcttaacggtccaacgaaagatcgaagacgatacgaaacacctttcaatacgtgaaaattctagataatgtgtatacaagggaaacaatatataataatgactcgatggaaaattaatctgtacttttacttatgtgcataacttatgtttaattgtcgaaacaagattttggcaatacgaaaagggggtggctatcaagctagaaaagtggatgggttttgagacacagagttttatacaggtttaggccctctcaatgagaagtaataccctactcctgtgcggagattgatccaccgagtgtattattgatcgtatgatctggaaaaaaagttatgctccaagagacacccggacccctccttatatagggggaggagtccatattacaaggtacaacccagtcggatacgaaactgactaagaggtgagtaaagataaaatataatcgtaactgactaagactcagggtatttccttgatacacaagtttggaatttaacccgagtcccttaaagatattctatctacatacagtacccctatacctagtcggatatacatgccatgtgggtatggggtatccataatctccacattaattttcttaacaaagttagtgatcaccagtcattgtttataactaatttatacttgtaccataagttgagtgaaagttggggattttctataaagtagtgaacattgatgcaattcaacaacaatgtactgaatattttctgttgaaacattcgaccaaaaaatctatacctatactaattgggcactttctacgaactctcacgttaattagaaaaatccatccgttaatcgagtagacagtgtaatcttaaccgtagattatcaatctccttttaatcgttttaacgtgatgggcctggcaaagcccattcaatctgtcctactgtcacccacctacgtataccttttcttttttttctaatattcttttaatcctttttaacgtgatgatggaccagtcaccagggaaacatctgtctggctgtctcccacataagaattttaattctttttctgtttttttcaatacgcgagtactactattttctttcagtaatctgttgtcgtaagtattcttttccacagctgtacgtccaaaattggtagaacggcataattgcattattcggtagatggcaaggattaacgcgtcgacggtagtccttcttcatatgcagatggctatggcgtacgtcctgcaaactctccagctctgatgattttctcaccaagagacatcgttcgaattgatctctctgcctccggttgatattttcttaacaaagatttggttcaatttctttgtttaattcataactcagctatgccatcatttgatcttataaattcaggtgttatttgcatgtcgatctagaattaaacaagttcacttgcacccaataagatcgggagtggccagtacatctgcacagcattataaggaagaagcatatgcacacacaccctttaatacgcacctaacaaatgcatactcaaataaacggagattagctgtaaaaccaaaaaccatagccttcatatggatggtaagtgaatccttacataactttcaaatatgactaatttaatattttttatgttacttggcatcatatcctacaaatatgaagaactgaagaaaacaacacacacatgagacataagattaatcctatttcgaattacatatatagatatatattttatattatactccatgtggttaggtgaatcttattaccagctgatcaacttcaagttgagaatttgtttttaaagtaaacattccaattgcaatatgtaatctctttagcttttcaacattgtctaaaagcaagattccaaagtccaaaccaaattaaaagtacaacacgaacaaacatgcatgattaattcttaatttcgaaattattctatcaagtaaaattctcgatcgttactgaatactaaatctaggatcattaaatcatggaaaaacagtaactaacacttgaaacaaagaacatttcaatacttattaaatagtattaacttcacaactattaaatcatgaaaaacctataatcaaggtcccaaaccgagtacaactctttaatagttaaattttggagctattaaataacaatattctataatcaacacttaatgtccatactgggtatagtcgtactaactaattttaaaatttcaaattaaataatgaaaatgataaaccatgactccatagatgcgtgcaaatcaacagttattaattcttatttttaatattattaaatatagaaaataaaaaataactagcagagaaaatattaagatggatgactcaatatttgtgtatttttcatttttcaacaatcaatcattctgctgtgtttagaacattaatataaagtctacatgtaaatttaataactaccgtattggacatatgataaaatttcaatattaataataatatcccgtgcaacgcacggatagacggctagttatctgaatttaaagacattgttcgattataccagttagctagctgacattcagtatgtgcgcaacacactatcgccagttccctttgcttgatttcatcgcatttaataagtttggactttataaggatgtgcaatcacacagtgtgttttcaactgtatctctccttaatttcctagaagataaaaatgaggagaaatagggtgagaacagggcaactcacagctagcatctcggcaaagaccagtgcttcacatgcttacaatgcagttacgttacaaacgtagaactaggatgcatcgggaatcaaacgagtgcattagcagttagccaactatccaatagttcttatccaagttttgatgctcttgtttagctgtaacacaactacctctgccaatagcttgtggccttccggtcaaccgagcaaagcattttattgcttttagtttttcagtctctgccgtctccatattttctagacacccaagagtcaaaatgtctcatagaaatagcatggttgtgcttcagaggtgctcattgggaacttttttcatccacacacaaaacgaggtagctcattagcatatcattatttaagtattagcttaaaagcttcaaaatggattaatataattttttagaagtttttctatattcattttttggaaaaaaaattgtaccatttatctgtttgagaagcgtgctaacgtgaaacgatggggtagaatttgggaaacatgagttacaaaggcagctaagtatgaaacacagtaacagcagtatcgtaattccgaagccaatctctacagaattaattcttacgcatgccgtcaaaaaaaatcagtttctaatgaacatactag

SEQ ID NO: 31094 - DNA, 2865 bp, Oryza sativa
atagcacatacccattcacacacaaaaacgacgactatgacttggaggataccggaaatacagcaggcacagttgtgaaagctacaggccagtggttaattcactttttggccgtgtttagttcccctattcccaacttcctatcacatcgtatcacatcaaaaacttttctacacacataaacttctaactttttctccaaactaccaactttcttccaactttctaacttttccacatctaaacatagccttttttttgaagcataaaccgatcaggcaacagcctcagcagtacatttattcgatagcaaccgagagtacaactgattttgcaaagaagcccccgaaagtagggaagattacacttaaaacacaagggatgcaaagaaggacctgaaaagataatgaaaaagcaattggagccgtggcccggctgcagaagatgacgcctaggctcgaacccaaatggggcctccaagagtaggaggttgaagaagccttgacaagcaaagataatatcactcgcactttatgaatcctttcgccggagacgaagaagatggccaacaccaatgcaagaagctcgccagagaagaactgggcggccggcgcaaccttcttcttcttgggctagaggacaagtctccaaacccgagcaaatcagcggaactcctagttgtaggcgttgaaggggaacccagcaagtacaagagaccccgatcgatgagaatgccggtgaagtcctccatggccgcaagccgggacaagaagagcgaaaatgccggtggccttcttgagccgcacaacgaacgtgattaacccgactatgggagagacccaactaagctaaagctatacctattaaaggagaagccggacaccctcccctcttactggcgaccggagagccgccggattccgaaaggaagaggacatgaagaagcactagtatgaaatcgtccatctatgacgttttgctcgtgacgctgtataatttcgtattgaacagagcatatctatgacgaaatttcatgttttgtcagggatcactcatggtgggggtagacattgaaactccatgacgaaatttaaaatggcgtcaaaaaaacaatagataatttcgtcacaatggtgtgcacgattcatgctcctttattagtacaatttatgctgtaatagcaaatcaggttgtcactggacccacatataattaaagataaagtaggtcgctacattcgttttagttatagcccatgtgaactattttttctaaaaaatatgctgcacacctaggggtcgaaccaacgacctgtggaatggcataagtcaagcttaaccactacactgcgaagatctttcatgctattggtgtctcaattctagttttttttttcacaattcttgaacgcatgaatgattgaatgttttatgcggacgacctaggacctgcatcacctgctcgtggggttcatcataaagtgtggtttatctttttaatctctggctaaaacttgtaggtagtttttctccctatactaacttcaaatttgattattcctttttctaaatttttctaaattcatgatctatcaatttattgtgttattacaactattatttttgtcataccttaagggacttttttttcaccctgggagacgctccagttaattcacttggagttcatatgaatcagccagaagcaagcatatggtagtatgttttcaaatatgatattcctgcatcttcagacgccatgaaatatgcataaatataatattcgaaaacatacgcaggaatatgatgtgtcgttctttatactttgttagaagttgttatatttggttttcagccaagagttgtagcttatgttgaagtaaatgctatctccgtattttaatatataacgccgttgactctttttataaatgtttgactattcgtcttattcagaaaaaacttatgttattattatttattttattgtgacttgatttatcataaatatttttatatttgcacaaaaattttgaatatacgaatggtgaaacattggtaaaaagtcaacagcgttatacattaaaatatggaggtagtagatattatcaattatcttaaaaaaaggtgtgatcacttctcttaccacgaagggggccttgctcttcaaacagaacaaaaaacgggcaatttcatgtagttcatattctcatatttcgtgagattttgttatcttggatggctgggagattttattgaacaggccaaaaattttgaatacattcaaatttcttaagttaaattatcttttttcaaactgcgccaaactcatagaatttattcactattagggcgacgatcagcaacagacggcaacctccagatatagataccctcggtcgcctcatcgagctcgtcgtcctcgggcaccgactgtgactccatgccactgccgcccccactagtcaacgagccgcgggagatgccacgacgatgacgacctcatgctcaatgggatttgtcggccagacagccttgaggccgttccgccatcattctaccgaagatgagatctaggcggaggcaaggtggcggcgacctcgatggcggccctccgtcttcctcccgatggcccaacctcccacaggcaggctgtctgcttcgtcggcgccatcatcgattcgggaagcgtggagcaggagccgggaacatgaggaagtgcggactcgtcatctagatctatccatatccacagcagctgccactagtggagaaaccatctttggtcggtccaccagatttcacaatagtcccggttggtgttaccaaccggggaaaagatcaatataagctttactcccggttg

SEQ ID NO: 31095 - DNA, 1722 bp, Oryza sativa
ccccccccccccccaagtttcctccagcatcttgacgtagccacactggcagaggggagaaagaaggagagaagaagaaagaagagggagtaaaggagatagaagaaaagaaggaagagtacaggagacactgacatgtcaataccacatgacccactgtatttttttcaatttttttctaatataaattcaactgacaggtgggtcccgttggtgtttttacttttctattttccttctactgccacgtaagttgaaaaccaggtcaacagttccacataaacatcacgtcagtacaaaccaccctcaaaactactaaaggagtcaataatggatgatgttaattattgaaggggtcgatttacctagttttacggttgagggatgcgaatgagatttgacatatatttaagggagtcaaaatggacttttttcgaaaacaaattgcggcagccatggcgtcgacggaggagccagcgcatgccggagggggccgccgtatagacatgggaaggttcaacatgaaggaatgacagtagcagtgacacggccaatcatatgattttaaaaataaataaatgttaaaattacccctaactataaattagcaaaatactagtgtgccctaacaaatcaacagcccaaatcatttttactggtagaagaatactaccagtagagtaccatagcggcactcatgtgatttatagttgcagatcaagcagagttgatattcaatttaagaaaaaaaattgaaaatatatctttttcttcgttattttgcgtttatataccaatgcgatgaaattgtgaacaaatatacctttaccgtagacgggaaccgccttggtcctgcaccaccatttcgtggaaccggcggtcgcgcagaacagcattgcgggaccgatcgatcccgcagcctggaaacgcggaaccgccgcgccgtgcgctgcttccagtgaatgcatgcaacgtcaatgcatccgctgcatgtgctgcttgctttgccgcgccggtcacgcgtcgttagcgcgtgggaccgcgctggtcgcgcttatgtgtcacgcgggagcgaggcattgcgtgcgggagtgacggtgccgcgcggacgctgcacgagcgagcggcactgcctcggtcccgcatctctattctgcggtagatatatatttttacaattctttcccatgcatgtatataaaaacaaaacattaaaaataaaagtatatatttaaattttattcttcaatttaatccttgattttatttttgtgaatatataaatgctttgaaaatttagtctcgacacaggtatatatatatatatgcatgcatagggacaccccaacaaaatttattttcttgggtgaaatgagtgagaccaaaagcataattaaacattctcatgccatgaaattcggtgcgttttgaaaaaaaaaaactgagggagtacagtactctagcacacttgtatagatttgtgagttactgaaaattgagggagtgcatacctcaggatgtgctgattatatttgcatacactggtggaaaaaccatctttggtcggtcggccaaaatccataatagtcccggttgcaataaaaactgggactaaaaataatctttagtcccagttaaaaacaccacagctagtttatgatctttagtcccggttggtaacaccaaccgggactaaaaatcatctttactcctggttcatcc

SEQ ID NO: 31096 - DNA, 3625 bp, Oryza sativa
aatagcgatatttagttctggattcgtactcccggttggaaaaccgtgactatatgggggttaccaaccgggagtaaaaaagctttctgcaccagtgatacatatacataacttggatcgggtggtatcagaaatgaaaattgtgcagggtcggcgtaagtttcagaactggacggaaggcatcagcaagtcatatactcgtatagtggatctcccgttggttatttattcaccagctttaatttgatctagcatgattgcagtatcaatgtcatcttgatcgtttgatgtgactgatgagtcgattaattatatgtacacgttttgccacttcgattttgatgtaaagatttttaaaaagtatatgctggccgttctgcacgttggtatggtcattcaattattgattatattatttgatttgtatcttctctcggtttccatgttcagatatatatttcagtgaagatgactagcagcaagacagcttctgggtggttgggaagaatgtgtatgagtcttctgcatgtcataaaaggagaaactaattatatgaagtgtatatacaccatggcatggattgcagtaaaatttgttgcataaaaggagacctgagagacgactgagagccaatatttcagaactacaaattgcgttcagagttcagacaaagagagacgcatgcagcagtgcttagtatgggattggaaggtatcggtaatcaaactagtgctttcgccttcctaacagaaccctcactaaagaaagatcttagtactagctacattattggatggcattttgtaccgatttctgctaaatagatcttgtactgatttccgctgaaacataatgtcatgtggtcagaagagatcagggggttaataaaagagatgtccaagagtttattcgactagacggggatcatatgtactatgcagtgtggcatcaaaactgctccatccgttttttaacacatgacgctgttaacttgagatacgtttgatcattcgtttcattcaaaaacatcatgtaattattatttattttattatgatttgatttgtcatcaaatattctttaagaatgatttaaatatttttatatttgttaaaaaactgtcagggttatggatatcacatacccaatagtaatcgactaagcttagcggggcccaccatataccaagtcttatacagacatacctcgtatatagaagaaattctggataaggaaagacgagtagagttctatatggaaacaacagggactactctgattgtatccatattggtcttcctggttctacttggacaaggggacatctattgtgtatctatctgttgttgtgtcctctctccctactcaagctaacacacgccgccagacatcaacatcaggcataagcctagacagacctcgtatggtgcctgcggaggccgacaagagagatctagcgccatctctgatctcgatgagctcatacttcaggaggaagactaccatatcgttgactatgtgttggttatccataccgacaagtcgatgacatttagataggttatcccaattattgtatttgtgtgattcagatgaataaagaccaacaccggcttcggtcaacaggagtagggctattacctgtcagataagggtccgaacctatataaagatccttgttccatctcttttacctcagtctcgcatataccctgataccaacgatcctcataccatgcaaataccatagtcatgacctcaaacatcgacaaaaatattttaaataagaccaatagtcaaacgttgataaaaaaaatcaacggcgtcatacattaaaaaatggaggtagtattagatatatagactacaaattagatattatgccctttcacatccgatggggcattaatatttatattttcctaatgtgcactgcaaggaaaaccattttcctagacaatggcaaaatatttttcaaggcaggtagaactctcagaaccaaacgtccgcctacgaaaacagaagggaggcgggcgggtagggggggatatcgaaaatgtaccttcgcagacgtacgtggtcaccaaaaataatggtagtactatatttttttttctctattgctaatagatttcataaatcggagtctcggatcacttctagcgagtggtctagaatactataccaatgcaggtcaccacaaatatatactcgctagtaaaatgaaaattctcgtttggtgaatatgatgcacactggtactgcgagtacattttaattatttgttgctacttatttggtcttataaaatgagagctgaaacgaaggagaggaaaaaggagaatagaaagggcatgagtacagagaattggtgcctttatttattaccgtgcatatagtgaacttacaagtaagattgggaggcatgggtaataaaagaagcgctcgtctgtgggatcgaacagtttttagttaagggatgaactgtgaagccgactttgtctccaagaatttactagttttcagatttgttagtgacagagttgcctcttgtactctgtcaaagagaagcctcagtccaccaagctgaactgtacggcgcctgcgagcatcaggtgaagctgcaaaccaacgtcgctttggcaaggacagcagtagattaattagctttgcgacatggggttcttcgagtgaattaggtgttcctcctcaccaaggatgatgtcaatcgatgaataaattaattaagcatctataatgctcgttatgtcatatgtggatgtgtaactgatgtgtaaacttaatctccgtgaagtttttgggtgactacgacaaagcgagcgcaaatcggagggataagttgagtcggatgaattccgcatgaaaattaattaatctgaatgaaattaatagaatgacgcatcagcataaacaaattcagcatgaacattctctattgaaatttttggacagaattatcctgagttttcaaaaacattgcccacttgtagacatgttcactactaaaaaatggccaaaggtgccggttcctaaaaggccataggtgtcggttttccaactggcacctattggtcagcattgatactagcaaccggcacctataagaaaaatagaatcggcacctttagcattgctcgagccaaaaaaaaaaagagctggctcgaatccaagccgaactcactaagtgctatcagtgtgcatgcgcccatcccaaaatcaaattcccaaaccccaaaatcatccacaaatcgtcaccaaaataaattgacatcacagaatgaacatattcaacaacaaattcacaaaaacatgttctacaaatgacatcacagaataaacatatactagcaaccgctagccgcctcccctcttgagccgccgcctgccgcctctccacctagcggaatcggcagaggggagggcgccgccacaacccgtcgcccgccgcctgccgccttccctcccgccagatccggtggaggggagggtgctgccgccgcccgtcgcccgccacctcccctcttgcaccgccacctgccgcctcccctcctgctggaatcggcggacgggagggtgccgccgcaacccgttgcccaccgcctac

SEQ ID NO: 31097 - DNA, 12179 bp, Oryza sativa
acctatgattttacccttagtagttaagtacctgtaccaatacttcaatatttttttacatcgtgcccatcactcaagagcgttggatttttacctttttagaatgcaaacaccgtagaacttctcgatcttttttcaacttttaggccccaatctgcatttccctggggaccctaaattactagagacagccctatgcttcagctggcctagaaacatgggaatgggatgctccactcgctcataatcactatgcacaaatgcatgcaagcgtccatctaaaaatggccaaagcccaccacttgccggtccgccatgaatctatcaaagcaagatttagctgcttcataaacttaataatacccaattacccatccattcgatcatctccggttaatttcatggacacaacgacgaccatggcgcctctccctctcctcaccacgacgtctctgctgctcttcttcttcctcgcgtcgtcgttcgccgccgacgtcgtcgtcgcgggcggcggcggcggcggcggcggctacgacggcggcggcgacggcgaaggcggcggcggcggcgacggcgaaggcggcggcggcggcggcggagccaagatgccgcacgtgaaccacggcaggtacaagtgcgggccgtgggtggacgggcacgcgacgttctacggcgggcgcgacgcgtcgggcacgacggagggcggcgcgtgcgggtacaaggacgccgacgggtacggcgcgatgacggcggcggtgagccccgccctgttcgacaacggcgccgggtgcggcgcgtgctacgagctcaagggggattccgggaagaccgtcgtggtgacggccaccaaccaggcgccgccgccagtgaacgggatgaagggcgagcacttcgacctcaccatgccggcgttcctctccatcgccgaggagaagctcggcgtcgtgcccgtctcctaccgaaagtaagtactcacgtgtctatatatatgtaacgtgatatcatggatgatttacgtgctgatcgatgtcatgctcacatcgtactaacatcgtcccaaaatattgctaccctagttctcgataggacatttcaaatccagtcttattataaagttataatccactaattctaatactcaacatgtaatcatgacacctcatcatccgctagcattaattaaaaataaaacttacgcaagcatgcaacattatctataattcattgaactctacaaatcaacatccaatcatcttcactcacattattcttcacaatatttttaacatatatatatatatatatatatccattatttttataatacttaacatatatttatccatataatcaatgtgcggaatatcatatttcatctacaaatctcatacagagtctactatgtattaatctcttaccatatagtttgacaaaccaattttatttgttgttaataactaatataaattttacttttagctcgattattaaaaaaaactttaaaagctctttattaattttcgcagcaaagtgcggggaaatgttccatcggaaactagcgcttagtacctagtattatatactacctccatattttaatgtatgacaccgttgattttttgtccaacgtttaaccattcgtcttattcaaaaaatttatgtaaatattatttattttattatgacttgattcatcataaaatgttctttaatcatgacatacatattttcatatttgcacaaataatttgaataaaatgaatggtcaaacgttggtcaaaaagtcaacggcatcatacattaaaatacagtgggagggagtattgaataggtctgctacctatatttcatgctcgcatactctctccggtttcattttaattaacgttttggacaatgatatggtctacaagatacatttttgaccttatttttctattataatatatataataaataaatgcatgtttacttttattatagcattttaaaagacaaatctatatatgttcttctaattcctttaaactaaatatttttaaagttattggtggccaaagttataaaaagtttgacctcaatcttgtctaaaacgtcaactaatatggaaccggagggagtaccattttctcaacgtcatcccatgcgctagcactcgtccttgcgtaataatccctttgtattactcgatgattaatttgcacatcggtgtgcgtgcatgcagggtggcgtgcgtgaggcagggcgggataaagtacacgataacggggaacccgtcgtacaacatggtgatggtgaagaacgtgggcggcgcgggggacgtggtgaagctgacggtgaaggggaccaagcgggtgaagtggacgccgctgcagcgcagctggggccagctctggaagacggaggccaacctcaccggcgagtcgctcaccttccgggtcatgaccggcgaccaccgcaaggccacctcctggcgcgtcgccccccgcgactggacctacgacaacacctaccaggccaagaagaacttctagctgatcgatttttttcaacttatttacttataatatttttacctctccctccgttctctccctacttaattgatgaatttttggaagtgaaaactaattaacactgaatttttttcttacgaattaatcctctgcgtatttactaatttgagtttgaaagaattcgttgatagtgatatttgatggatattcatgtaagctttggaatcttaaattttgatgtactggtcgaaaatgccattagcattgcatttattctgtttttattattattattttggcttcaaagaccaatttttctgacggttccaacactgtgatggttttccctaatgtgtccacgtcagaaattgaatttttacaaacccgttgtacttatttctgttgtgccgtcagtacttatttttctttgcagaaacccacaggaaaatgaattcttcgatggacctttttctgacggcagtttctgtcggttcaccacaggaatttttctgtaacggtaaaatttatttttctaatggtccagccaaacatgctagctcgagcatgtggtctatgtctcctactctctagaattaatatatgctactgtattatgttgggcgttccgacaactataaactccctatcttattaaatatgtctatagattattgtagtaataatgggcttaaatttgtaatgatgttaatcataacatctctttagacgggtgtgtagctgatagtcacattagtatatctcacacatacatatatttgctcatcactgatatatataactttgaatgttctgaaacttagtcagatcatatgaatctaaattaaaatgaggttcatttgtaaaccgtccttcattataatgtgatttgtaaaattatatgcacgacattattacattttccttattttgttcttttatttgttgttggatcttatcaaatagatgtcaatgatctatttgtaaatattttttcccaaaggaaagtcacgtagatagagtaagagggtctatttgtaaatattttgttctttaatattgaaggtatacatagtagaattatactccctccatactcataaaggaagtcgtttaggacaatgtttaagtcaaatattgggaatataaatcataaataactctcaaattgttgagtttgaaaatataaaaattatatgaatagatttgtcttgaaaaatacttttataaaagtatacatatatcacttttcaataaatatttttatagaaacaagaaatcaaagttgtgttttggagaccgtgccgctgtcctaaacgactccctttatgagtatagagggagtattcacaacttaactattttttttcttagtaggccgaggaaacttcacaaagtattactactccctctatccaatggctcacattttttctagctattttgtcttcgtgtgaacccaaaggctattattttgttgatcatgtggctcatcctagttgatttttggaattcggatgtggtgtttaatttgatccaattaggtgtgctatgaacagaagtcaccattgatgaggaagatgaaaccagaggaaaatatatattttgttgatcatgctcgtcttggatagacgttgaggcccataaggaccgttagaatttaaacggctcgtataaagttctgcctaaatcgtcgaaatataggttaatatttggcccaacaatatgggcctcttcagcctggttcacagatagaaaccaatcgatacgggaatatattatatagcaacggtatgaataatgtgcaaagttgtttttttaattagactatgatatgtacaaattataaatttgatcgatcaatcacccaaaaagatcttaagaaaattgagatgatgtgctatttaaaagcatagagataattccaaccataggttgatcatctggaagctgagaacaattgagctgacatggttttatgaaagaaaagaaataagataggtaataaatttggaccagagattaattattcgagggctagttaataaatagaaagggagttaaaccttcgtaagtaagagagaaaattaatttgtacttctctcaaagtctcaactacttccaagtgtatgcttctttcaatgcattcatatatccaagctcaacagtatacatgctactctctgctcagatcaaacaagatctgacacaggaagagagatggagtatgcaagccaaattggtgtgtgtgctagctagttttcacatttaattttcagatgtgaactcgagcttaatttagagaattcaaagagagaagtccaagtccaagcacatatagcaaagacaaatcaataaaacatgggattaggaggcaccgagaacaaaaggagtgccatggttttctaataactttctgaattcaaatcttcctcatcagtttttcctaaaggcaacgtcacaaataatgcccttctaatgtggagtcttttccccctatgccactaaaaaagttgatgcttacctgtgtaccataaaaaagtttagagtcacatgtatgctatgagaaaaactttcgttgaccagtgtgccattccgtccaccttctgttagaacttaacggttccatagctctgacatgtgggacccatgtatgaaaattactaatttgcccttaaggattttcagctctcttctcctctcctgctatctcccgtgagtgcctgctctctccccgttgcgctgcacgccgccgcaccctaaccctagccgcacactgccgccgccgcctcgcctcgccggagccgtcgccgccgccgtgcgcccagggcagcgcgcccctgcgctaggccgtcgcgcctcctcctctcctcctctagggcccgcgcgttcccgcgtcctccctcgtcgcacggcgcgtgggcggcacgcgcggcaggtggtggttggttcgggagggcggcgtcgtcgccggtcaccgggtggtgcggcgccagggcgcagattggggcggtcaacgtaagttaggctcatggcatacaagtaactccaaaattttttgtggcacacaagtaaccagtaaattttttaatggcatagggataaaagacttttagatgtgccttcttgggaagttcactgggactacggttatctgaactgttgaatcatcaacaaactaaagtttggtgaattatgctttaccatagttttcgtatcacccacgtaataaacaggttcagaaaagaaggctaaacttcagcagaagagccatttagtgccatttttacactataatggtaaatttcacatgcagaggccaatcctaatgggccaggggatctgtggataaggcccaggtgcatggctggggatggcccagtggctgaggccccctcatccgcaccgcgcagttccatctccccacttatgttttatttttgttttctccatcgcgcgcctcatttgctctgatcggccatcgcatgtatgctcttattttattgatgtgaatcaagtttgaattgatgaatttaaaccttgtttgcatttacgtgcataaatgctttggaactttactctcaagagatatatatacagacactgaggcaggtgaaatgagtgagaccaaaatcataaacatcctcacaccgatatattttcggggttctgtatgacggttttacagttcaccagcacacatgtataggattgggagctgatctggaaatgaaaatggtgcaaattatattgagatacgtatataggattggaaggtattagagcaggtacaataatcctatgtaagcaggctataacaacaaacaagttatatttatgttgagaaaaaagagtgtgtgcgtgaagagagaagctagtgtgggcacttattttgtcgccagagctaacaccggctcccatgcatgctgtggggtccactagtgctcagcttatgtgggtgaccagctaaccttcctcccgctagtgtgaaagttgctcattcaggtaaaatataattttgatagttgtgcaaagcaataataccaactgccagatactgtataactctattgctaacgtagattgttttggagccaacaatcagctacactattgaacttgttctttgagtaggtataatagtgttgattcagccggagataacaagtcaataaccaccacatcaacattgtcatacaaggaggagggagaaaacatgagagagagagagagcagaaccagcgcttctgctagcaccggacgatagcagcaaattatacaaaatgaaatattttatttgcttcatgggtttctggttcagtttacttgatcttttatgtatatgtatactgtgtggctgcatacacagcttatttttgcgctcaagccaggatagacctagagatagagtttagtttcgatcacacgtgcgtgcaataattaaacccgttcatgcttccttaaagccaatcttttatataaacaatctgcaatgtaaactatagataatatgtactccctccgtcccaaaaaaaggcaaaccctaggtttccgtgtccaactttgattgtccatcttatataaaatttttttataattcgtattttcattgttgttagatgataaaacacgattaatattttatacgtgacttgtctttttaatttttttcataatttttttaaagaagacggacggtcaaacgttaggtacgaaaatcagggttttttttttttttttggactcggagggagtacgtacacaaccgccgactgtttgagattaaagcgatgcatacgttggtttcagaactcagtggaaggcaccatctatttatcaatcaattaattatcatggacaaccgatcgatggagcactttggcggacaccaggcctactgaccttcaatgctactgtacgaacagggtttgaaatttcggttcgaactttccggaatttcgcccccctaccggcatgccgaaatttcaaacctgactatactttggccgtacgtgccacaccaccgctttttcgtcagatatatgccgtcgtctctactgctttgctggatccggcaaacaagatctgacacaggaagagagatgcagtatgcaagccaaaggtgtgtgcgctagttttcacgtctccagatgtgagtacatcttaatttagataattcaaagagagaagaagagcattagctccagtccatgcacatagcaaagacaaatcaatcttaaacatgggattaggaggcaccgagaacaaaaggagtgccagagtttcctgctgattaattttctgaattcaaataggaggatgcattatcttggaatttacggtttgccggttctcgtcttgttttgttacacatctgcctcatcagttttcctgaaagaaacggcacacttcagaggacgtctcacgacatggttgcctttgtgaagctgctatgtgccttttttatggccgctacgctgtgatcgagaaattgcaatctagacgaactccgctgttgttcaattttgtccaaagagagatgctgagataaaaagaagtggtaaacaagatgagtgaaatagaatggtaaaaatcaacagtaacaaaagtacaaaaccaagatcgatctcctcctagccctgtctagcagtagacagagatccgtgatttggtattcagcttactaaagtatacacctcgcacaaattaaaggatatctgtttcccttgctgtttgcacacaagattacgttaatagtaaatttcaaccataataggttaatccgcaccgcaccgcagttcgatctccctcacttttgttttcctcttattttctccatcgcgcgcctgattcgtttcattgtgggtctgatcggccatcgcataaatgctcgtattttatggatgtgaaccaagtttgaattgatgaatttaaacccttgtttgcatgtgcgcgcataaacattactctcaagacatatatagatactgaggcagctgaaatgagcgagaccaaaatcataaacattctcacaccgacatatttgtagtgctctgtatgaccatagtacagacaccagcacccatacataggatgagctactggaaatgaaaatggtgcagatctcaggaaccatgcagattataattagatacatatttaggattgggaggtattagagattaaagcggtgcatacatatatttggttggtttcagaactcagtggaaggcagcatctattagacgatcatcatggtttcagaacactgctcgtctcctcactcgactccccatctcctctctccgttgccttgccgccgcccgagcaagccgccggtatgccgagcggctgcgaggacggcgaccggtggggatttcggtgcgacggaggggagcttcgggtcttgtggcgcgggagacggtgcacagggccatgggcggtggtggccgggcccgcgcctggccatgcgcggcagcggaggaggccgatagggctagtggtgtagtagtcggcggggccatgggctgcggggcgcctggccgtggctggcgagacgttggcggcagtcctatgagaggcgaaggtctagaaatccgacgaagtggaagcggatccttccggctcgcgtctagttagctatttcagactggatgacgatggatgatggtgggttaattggtggcgcacggcgtcagctcacttgaagtggatgaaaatgccttccactgagttctgaaaccaatcgcggagtatcgtagcgataacgcctatgggtggtggcgactagacgaattccactcgtcgaattcggtcgtttcaggagaggatgtcggaaagcagggatgtctcgaggtcgtagttttttcgtttattggtggtatgttcttctctttggtaagatatgagtttaagtgctcttgtattcttttggctattttcttatggatatagagatcagattaggtcctccgatggacgatgcactttggtccgattttttttcaaatgcagccccataattcatgtgagctcgcaaattcagaatttaaatatatagacatgatgctcacgtgtacactggcgtttccatccaacttctagtccaacaagctaatgggcccgtgaattgatgtacagcccaacagcccactgtcagtcaaactatgatagatggatgaaccgtaataagcaagcaaaatagggcaaatctgccgatcgctgtgctgccgttaccctcaaattttcttcgacatccatcgttcctctatttactaatccagcaaacaaatttccttgaattcagatattgttttttatgttggaaatttgatctgcataggcagtgaccggtgagtttccaaatctgaaaatcagaatatatgttggcaatcttgatttgttttgcatatagcagtggcgcatcttcacaatgggtgcatacatccccgttggtgtaaaaaccggattttataaattcccattatcttaaaaaaatcagctttacaattggtttaaaattgagctgtagaatatcgattcgattaatcccacctgggccacaacaattgctgtcaccgtcggcggtggcaccaatggcatacttctcttgccaccacagagacacaatagaatcccgatgcatatggatgcaataatgaaatgcaagattgacgattgggacatcatacacatcatcagtcatcgtaagatcggagtcaagccggtttgtagctgcagttttatcttatgataggttttttttttcattttatttggtattagaatatgttaatatttgtttaaacttgcagattggcggtcaggccaacctcattgatagaacgatccggctgttggatgtaagatagtccctagaataaaatagaaagcgggcaacaagactattcgagagcactattaatgtactgtgccttgtgtcatttctaagacctatgttatgaaggctcctatatataatggctgcaaattaataatggtcctagcttttttaggggcctgatcagattatagcttttttaggcaagatggctaaaattttagcaggatttcttatgtatttaccaaatttggcaacaaactaaacgtatatattttttagcaactttaaaaaattggtatggttgaaaatagcatcacggtgaacagacccttagtaatgaaaaatgaattggtctttctagtttctagttttgttactatgtaataataatgtgacatacttgtggtggtctctgttcagagcttgcctatttaaacacgcatggtttaaatggtgttattttgcttttgcaaataattgtaccatatttgcttcttagtgtaatatatatgtttataattaaaaaaactaaagaacttcgattggctgacgaaaaaaagagacttaatgctactgaggctgctgagtagtgtacgttatttcgttgggcattagctcacccggatttgacatgttccaacgtgcatgccgcttagaactagaaattcgaacattgttcacatcttgaattttggggctgcattaatattttagatgcaaaaatgtcggcactttggtggacgccagttctactgaccttcaattctatgtactttggccgtgccacagtctgcgagatatatatagcccgggctgacaccctgtgcctttttccttttgtttcttttgatagagtgttttttttttgttttgttatgtagcgccagacgtaaaactctgcttatctaataggcaaagcttgattgggatcctccaaagtaaattcagagtgacgtggtcactaatatgtaagcctcaccacccatgggtcaacatgtcatttgaccatatcaggtgaaaagttacgttagaggattcctctccgaaaagattatatctattttgaaagtggacctctcggttatttaccttgtgccagctacgagaaagcactactagaaaaagcattttcgctgatgttgagtatctttttttgcaggcgggtagatctctcggagccaaatggctgcctacgaaaatggcaatcagggtcaagaccttcatctgcctgcgaaaatatatttttataggcggaccacataagacgccgcctacgataatattttcatttttgcaggcggacctattaagaggcacctgcaaaaatctcattttcagaagcgcactgctaagagctccgcctgcaaaaacccgcatccaactataaaaaaattcagacttatcccactcccccaacagccactcaaatcttatcctctcctctctccctctccctctcctctcaccctccccctccctctccgagcctgcaaagaggagagctggcgatccgggcgaggaggaggtggtccggcagtggcggcggttcggcggggagggccagcaacgacggggtgacgagagatggtccggcggcgggctcggcaaggaggggtctagcggcgggggctcggcaaggcggagtgatggccgtggggtcagagcggctcggcgaggaggccgcccggcggcagctcggcgaggcaaggaaggccagaggcggctgctcggcgacgagggacggcgccgatgatgagggccggcggcagataaaccctccctccccggtgtggtcgtcccctccctcactctctcttcctctc

SEQ ID NO: 31098 - DNA, 2047 bp, Oryza sativa
ccagggtggccgcgccaagcggtgcccccgccggaggcgtaggtgggaactttctgtggctcgcgcaatcaagtcggcgccggacaaaagggcgacaagcaccaacgccgagccgtacgctgtgctctccgcgatctcccgcgggccgcaggagctgctctccttgatctccctcatcgcggcagcgctggccaaaacacccaaggggagcagcggcgagcacaccacggtcggcgcacactgagttcgagcaggtgcagtacgagccataccggtgttttgatgattgggggaaaaatgctacttctaatcttgatgagtgattctatctatgcgtggctgggcaagccgccgtcgccgcagcggcgaggtggataggagagggagggagatggagatgaggcgccgccggggatggagacgacgatgacgagagccgcgcgattctccgcgacgtcgtccggggagcctgctgaggtgcattcgtcgtcgtcgtcgtcgaggaagcgcgcggacgccctggcgaggctgcgggcggcggcggctggggtcgagcctgacgggcaccatcttcgggcggcgccgcggccacgggcacgtcgcgctgcagatggacacccgctcgccgccggtgctgctagtggagatggccgcctactcctccggcgcgctcgtcagggagatgtcctccggcctcgtctgcctcgcgctcgagtattaaggtgtggggggatgatacgatgtgagagaggggagacggaaaaacggacgggagtggcatggttccaattttagaaattttcagtggcatgtagccgatttgatgaatagtagtcactttttttttatttcgtaaagttgtagtggcatggatccaattaacccaaacaaatttgttctaatacctagcacgtttgaagtatttgtttgttatgttgttagcccgtgtggtccagaggtgttgtgttggttgaaaatttaagagtgagggaccgcttataaacctttatatgctagctccaatcattctacacctgaactaatccttttatattaagcgagtacaaaaattgtaagcgggaactatacgtatgtgaatccattaaaaatgtgtgtagagctaggctaatatggatagcgtgttaattatttattttcagcagtcggagaatctgagtggttggaattaatgaatgtgtatgtaccgcactttatgaaacaacgtgaacaaacaaagtgtacgccttgcatacggtacattctgcgtcgataaaatggaaaagattcagggtgttatataaggactacttcaggtgctaaatgttgtttgcaaattaatttggtatacatacatgtgctatatataagaatgcaacataaaaggagagttgagagagtgtgtagagagagccattcagaacaacagtcgcgttgaaagctgagacatgagagacacagcaatcgatagctagcatgcacatgatgcattgatatatatgtatatatatgtatgtatatgtatatctgtatatcggtaatcagattagtcttgtgttcttttccagctacttcactgcaacaagaggcagccctgaactatctagattgtgttggattactatgttcttggttggtttctaacaccactgacctaccctttctgcttgagttggcaccaagtcgaaacacaagtggttgaccttgtatcgatttccactcaaacaagtgtgtcgtatgcttagaagatcaagatcagggggtcggtatataaagagatatacattgaagatcacatcaccattcagcacaacaactctcagaaattcagaattaattaagccggaatccaacaagatacttgacatggcttgtaaaattaagataatttcaagtgttgcattgtgaactgttggctttcatataaggtcggatcttaatgatctgttatctaaaaaaaatagggctgctttgggttaatatgatgaacacaaatatatactccaattggctcattcactactagaaaaaatattttttatggcgttgc

SEQ ID NO: 31099 - DNA, 1425 bp, Oryza sativa
accaattaagtaattaattagagcatcatgggtgtgttttacactaatggattgacatcctccttgatgattagaatcaacagagtcactttcattctagaaggttcgtctactgttttccttccaaatgttgaagtgacatgcacaactgaaacaaaggcaaccatacagcctgaatggtaccttcggtttgctggagtacaagtggcaacttctttttttgaaaagacaagtggcaactctgttacaaggagatttaaacaccaggaattaaactcatcaagacaagcacaatggacaattcctcctgtaattaaggccccgtaggctgacccgcggcagcggctcggctaaccggcaacggcaacggtagggtgacgctaacatggtgttcgataaaatggtgacgagagacatggtggcgtggagctgagtaatctagccaaacactttctatacacatctcggcttttataggagctagcttccatttaagttggagtttagagttgagagttagaatttagagttgtgacaaacagggtctaaaaagtgtgacgatgaacgactacgaccagtgattcttttattaccaatacctcccaatcccatatgtaagttcattacagcatgctagctaagctataaaatctctctgttccctcgctgatatgaactcactggtaagttttatcttattttttttctctcttttgagccctcagctcgagctgaagttttcaatttgaggcgtagaaaagaactttaaaatgcacatcccttctcttctcctctcttttagctctcattttatctgaccaagtaccatatttatagatcttgtcaaaatgtactccctgatgaaactgtactaggttggatgtatttatttatcaacaaccatgtacttgcaactcgttgcgagacctaaaccagtactagactcgtatttaatttactacctccgtcctctaatataagtgattttgatattttgcttgcgctgtttaaccacttgtcttattcaaaaaaatttgagcaaatataaaaaacgaaaagttgtgcttaaagtactttggataataaagcaagtcacaaataaaataaataataatttcaaatttttttaataagacgaatgataaaacagtatatacaaaatgtcaaaatcccttatattagaggacggagggagtatttctttgttaacaatttaaactttcaccaggctaataatcagtataaaaaatgattctcgcaagcagccgaaattcacaagcggctggtacaaccgccagtaatcaaaggccagcgaaaatctattattttcgcttgcggttacgatccgcttcataggtggacgattaagaggaccgccagcaaaaagaaatttttgcaaaaaaaaaaaatccaaatccaaattca

SEQ ID NO: 31100 - DNA, 2222 bp, Oryza sativa
aacttcagcagaggagccattttggcttgacagcaaatttcagtcaatcatttggctgaccttgtcggatgctctgctctgtaacaaccaaaacacaaatttcgatgttataaccaggtggtgaaaacatatctatctatctatcttctattatatactaaaagtccattaaacctgctacaaacgctcctaagctgccaagtagcgctcctaaaaacactcttaggttgccacgtggcagtttataatctcacaatcgattttcatttaaattggtgggcccattagattagatctattgcttcgtcttaatattctctgtagatataggtgaaaccgtttacaccagaaaaacatacgtacgtactatggaaagaaacgatcaaacgaacccttcagcatacgtacgcacgtacgatgcatcgtaccataaatagctattaaaaatgataaaagaaagatactattcacttgaaaaaaaatacttatatatgcacgagtaaaaataataaaagctataagacctaaaaaatatataagactagaaaatatatgtacgtcggtataagaaaatagacgttttttaaaataagactttctatactataaaaaacaaaacttattactccacaaataaggtggtctagcgtttctacaattgccacatgcatggctctctacaattttgctatcaattttcatttaaaatgatggatcattattttagatcattagatttgctcatttcctcttaatttcctcggtatacaaccgaatgttctattgaaaaaaaatacaaagacaaatacatatagacgataataaacctttagatattgttcccttaaaaaagtacgtacggatacacgagtaaaaataaaagccataatactctaaaaatgtatatacgtcggtaggaaaaaatagacggtcttttaaaaatacgattatctatactataaaaataaaatttattactccacaaatattatcatgtggcgtttctgtaagcactcttagaataccacatggcactctataatttcgttgtcaattttcattcaaaatgatggatccattattttatatcattaaattagcctgcttcctattaatcgagagaaaccatttactggatgtttgattgaaaaacaaatataaagaaccatacgtacatacgataagaaagttataaagccaaaaaaatatttatcagagtacgtactacgataaaaaaagctataaaacaaaataaacatttagatatactgttcccttaagataagtatgttataaatggtctttttaaaataggatttgctatactataaaaaatataaattatcactccacaaatatggtcatgtggcgttttagcaagcactcttagaatgccatgtggtactctataattttgttgtcaaattttcattcaaaatagtggacctattattttggattatttgattagcccgcttccttttaatctcatctatacgagcgaaaccatttagcgatgttctattgaaaaaagcaaagaaacatacgaacacatgataataaagctataaagcccaaataatactaatataagttggtagaaccatcgaaaaaatatagacgattttaaaactaggattttctatacgatagaataaaatttattactccaaaaataaaaatgcaagttaaactagatcaatataaaaaaaattaaatgtgtttacacgcaattttttttgattatttttaaattttatagtcaacttataatcaggtgtattcaaatcttgataacataacatagttatattataactaaatacattatagcacctggagctgacatataataagtaatatcataatatttttttaaataatttaggcgtcatataataattaatgtcatgataatcttcgaaataatttcacatcataatttatggtcaaatatcacttaacaattatataacactaactgaaatctacatgcatgaaaaatgaaacaacattatgttttttaattatatctgatttaattttagtttgtgtgagattgagattctcaaagttttttttttatttttcataactattggattggtatgctcaggcaatgatcttgctataatacgaccccttaatctatcacaagaattatggtcatatatgtttttctttgccaaataggtttgataacaaatgaacaatcctataac

SEQ ID NO: 31101 - DNA, 2663 bp, Oryza sativa
aactatattttttgggaataactgaataactatttacatcacatccatcttctctttgtttccctagagggcaccgagcatggataccacaactatagcgtggggcacacatatggttgacttgaggcaggctcagtggaggccaccattgataatagtgctcaacttcctacttactggtgcaatcgtctttaaggatgccgatagtgaactaggattaattcaaattgtgctccacactggttgtgagactgtgagaggcacgactatgtcaacccatgcttgaaggaatcttgatggttctccccattagagggacatgtctattttttaacggtgctatcctaataaccaatagaagcattagttttagaatatttatcagtagatttagaaataagtgttggcataaacatttaggtacatagttgaaataatgttttatgtattaatgatgtattagacttattttggtggtttagatggagttccatttattaaaatcatatctatcttttaagaacaatgataataagtaatggtgataatagcaaagtttacacttacctggacaaaagtgaattttgattaaatctaagagacattcttatcatttatattaaagtctacggtctatttcacaacataattttttgttactacgaggcaaaatctataatttgttatatgtatatggtgagatatgacttaattctcttagcattatttatataaacaataaataagatgcacgcgcatctgcgcgggcttcctttctagttttattctaaaagatcgaatgaatgtggagtatgaatatgtatgttctaattatgaaaaactactagatcagggacttgtctattttttttcttcactaaagggtattcagtcaatgattcatattgtttgctaattataatatagactgctcctccatttgccatgttagcttcatactacctgtcgcaaaataagtttagctgtgagtatctatgccccatgtttgaccgtccatcttattcgaaaaaattatgaaaaaattaaaaaaatagtcacacataaagtactaattatgttttatcatctaataacaataaaaatactaatcacaagaaattttcaaataagacaaatggtcaaacgttggatataaacagtgtaaaactgcatttattttggaacggagggagtataaatttgcatagttttaactgaagaaggttaattttcggtgcttacagctggtatagtactacatgcaagtgcatgcttcatcaatacacagtacaggcatccaacctcagaagtattaagactttatttgggagcaaaagtaaaaaaacagtaacacaaattttgacaagatatcttttggcttagaccaaagtactcacaagaacagatggagagtgcggaaatgagataaaagggcaagtgaggttttgaggtctctcccacagaccacatgagagttttttcacttctacatatgtaagttactagagaacagagagttcaaaagaggacaagaaaatactctcccatgagtatttatcaataagagatccaatgcttaacatatgtgtggttacatatatgggactgggaggtttcagaaataaaattaaggagagatgaaatgaagttttgggcatcccaaaatcaaaaggtagtaaacatgaagcttatggttatgcatgatttactagcttctagctgtcagctctcggatcgacttagctattctctaatgcaacaaaccgaagaagtcaagtcgtttgtccaacattttcttgaagcttatctggtagatcgtgttcccataatataattgatattacaacacttactgataaattggctcttatcaaagggaacccttgtactttgattgtactctcgtgtaacaggaaacgttatttcaatcttttccagatgcattttcgattcggttatggaattcaaatgagataatcatttcagtaattcagaaactattaagggggcttatatgaaaagttctggcaaaatcaacttttcatctcccctacccctggtcctgatttcctgaatgtgtctcactgttgtctataaatggatgcaggtctctaacttgttgtacccgataacaaattttatttgggaaattatagatgcaaaatgttcctgtgacacaggaggaagagagattagaaggcaagcaacgttctcacacaagagagaatgtgcaatcaaaagatatgtgctagttttcatgtctccagaatttcgaaagaactttagagagctcaaaaggagaagaaaagcatttcatgaacagataacaatgtgagatggattcagtgcatgctcatggtaattttcaaggatgaacttgggattaggaggcattgggagtaaaaggagtgcaaatgatagatgaccaacttttgaattcaaacaggagtgtgcatgaatatatgtatggtttacctgtttgttctcaggttcctttataatttaacagcctcatgccttctggtgaagatttggcgttgataagggcattctcacctttggtgaagctgctctagactctaatcatatcactgcaagtgagtgcaatcaaccaaaccaattcggaaggaaaaatcagagagaaagtggtaaacaagatgagc

SEQ ID NO: 31102 - DNA, 3815 bp, Oryza sativa
gtgctcggttcactggtccaccgttcaactgttgggtcactggttgaaccgtggtttattcctaagtacattttgtgtttactctcaatcaaaatatcctagcagccaggtatcatttcattttgaaagagacatttctttttgaaagaaattgagcgcatgtaaataacctgtgactattctcggggatctgtcttggcattgtgatgtacgattcagattggcttaattgatctcagtcacatacgtcaagtgatacaattgccccgagaacacttacttcctagaaattttaattgtttagtaaatataaaatgaaatttttggtggtttcagtgaggagcaggggcggcggatacaggcatggggcagctagggcttgagccccatgcctagcttcatgatccccattataatcttgaaaaataccatgtaatttctaaaaatatttgaacgctcgttagttcagccctacgcgtgtagattttctggctccgccactggcgaggagtgaagtagcattgtcctctcaactacatgcattcaagctcaatggcacagctttatctgggagtatgtgtcagtatgctcggataaaacgagagaccagatcgagggagaagcaggaagagagataaaaaaaagggaaatgtgatctctcccacaacagtagttacgtttcttctacatgttaataattattatggatcagaaagtacttatcactcgagagaccagatgcttaacatgtgtgtagttatatatatatatatatatatatatatatatatatatatatatatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaagtagttagtaaagtagttaatgttaatacctaaataattgaaaaagtttcatactcatttgaattggttatatactcaatttcaacaatggtgcccgggcaccatggagcaccaaacaaatttaatatatatatatatatatatatatatatatatatatatatatatatatgggattgggaggtttcagtaacaaaaaggagcacaggagtgaagatttgagcttggtagcgaagaaaaggaggcagcatggagttaattgtatcgtggtgattagtagtcatcattcctctgctatctcttgtattacaacgaagcgaacacatctcgtcattggttttccctgctgcttcagtggattgttctggaacatgtcagactgacatgattgtgttttcccataattactattacaacttactgataaattaattgctgcttatcataggaaacaaaatgtatttttttctcccgtgtaatagaaaattgagacagaattgttttcagcatttgatatagtctctcccctttatttccttcttttccaaatgtattctctgttcatattaaattgagtattgtatttcgattcggttatctcaaattctaataagattgttgtttcactaatcgtgtaaatgttatgcgcttatattaaaagtttaggcacagttcactttttgcctccccaaccgttaggcaatcctccataatccagggtttctaactagggacggacccagaacgactggcccaaggcctggaacagcctacccggagaatatgactttgcatggtggttacatggtggaaaaatgtatatccccatgagcctccagtcctagacctcaggccacagtctaggtgccccgaggcttaggtccccggtctcttactcaatgtacccgacaacaaaatccttcaagaaattatatatgttgttatttccttgagaccaatcataaatatggaacttttttatttatacaatgcaattataaattcatccataatggacttaatagcttcattaatgcatgcatatatccatgctcaagtgggcatgttactttttgctcagcaagagagataagaaggcaagcaaggctctctcacacaagagaaaattaagtgtgcaatcaaaatatatgtgctagttttcacgtctcctgatgtgaagtagagcttaagagagctcaaagggagtagaaaagcacatttcatgagcacaaaccagctgtttgagatagattcagtgcatgttcatggtaattggtagggacgaatatgggattaggaggcattgagaataaaaggagtgccacgatgaaatatttcacttttgaattcaaacaggagagtgcatgaatatatataccgatgattcattgcctcccagcttactttatagtttaacagcatcatgtgctctaatcaagacttagcgctggggaagacgaactcgcctttggtgaagctgttcaagactctaatcatatcgatgcaagatataacaacttgagcaagatgatcgaccaaaccaaggaggaaacacaaagaaaaaaaagcggtaaacaagatgagcaaaatagcacagcaaattgggagtaacagatccaatctccacctagaaatagacaaaacatcactcattgattgttggtattcacctcaatgaaatgcaagtaaatttccttacagaagaatttcggagtgcagggcagctgttccaaaagtagcacatgagattaaataattaggatcaataaatcaagttggagagcaatatatgtaatatgtcctatagtgctcttcaaacatgcaagcattgcttaaagtttttgactgaaagcattgcttaaagttgacagagaagtctagtcatttgaacaaatgtttcttcaaatttttctaaggtaatttatgcttatcacaaatgtccacctgcgaaatgaaagggggttatctgtaaaatcgttttttaacaatgctcatcacatggttggctgtcagcttgctctagcacagggagacgaaggacagggtggaggggccggcgtcgcggcgacaactagggttttcatccccgagccacccatgcaaggggtacacggggggtcacgggttggatcaatagttaaaatcctcaaagtacttaacaattatgatgtagattgatgttccaccttccatgttagttggatacattcatttatttttaacaaaaacaaaatgaaattttggtgctttcaatgagagtgttgtagcattgtgctccatactacatgcatttaagctccatagtacagctttttctggcagtaaatacagtaagattagcaggatatatgttagtttgctcatataaaacgaggccattgagggagaggttggaacagagataaaaaaaaagccaaaggagagtatacagttctacatgtaaattattagggaattcagaaagttaagaggacaaagaaatactctcccatagcattttatcaatgagaaaccagatgcttaacatgcgtgcagttacacatatatgggattgagaggtttcaggaataaaactagggcatggagctaactacatcgttgagatttactggttaagagttgtcttcagactcttcagtgaagcccaacagtcctcttttgcaatgagtcgaagtcccttgctgcctgagcagggaagttttcgaaaaattgcagtgattttgttgactcatgaaacatgt

SEQ ID NO: 31103 - DNA, 3879 bp, Oryza sativa
ttttatgcgatgatagtaatgtcagtgcatgattttgtgacatttcttttgaaaagatattccgtgctatttttatgacatttatttttgaaagatattgagcgcatgtaaacaacatgtgactattccaggggacctctcatggcattgtgatgaacgattcagattggcttaatttgattattatgatgcagactgatcctcatgttgccgtgttaacttcatataaattttattgttttttatgtcagtcaattgcatcaagatgatataattgtcactagtacagaaccggacatctaaatcactccatctataacgacagacagcgacccatcacaaaggtactcacctctgatgggccggaaaaaaccccatcacagagacaccgcaggaggcacgaactgaggcctcattgctgaacccgtcaccacaagaggcactttgccgataaagatgagggttcagacccgttacggatgactagttgactggttttgtactagtgtaccatgagaacacttcaaacctagaaattttaattgtttacagaaaacaaaatgaaattttggtgcaatcagtgaggagtgcatagtagcattgtcctctcaactatttgcattcaagctcaatagaacagctttatctgggagtaaatacagtagtattgacaaggtataggtatatatatgttacagtgctcggataaaaggagagaccagatgagggagaggcaggaagagagataaaaagggcaagtgtgatcttctcccacgatagtgttcacatttcctctacatgaaaattgttagggataagaaagttgaagaggacacgaaaattaatattctcccatatgtatttttcaccgtgagaccagatgcttaacatgtgtgtagttctgtacgtagttacatatatggaattgggaggtatcaagaaacaaaaggagcattggagtgaagatttacaaactgctgcatctgaaaaagggaggcagcacagagctaactatatcgtgttgatttactagttatcattcctgtaatgtggcatagctatgatatatcctgtgcgtagtatttcatcgaagcgaagacatcacatcattagattatgctgttgcttaagcagggaaaatgcatgtgttttgggttcaacagatattattgttttggaacatgtcaggtagaattaatattgtgttttcccataattgccattacaacatactgacaaattgccgctgatcaaagggaacaaactgtattttgattgtgctcccgtgtaacagaaaattgagacagtaatgttttcagcatttgatacagtctctcccctttatttccttctgttccagatatatttctctattcatcttaaattgagtagtatatttcaattcggttatcaaattctaatgagattatcatttcattaatcacgtaaatattaggggcttctgtgaaaagtttagacaaagtcaacttttcacctcccaaatgttggggtgtgtaggatcgaatagcaagaactaagccaactagctgaggagaggtgaatggttggagtaccaaaaatcaaatttttttagcggaattaaaagttacccttgttatagatcgagatcagtctgactgaaatagaggctagctggtggtggtgctccaatctgaccacctgctgttgtttgtcgccgcctccgatctaaccgccatgagcctaccaatatgaccgggtagtagtcctcggcctgacagttgttcactcgccggtgtgaccgttgaaactcgagcaaacacaattcaaagatctctcaaagtagattgtttatttctttctactcatgtttacaagtgcaacaacagcatccgtcacataaatctcgactaaactcgaaaccctaactttactctaaactcaactctcacaaaatcgataccgagagttctcaaccccccctcccccttctatttacatccaaggtaggcagcctaaagtcacaaatccaacttgtccaagaaatcttaattcactaggaaaccttttcatacaagatacaaacttatcctaacacgattcaaactccaatcttcccaaatttaaactcctttcaaatttgactccttatctcatacacacacaatttccctatcgtgtgtgagatggaatcttcaccaaccacgtgcattgctctttagcctaatcataccacatgatatcatgatcattgggacatcatcttctcctagattgactcctaatccatcaccggccatactttctcgagacatcaagacacacctacacatgaatcaaacaagaaacaatatctgagcacaaattctttccaaatttaactcaacattagcacacagcaatattacatatgtgtagaaatcatctaaaagttataattacaagataatcacgggtattcaaataaataacccaaaacctactctaatctggagctagccggtcaaaccgtcgagctagccaatctgacaacacacaacacactagcctgaccaacctaccctgcctggtttgtatggctccacacagatagcactacttcgccaataatatccaaatatcaaaattaattatctataataccaattgttcatcacaaattaataatcaaaacaaactttgatttcacagggtgatcctgaatgctctcgatgttctccataatctagggtctctaatcagggagggacccaaaattgggctaaggcccaagcaagcccatggagaatacggccttgtatgatgattacgtggtggtaaaatgtctatcccatggtagtcctaggcctcacgccatggtcctggtggcccaaagcttaggtccactcctgtctcctacccatggtacccaacaataaaatctttcaggaaattatagttgcagttgttttcttcagactaatcgcaagtgtgattttcttttttatgtataaaatgcaattatatattcgtccgtaatggacttaatagcttcaacaacgcttgcatatatccatgctctagtagacatgttgctttgctcgggaagagagataagaaggaaagtaaagctctctcacacaagagaaagtgtgcaaccaaaatatatgtgctagttttcacgtgtctccgtatgtgaaagtagagctttaagtagagagctcacagagagcagaaaatcacatttcatgagcacaaaccagtttgagatggattcagcgcatgctcatgagtgacatgagtaattggtagggacaaacatcggattaggaggcattgagaataaaacgagtgcggtgaagaaatttgtaacttttgaattcaaacagaagagttcattatcatatatactgatgattcattagctcccagcgtactttatagtttaacatcatcatgtgttctaacttctaatcaagacttggcgatggcgatgacgaactctcctttggtgaagctgctctatagtctaatcatatcactgcaaaatagaacaagatgagcaagatgatcgaccaacccatggaggaaaaacgaagaaaaaaaaagtggtaaacaagatgagcaaaatagaacagtaaattgggagtaacagacccaatctccatctagaaatagacaaaacatcattgattgttggtattcacctcaatgaaatgcaagtaattaaatttccttacagaagaattatggagtgcaggcagttgtttcgaaagtaacatatatctgtcccgcttagtgtttgcatgtaagattaaataattacaaccaataagtcaagttggagaacaatatatgtaatatgtcctatagcgctcttcaaacatgcaggcattgcttaaagtttatgactgaaagcat

SEQ ID NO: 31104 - DNA, 5603 bp, Oryza sativa
tttggtgctctcagtaagagtgttgtatcattattctctcaacaaaatgcattctgtctcaaaaaacaaaaagaactacatgcattcaagctcaatagtacagctttttctggcagtaaataaggcaagattaacaggatatatgatagtttgctcatataaaacgagacccagattgaggcagaggttggaacagagagataaaaaggctggcctctcccacaggccaaaggaaagtatttacagctctacatgtaaatcaccaaagttaagaggacaaggaaatactcttccataagatttttatcagtgagaaagatgcttaatatgggattgagaggtttcaggaaaaaaactagggcatggagctaactataccgttgagatttgctggttaacagttgtcctcagtgaggcacagatgtcctcttttgccttgagccgaagtcccttgctgccggagtagggagttcctcaaaaaattgccgggtttttgttgattcttgaaacatgtcatgatagattgttcccataatccgtactgaaagcaaaccaattgctctcttctgtgttaaaactgagacaatactattttctaatttgatatatattttttacatttctgatggcggataggttgttggggctagttgagacaccagccccacttggaagacttgcctctaattagacaatatcaatttttttaatgaaaagatcaagaccatatctttttatataaaaggtccaattttttcatagatttattttttggatatgttaatttagctgtgaattaatgtagagaaagctttctttttcttttgatgatatgagcatttggatttcttttttttcttttgatgatatgagcatttggatttcatcgggaaatattcagttaatattgctccactcatgctatgtttttacgctagcctccctcaatttgcatcatgaattcgccattgtgcattccattgtttttcatactatgttatatttcattatcttaaaaaaatactatgcattttctgttttctgtccatataaaattgagtggtcagttatatgaaatttgaatgagagaaacatttcacgaattaatcaaatgtcaggaaagttgaggggcttgtctgcaaagtttcaggtaaggtcaacttttcgcatccccgaccgttgggagtgggcccgagtgcgtctctctcagctttccacaaacggatccgggtctctgacccggttgtacccgatatcaaattcctttcgaaattatggacgcaattgttccttgagaccaatcgcaaatttgaaaatatttatatgtatgcagtgcaagcatagattcatccgtgatagatgtgatggaatatctgagccgttcaagtaacaaactattaattgtgtttagtgtagaggattaattagcgtgtgacctgcatgcacgatcgtgatttgccaccaaatttcaccaaataattaaagtgcccaatttttttttcaatattttgtcttcacatgcataataaaaattgacagttgaaatttcccgacacacctttcatttgacttgctccaaaatatcggtgattaaattatctcctaatttcgtggacttggtcccaaacaaagacgaacggaattcttgttctcctcagtcactgcgaccaaaaacttgtcaaaattgactcaacactccaggtccaatatatagtatggcaataatcatttaccctaaatatgggaagcacctaataaataaataaataaataattgaaaccatttgagtagatgtcacgacaataaagaataaggtgcaccataaaaggaggggaaaatttgtaatttaattacactatttgtatgttgttagccactgttttgatgttgatatgttgccttcttctgccttatcaagtcacattatattgtgcacgcagtagcaacttatgaagtttacattcatgtgtacttttgtcactacatataatatgacacctattaaattccatagaaacattttcctcattaaaataatcaaattttgtcataataccacacaagctttgaacttaattatcgcaattgaacgcatcaaaaacttgaaattttttcacaaatttctccttcacacaaacaaaacttattgaccaagtgcagcaaaacttgatccatgaataacaaaatgattagaagtggaaatccttcatgaaaaaaaaacagatattcaaaattatttacaaaaaacttttatatatagagagagagttttaaaatcaattcttaaaaaatcagaatcaacctaaagtaagcttcaaaatttaaatttttgttgctactaataaaccaaaagataaattatgcgacacgctaataatacagatctatgcactttaaccattgcgatcaaacgtgccaaagtttctcaaaatgtatcctcaatattaaaaggacccatattattgacccaagaggtgcaaaacttggtccataaccaattctcacaagtggaaatccttcaaaaacaaaacaagaggtaccataacaacaaactaatcataataatccaaacacatgcagtttaccccccgaaaaaactattattcacaactcagtccctaccccccacacgtcgtcttcaacagctctcttccccttccgagcgccatcgccattcgaaaaccaagacccccctcctccccatcaaaacccagccacaatcacccggttccaccccccgatccagccctcctcgccgcgatccactctcccgggcgtcttctcctcgctcccacgatcccgccggtggatcgggccgccgtgattggtgccggttcgaggcgccgtgattggtgccggttcgaggcgatgatggccgcggcggtcgaggaggaggagatggtggagaggatgcacgggtgggcgagggacatggacgtggcgtcacgcagggccgaggaggaaggtgggttctctctctcgggcggcatttcgtagaacactctgggtgtgtgtgtgggtgggtgatttcttgatttgtttgctctgctgttcttggttgacccgtttcgggtttcagcttcattttttgggttttttatggtttagatggttgatcgaactggggagaatctcgtattgggggctctgatggttttgattttgacgtttcaacttttttttggtcagattcagtttagtatcgattcggctttttcaaattttgttggtgcgattcgggttgatgatttagttgggtggtggtgattaaaggtttcatttaatagcctcgcttgaaattgagctagtgttgagctcacagttgtgtcggtttcacgagatctttgtgtggggagaagggtttatgctttatgcctttcttggttcagactaagaagtggtagctgtaccatactggtataccttgatgtgtccagataatagtagcactatgaaaattagtatacattgatgtgtccagattataatgccactgaaaattatgtagtgatgtaatgaattatgaatcgtgttatcataattttgtggtaagcaaaaatgttgggcatgtttaggacacttcttagcagagatttttagcagtatttacagtacatctagtcagtgtgagatgatggtttactgggttgacaattgcagcaatgagacggtatgatgcggcaagttggttgcgaagcacggttggggtagtgtgtgcaagagacctgccagatgaaccgtctgaggaggaattccggcttgggctgagaaatgggattgttctttgcaatgcactgaataagatccagcctggtgccatacctaaggttgcatttttcgcattcaaattttatagattattcagaagccacaaatgctaatatgtgatgacatttctcttggcaatcttaaaatgtttccaggttgtacaagcccagtcagatgctgctggccccacggatggctcagctctgtgtgcatatcagtactttgagaatctgcggaacttccttgttgttgtagaagatttaaggcttcctacatttgaggtgtccgatttagaaaaggtaactctgtcatgctgatttggagagttcatgtcacaagccactttttcatcctagaggttcaattttctttagacaggcttcccggcttacctcatcatttgcaatactgcctttggtcacaaatatttgttgtttagaacaagtgtctggtcaaactttttaaatcaatttcttaaatatttagattggacacaattaaattatacagattttttctcaaaaagtaatttcataacattttaattttaatgggttttaaagatatttgacaatacaaattagtggtaaaatttacatttggaagattacgtcgctgtccaaaatgacatgtatctatgactagagggagaaatcttgaaatgaatgttgcatcactaatatatgagtcacttgagaaactgatgtattttatctgccaattcgaatgtagggtggcaaaggtgttcgggttgtggattgtgttcttgctttgaagtcattcagtgaaagtaataaaacagggagacaagcttcgtgtaaatatggcggcctttcaaaacctttgacagccagaaagtattttatactcaagaatactgatgcttttatgaataagataatgaaagggcactcagcagaggcaatccagagtgaattttcagaggggcaaagcatagttactgatttttctatagagtctaatgagatggtaagaactataatttggtatggtttttttgggcacaatcatgcttatacttcttaatgacctttaccttcttgtttgcagactacttcagactcccttagcattcttttgcgtaaagttctcttagataagaaaccagaggaagtcccattggtaagcctattttgcttgaagcataattgattattatgtgttgtgattgatgaacattgagaatataacaaaatactctctaatttggtcagattgttgagtcgatcctaagcaaagttattcaggaatatgagcatcgaattgcaatccagaacaaggtgtgttccgttccactataattatgataatgtttctttttttgctatttagaaaatcaggtttctccaaattacttgggttccgaagttagtaataagacttgatggtttggtgtttttgttgacctttatggttaggacatacaaactttaatttgggtaagaaaaacatctcaggttaaattcataggagattgtgtaggttctgtgtcatgttccagattatatacaccatcagaagctgaaaatgcttctagttgtgaccagatgagggtatattatttatttgagtaaatttcacatcatttattctaaatctgtggttgctacactctactcaattttttggtactttaataactgatgtttgttatggtgtatatgaagatggatgaggaggagcaaaatctcttgaatatcacggaacaggtcaaccatgtagttgtaaatggtgatggtgaagttaaacagttccaactagaggcacagacaaattttgatgtgcaacaaaaacagatccaggtattactttt

SEQ ID NO: 31105 - DNA, 648 bp, Oryza sativa
taaattaattgagaggtgtgaagatgatgggttgaccgtgtgttaacagtgaaaatggtaatcgacaaaggcgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttagaaaagtgtgtttagtgtccgataaggactttatgttttccttttatctttaggttagtttctttcttgtccgataaggacttgtatcaacccatgggtataaatatgtacacccggggtctatataatctatcttcacgatcaatacaattcggtgcattgccaccttttaccttttctactttattttatcatccggcgggacttggcacctgacgcggggctgcatcgatgttcgatctccggcgaaggggtaagtccaatgttccatcggcctaggcaattgtctcatctacgtcagcgtcgttcaagactgcatcagtacattcgacctcttggattgctctggtttggacatctaccac

SEQ ID NO: 31106 - DNA, 2038 bp, Oryza sativa
ccagagcttgctgatcaacaccacgaacaccctctgacccatgagggaccaatgcaccttagctcacacagattaaacatactggccaagaatattattcgatatgatcatagtagtagtagccgagtcaagtacagagcaaatgcttcgaacagttatttgatgaactgacttggcgagcatccggctccaccaaagaagaaatgtagcccgctgtcatatgaagaaggacggcctacttgatagcagttcaggtttgtcgttcttgtaaaaatttcgctaagattgggagacacaaatttggatgtcgatgaataaattacattcacatctgtgaagaaagcagctcttccctctccttcgtctggtgaatagccactacccatgggaggaaaaggttcacctgttgcagcacttgctacacccatccatccaatcatatttgcagctccagacaagtcagtgaagagctcccccggccagtatcccaccaattcctctccaaatagcaacacccagacatcccatatctatgaatttaatggaaaagaaattatggcagtaaacttgactattgcaacaacttaattatttgctgttgcaattaaacagttgctttagatatgaatctttgtactgtgcaatatggagcaatacttttggtagagtcagggatttaccttaaaaattgaaattattattaagtatttttttccatcgattgtggaaattggcttgagtactgctccagggactattctattgctaagctgaataaagcccgcgcaacgaagattagtacatgacttgtctttattagtctgttgcatgaaaaagaaaaacgtgacagttatttctcataaaaatgtgattcactttaatacaatttgagatggtgcttttggtaaccgatcatacccatgcaatctcgaaatgagcgtgattgtcaccgtacatatctggatcaacctgggattgaagtaagcagagttgtacattactaaatgataacaaagcatgtaaaaatgtttgtcataatttatatattgttgagacttagtagttagtacaggttgaaggtgacaacaaatgtattgcctttctcatgtgacgaaaatatattttgttttctgaaaaaacaactttaaattgttcaaattagattctttaagataataggaacttacataccagcctgcacctattcgactttgtccgttttgtattacaacaacagccccagtatatcttggtggtcttcctgtacaaagatatggttcccatactgaaatggatgactgtgaaccataaaaggtagatggttctgtttcaaccgctgccatctagaataaaacaatgaaatggggtatcagtattaaatgaagaataagcatagagaataaagtgtgaaacatgtgatgggaggtaatacaattataaaaccattgttcctacattttcatatcaattggtgtttccagtatcattgtgtcctatgttgttgtggaaatgtctggtactcatggatgacatgtagctcgttaggattggtaccgtcccatagggacactcaattttgcacatatcaatactggagatataaattttagatcctttagcatcattcgtactataagggaaagaacctggctgcatctgcataactcaaaaaaaaatccaatatgtacattaaaatcattcatgcttcttaatggcgcaaaccatgtatcatatgatgagatctataaacaacaagttaccaacaactgggtggtatgattcttcagcaaaagatgcttcaaagatgcctgtgatttgaaattaacacaggcaaaggtttgcccatctccactctaaaattcgaggatcacaccagttttgcattagaacaaactaaataataaaactagagtggtttgttagaattcaatacatacatacatacatacgtacatacatacatacatacatacatacatacatacatacatacctgaaacatcttgacgactgaatggtttacaaactcttcctttct

SEQ ID NO: 31107 - DNA, 48411 bp, Oryza sativa
  unsure (1)..(48411): unsure at all n locations
atctttcctctctttatgaaactaggttgttgttcaaatgaattattgcatatgcgttacgacaaagttggtgatcatccacacttgctggtgcgaccattctatatctatgcacgatgatggaatttcgcgaggtattgctattaacaaggtgcaagatgtaaataaaattttttccactcgtatagaactctaatataaaagaaatcaataaattttgaatcatttaaagcttttgcatcatgacgttttgcgtaataccatttggaatctataatagatccatgcgggaaaatgtaaatggattaagatttcccccaagagtttttttactgtccagcaagctggccttgtaccaaatatggtccgttgagtggccatgatcggacggctgacatagattggtacctccaggtaccatttgccctgaggtaccagccaaaggtgagtgaggtggaagggtaaatttgtattttcacattagaaatgagtcaatcgattttgatcctccgtatttggacgaggcttaattagcttttgcaattctacagcggcggtgacggtgctccacctcgacttcagcggcatcggtggtgttcaaggagctgtcttcagtgacagcagggatgttatagtgttgccttcattgtgcttcatgttctccacgatgcatgcctagtgcgtttggaaaactagatgaatactccgtcgcgttggtatggaaaattatgttgcataatacgtacaaataagatgtaatatgattatcaaaactaaaacaaattaatacaattttgatcctaaaaataattgagattgcatttttatgagagaagaaagatgaggcaatttgagccatagatctatcatacaaaggctaaaaataattagggtgatgtggcttaatgagagaagagagaaatagcattaactacacttagtggggatgaactataacaccatgaaaaatttggttttgaaatacgaaattaaaaattcggtataaccaaaaatctttttgaacttccttgcatactggaatttattggattttattttccgttttccggctatgcatgggctaaaggacgaacgtctgagaatatgcatgcattttgacttcaaatattatttattcaaagaaccatgattatgaaatatgttagtatttgcaaataccaaatattttcctgaaaacccttctctatgtaatagatcctctgtggcatattcaatttataaatagggttacatattctaagtttgaatggacaccctctatggtatagttcattaaaacggaaattattttacaaagggaatattgctttgattattgtctgagaatatgtccggtttttccccattaataaagtatttattagaaaccgtatttgtgaaatataattcctaaagggctattttaaaagaaatggccttctcaggtaagtccgttttttcccattgaaatgcatggcccagcgtgcataataggatttgttattagttgtgtgtgtttagctgttgttccaaaagatgtcaattaacccttatttgctaaaaggatgccccctatttgacgtcctttccttatcctccgcgtctgttgcattaaagcgcttcggtactaatcagacctgaagtcgtttcctttggtcgcaatgcgatatatatctctctcaaactcttaccctacgattaatttagaatcaccctatcagttcaaaactcgataatttcctcaaacacctacaactgatcgacgtatttatttattatatgttggttataatatcctcgattctattcctaccgtgacgaatcgatttgtataccacacgtcgtccctaaaattccttttgcattaccgtcgttcgttcgtgcaaagtgctcgcaaataagtcctaatgctaatcctcgcacggcctctttgccaaatcaaatccaaatatcccagtttaaacagtccaactgctgagctaagtaagttcccatctatacggaccaattatcatccaagctaaccaagcctcctacatacagtccaattatacagtccattatacggtccatttcacagtccaaattatacagagtcgaatcaagttacgaattgcctagctaattacaaagtttcctagcaaaatgtccgagtctcctgttacatttggtccacccttttttctgccagcccaactacaacacaaagtccattccaccccccctctcaaggccggcccagcccctcactagcccatgacctgccaaccaatctaagtccttttgtcctccctctcaaccctcagcccgacgcgacacagccaacacgcacgcaaggtgctctgcacaagcacaaatcctgcaaaccaggcaagccagcataccgagccgccgtcttcatcctcccccacaccttccacccgggattcacgtacaaacttgatgccggtcatcaactcgcggacgccgccacaacaacacccagtgcaccaccctcccaaaatatcggcaacccagtgagaggtgaatccacaccgaaaaatgagaaccgaaagagaatgcgtaccttgtcctccctggcggtgtcgacgatccggacctgaccgccgacgtccatcacatccaccgctgctccaagtccactgccccgctccctcgagctctagccgccgccctcgctcgcccatgccgaaagcatgaggcgagttcacggggccgccagcgcaccaccgccgatgtcaacatccggccccatcggcgccgcccatcccatctgcggccgacgctacgccgcttccttggccgtcgctcgcccatgcgccgctgctccgggttcaccgccctcgcatgtacgagctccaaccgccgcgccgtccaccgttcctcgcagtcctgtgccgtactgccgacgacgtcagccgaacagggcagtcggccccgtcggccgagtcacctctgccggccacgatggctttaaggattggtttggtttgtggtctaaattggccttgccaatatttggcaattttaacagtgtttagtattggtttgaagctaaattttggcgtgcctaaagaaataggtcatttcaatagtgaaattaggttgttttggcttcaatccaaacacaactttaccttaccaacattgaccatgtcaaaacttaccaaaatttagcattaaccaaaattgctaaggtcaatttaggtcacaaagcaaaccagccctaaaagccgtcgtttcccactgtcttcctcccttggcctccaagctccaccaccacctcttttgtcgccgtctctcctctatccgagccaccagcgccgccctgactcctcctcgttgcgccggcttttcaccccatccaccgtcaccgccgcccctcccctactcccagcaccactgctcatcctccccttcgcgccggcacgcctggttgccgtccacgacgcccgcgtctgcctcctcgtttccttacaccgcgccgacctctcccctccatccccgccactagcctccccctcccataccgccggcaacctccctcctctccatccccacagccagcatcctttccccgctaccgccggtccgcgaggctcctccggcccccttccttccctcctctgccgccgtcgcacgccgccgcaccaccatgcccagtcgtcgcccccatcgcactcgcgcgtgtggacctgagaggagtggaaggagagagagcagagaggagaaaccgatagaaagaagggagagagagaagaaaagaaaaggaagtgggacccactagtgggagccaccatctggactattcctccccgtgaccctttggccggctaaaaagtacatatgatctccctctactttattcaccaagctccgaacatcaatccttataaaagtctatgttacttcccttttctttcttggccgcgcctatcgtaagatgcaattttttttcacatattttgaaataaagtatggtatactgatttttgttttctccttgataatgatgtctctttattgaatagagtaataaagttccttccatttctcctgttcctacaaattattgtacaaattattacacccacgtaaatgtaaacacaacatatttcatgattagatcatatcggcaccattcccagtgtcacacatagtccctccttgggtcaccaccttctgctcattcctgtacacgtacctcctcgcgaagaatacgtaggacagcagtgccaccacctcgatgatgcagaggacgacgtagaacctctcgagcttgccattgttcaagttggccccatccaaccatcctccgctgccgccattgcctttaccgcctcttcgggtgacacggttggtgacctggatgagcaggctgccgagccacgccgacacgccaaggatgcagtagaagatggagctaccgatggacttcattcccatagacacctcgctgcagaagaactcgaggagccccacgaaggaggtgacgtcgaagatgccaatgaggaagaattgtggtgtcaaccaaaatacagataacgggatcccggcggtgccgtccgcgaggctgctctcatcggcggcagacttcctccttatctccaccaccgcagcgacggcggtggccatgatggtagcaatgaaaccgacgccaatccgctggaggtgggtgacaccaccgacatagccggtgagcctacggagaggtggcacgatgacgcggtcatagagaatgaggatgaccagctggaaaatgattgggatcaggaataatgtcgctggcgatatgtggacggatccgagcttggtgttcatagtgctgccttgctgcacggtgaaggtgaggatgagcggcatagggatgtagccgagaacggcagcggcgaagatgggtgccatgcgtagcaagatcttggtctcctccacctggttcacgctgcacagcgaccatgcaccagcatcattaccagtcctgactgctgctttctccaagcacctgcaagcaatgaaagattccaaccgttactcattataagttacatgtgccaactggtttgactttgtaacttatttacttacttcattttaaattacttatcctccatgtttgtcccaagttaaatttttgtatctttgaccattagtttttacaaattattgtagtctaacagcatgagcattgtatatcataaaagtactttctcttggtaaatctagaaatatatatcttatgatagtaaaatagatgagttcatagaaaatgatggtcaagcattaaaatgttttactgagaacaaaaccaataacatgtaatttgaaatcgagagaatacaaagataaactagataggcagtttatttataaaccactactgtccttacacggtgactcgctgcagctttagaaatggaatatagaaggttgtcacaagtttttattttactactggattccccgggcgttgcagaagagagtttaagaacttcaaaaaatctcgaagaaaacagttttctaaatcgtgatactcttaacgcttgaaagaacaatactttcgctctatagtagttgatttggaattgcaaacataaaatgacacatggatgcatgtataatgtatggtagggatccaatagctatttcttttctagcagatatggctcaacgtatattaacctttatttgcaactaggaaggtagcctgcgcatttgcgcgggcatgcatattattttttttttggaaatagttgtaacaaaagaagttgaaattaaagtaaggttagtttttcatttttaattgaattttcaatgtttactttttccttaagaagtctcgatcgagaaacttttattgctcataagtttatctttttaccatcttgctagccctctttttaattgatcaaatgtacatatcttatatagcgcttctttttaatatatgagaccctacatgatattttttaaaaaagacatagtcaacgtgaatcttaaaataataatttattaggaaaatataacttttaatcatattattataacaaaggctactaattttatattgccaccttagaggcctatacatacaggttgcagagaaacccatggagctactttaaaggatagaatttactgaactgatttagcattaccttcgcctcttggtgtgtttaatatgacttgtacaaagagaaatataaaaattttgaaagaataaaatattatcatgatgtaaagtgggctatgtttttctataacgaagggagtagattgattcaatactatcttacgggttaagtgctccataattagtttttatgtgtaaaagcttgaacgctacattgtgtttcaagcactccactaaaatagttatgtgcaaaaggattgcaaaaattattttcaaagaacacccatgagtctgaggcaagaggctcaccacataggaggctgcacatttgagccacatgtgaaaagaatgttcgcaaaaatcatttgtgtagttgtgatgaaaataattattcatacaattaaaaagttagaaatccctatgtgaaaataatggcacttgtgcctatattattgtttgccaacaatagttagaacttgatagttctttctggtatgtagtaaaattagctagatattttacaacttattattgtatcccgttgctaaaatgcaccagctaattattttctatatgctacatttttaatgggtaccttggtgcatgtcgccgaatcagccttcttggcgccttaacgtcgcccgcgcgcccccgcaccaccatctcccagcaccggagaggaaaggagagggaggcggtgggcggtgggcggtgggtggtgggttgtgggtggtgggcggtggggccgtgggggtttttaataacgcaattgttttctttttgcgagcggtgctctctatgtactttttgctagcaaccgccaacgaaaattcgatttaataactaaagaggtccgcttgcaaaaagacttctactttagcggtcctcttaaaccggccgctagcgaagacctatttttgctggcagtcctaagcacttcatccattgttaaaatttcgctggcggttttcacttatggccgttagagaaaaagaaagtttgacgccatgaaaaatcagttttgtagtagtgaaccgatttaagtaggaatcgatggtcgaatattttgtttttttattttctctaatttaagagtgctatgtagttaattagaaatattcgtatgatgtttagtgatctataaagagagtacggaggaagagcttgctatctagtaggttaatgtctatttatggatattttttggctcaaaaataaaaaacaataattttagttatcatggaaatataaaaaagaaaggaatagaggaagattaggttacgtacattcatgataatgccgcacataggcatggacagagggagatttttcttaagatagatctaacaatttaaaataatgggttcattatttaaatgaaaatcgatgagcgaatttctatattttattagagtgccacgtgacgactcgaaagtgtttataggataccatatggtaggttaggagcgtttgtaggaagtttaatggattataattacgctcatcggggtatctagaaacaatagtgtacatacataaatattgctaagataaatgtaatagtggaaaataattggtcgatcatatttaagttaaaatcaatgttttttttgtttttgtcttcataatttatatgattttctctaatttattaaattaaagtgtttcttggtgtcttaggagcttatttagttgtccgttattaaaacacaaagaaagtaattattaagactatagttctgcatgacaaatttctgtaattaaaatataggtaatatggatgttattttttttatagataagatacatcatatactttataaaattttaagtagtgaacaaccgaagaaaataaaggggtaacaattgatcgcttcttttccaaccgtgggtacaaatgtgcatacatgtatgttctttttttattttttctgatgaatagttttttattgttttcctttagcaaatagtgtgtaggtagattcttacgtacgtttgtatgtttgtacgtacgtgcagggatgcttgaatgtgggcctgtagggataggagagggaggtggaaaaaacaattctaatggtaattaaaaatagtgggtccagttgtttattaaagtgacacatggcgttttaggagtgtttgtaggactcccacgtggcggcttaggagcgtttgtaggaagtttcatggacttttagtatataataatagatagatagatagatagatagaagatagataactaaaataagcaagttgtaaatacacatgatattggatggttgagatcaaagcatgagaggatccaaaggctagattttttggttccaactatataggatataggatatatagattggataccatctgtctttttatggcatnnnnnnnnnnnnnnnnnnnnnnntttaacccgaaatattaagatggtgaaagaatgtgcctaattcacttatactatagcattactaacaaattaaaggaatactctgataaactagcaatgttcagagtttggccgacatacccaaatccatctgttctggggagaacttcgagggcattgttatcatcatcctggttgatttgtttcaattcgctggggtcctccggcaagcggacgtttcttttcctgaatgccgctacaaaaacctagagtacacagcttgatcgattaaataggaaaaagaacagctatgttatatagtgatatgcttcctgcttactctctgtcgtagtgtcatgcatggatgacagagtaagcaggaatcgtagtgtcatgcatggatgacagagtaagcaggaagcatatcagtattaggctttattaattgttctttttccaatttgtcatccgcattaggctttattaattgttattcaatcctctaaagttctacatacatatagcttaaatttatcacaagaatttagcgaagtttatagtttactacaacgactgaaaacttttagctcaaacgacgagaatacctgcaatattcttgtgatggggctccccgtcggcagccggttccggtagagcgggaaggcggcggcccagaccagcaacccgagcaagacgaaggcggcgcagatggcgaagccgatgccccagcccttgctgttctccacccacacgatgaagacgaggccgactaaaccgccggtggacgcggcgaaggtgtaccagttgtagaagctcacctcctgccgctgctcgtccgggtcggccgggtcgaactggtccccgcccagagccggcaggcacgccttcatcgcaccgtcgccgatcgggaccaggtacaggcccagcagcagcaggctcaggtttgcgccgcgcaccggctcgcaggtggtgctcgccgctgccgttgtggccgccgggttgcacggcggcgggtgcagcgagggggtgtacgcttgaagcgccagaacgatgtaaccctgcggcgacgaagtaaccagctatgtgtgagaactgagaagcttgttggattgtgcgtgttagtacttgattattgctgaacattcgagtgatacttgagaagctaacgggagagataagtgtttttctacaaaaatttggtacctcctcgatcgttaaaatattttttcccctaaaaagcaaggagcagttggtgcacttggttatttcgataaattatatattgttaaagaccgcatttgtatttttttcacatttctcttgtctagacaatcttgtgttaagttttgggtgcatatttgttgatacatgttacttgcaatgttctataaaacagtactctccctctttccgtagataattgttggacgtgtttaaaaaggaacttattaagacaagactttgcctattgatattgcgtataatttattgaatagtattaaaaaagctgccagaaatcttataatctaaaggagtcctaaaagttgacacatgacaaagcaaatcaaacttacaagccctaccacataacatcacatttgtgtcgccttattagtgtcggttgacaaaaactggcactgacaccggtttccagctccagtagacccgtgcagaaaacgggagaagaaaaaaccacatcagtgtcagtctttattacatgaatcggcactaaacgctaaagtgttagttatttaggtgagccgatacacaataataattattggtaccttttatactggaacaaaaaaagttgccagagccacaagagccgagacaagtttcatcttcgactagatgagaccacggtgagtcttaaaaaagaaaaatgaactccttgatgaaattataagtctcaatatcctctctatctttgtgctctcagtcgctttcctgggtcttctcccctcactgtctcctcaccagcacggtccactcacagcagtggcctcctccattgccatccgcatccatcgttcaatggcgcggcgtcctctcctcaccggtggcctgctccaccgtagagcagtgatggctatctcccaaccagtggtgagcgctctttccccactggtgagtggcagcagcaccctcttcctcttgcgcaaccattcccatggcccccgtcatcaagctcgggcagctggatccgactaacacgaacttgggtgggacgtatatatctagccaccacccgtccagaatgcaccagttccacgcttgacgatggtggcaacgacaacggtagccttgaccttcagcattgagcagtggtgttcttaattatgtgatgccttatttgatactgtagatgtggataatgatgtgttgttgattctgtggttgtcttttttgttggtttgttttgattcttctagatggggtatggatatgttattaacttgtgatgttcttgaatgttgatgtggttcttggggagagggaggggtggagttcgattgatcggctagattcgagctgatgcgtcgagccaacaatttcttttttttattacttccataaccctatcaatgccatctctcacatccggcatacactactacaaaaatggacacacaggtcagcactataggtgccggaaatgctaaaaccggcatctatggtacttttcccacctaaaatgtgcatccattggatacaatcggctagaaccagcacctttgtggagagataggtgtcggttctaaataaaaacggatacatatagtattagtgtcggttttttaagaataaccgatatcgttaatatccattagtgtcggatacatctagcaagaaaaccggatgaaaccaatggaaccgaattccacgagttctcattccgtctctctctctctccctttttattaccccctcactctctctctcccttatcctccgctctcttgttcactccgcctcctcccctctccccctctctcttcctctctcagctctctctctcgctccctctctctctccaccacaccacccgatggtgggaggggaggcggttgcgccatcccctccgccagatccaacggaagaggaggtgacggcggcctggtggctcggcggcggtggcggcaccctcctctctaccaaatatggcgggaggggaggaggtggaggtccggcgcccttccctccactagatttggtagaagtgtaggcagcctggtaccagcaccctcccctcccctctccttgcttgtctcattgatgttcttgtgttcttagagttcttccattttcttcgactaaatgtaattaagagtgtgataaaatctagttggggtgaagggctattgcttgatgcatgggctcgaatcgagctgaggcgttaagccagcctcttttttaattcctaggacctcaaaggtgtcacttcctaaaccggcacctttgagaaaactcgaaggtgccgcctactaggtgccggttgcgaaaccaggcatccatgtgggtttggcaactggcacctaaagacttttttatagtagtgatatatgaactcaactcatcagtgccagaatcccagtgccagttggggacctagcttggagagccactttgaaaaaaaaataaagacaagaacaagtgatttaatctgaagttctttacaaacttcctccgccaattttaagtgtaattgttggcttctgtgtcaaacatttgactattcatcttatttgaaattttttatgattagtatttttgttgttattagatgacaaaacatgaatagtactttatgagtggctttttttttaattttttcataaatttttcaaataagacggacggttaaagttagacacggaaactcacaactgctcctagaatgagagagagagagagagggagtgcatgcatattaaataaatagactatagtactcacacgacaaataattgattaataggcttgatgaatgactggtgttagattgacagatggtactacccgataccaatatggtcgattgcactaaatatttatagtacttccactactacaaagaggcacatacaaatctgcactataggtgccggaatagttaaaaccagcacctatagtgtttttcccatctccacggactgaaaacagaaaaaaaccaacacctttaagagactatagatgctggtttttgagaaaaacagtcacctatactaaaagtgtcggttcctataattcagtataggtgttggttttaaaaaaaccgacatcttataaaccgagccaagccacatggagatgcggaagatatttgtagccgtccacacacgctatctctcctcctccacaatgttatcttcccatctctttctgctccttctcctccccaaccttatcttcttcttccccctcctctctcatggctacggtgccctccttctcctcccctcctcctctcacacgctcggcggcgctctcctcacgtctctcggcggcagcctcctcctcgcaacgccatggcggtggcgccctcccggcgaggaggcggtggcggtcctccccgccactagatctgatggtccggcgagaggaggcggtggcccgacgacgacacaacggcgaactcccctccgccagatccggtgggtggggaggtggtgggtggcggcggcttaccgagagcggcctccccacctagcggtggcagccgacagtggaggcagcagcggagcctcccctccaccaaatctggccggacttggcgacggcctggtggaggcgaatgggagcgaaagcgacaacggtggcttggtagcggatgcagcggcggcggcacagcagtggatgttcatgcttgttcttgtgtgttcatcttgtgttcatgtgtgttcatcttgtgttcttaatgttgatgtgtgttcttagatgtttatgttgtgttcgtcagtgccgccttcgtggtgtcggttgggacctaagggggtttcccaaccggcatcaattaagatttctgttgtagtgttcacttgtcacagtcacctagggtggacatccttgattgacgtgataaatactatatctgagactaattttctaaagttttgcaagaaactgttcataatattataagagtagaacttgcaaaactacaaatattccagcaaactatcacaaaatatatatttaagagtatatatgtatcacaaaattacagaatttacattaaatatatcacaaaactatatatttgttgcatcgtatcataaatctatagatttactgacaatgttatcaaataactacaaattttagagtttagaattcatatcagtattgcttttccaaagttacaaaagatgttattttgtgacacaatgtcttaaatctgtagtttcatcaaataatttatgctaactctgttttgtgatagattgatcaaaatatatgtagttttgtgaaatttacgcacattataattgcgccttgagttaaaataatagacaatatcatcttaaaaaacatcaaacgtgatatatgcaaaaagagaaaaaacgaataattaacatactatgatctcgatgggagccaagaggatgacggtgtagaatcgtttgacgtatgagtcagctaggagggccgccgggatggagaacacctgcaacgcggcgaacaagttggtcaccgtcgtcgtcgcctccgcgacacccatgtgcatggtggcccggaggtagctcaccatgttcaagacgttggcgatgttgggcgcgttggtcaggagcaccatcgctgcatgcattaacatctgatcatatccatgattcgttatcaacttcagcatctgagagcgttctgatacatgagttgtattaagttttaattcggtccagaactgaattttgaattgtagcacagaggtttagatacgtcaaaattcgggattggaataaacttggcttgcttgtaagaaaaaaaagtttggttatcttgcaaattgagcatagcttaaccgattaatttccttatggtggaagcaactcatccgaatctgaattcaagttgcagacttcataatggcgctcgtatttatagttaattatgttttcagtcgtaggtgatgtacccgtcaacaactagttttgtacggaccgggtaatatcaatatataccggtctattttgtgcgcatgttgtgagcgcctaagtttatattgcgtttgttagaaaaagtttgattgtctttatcctatagcgagttaaaatttatactagcactatatttcaaggtagatgtggacccaaggtgaaaaaaacaagcttatctttgttgaccagtaaatgtgtgtattctacttcctttatcttaaaataagttaatccaaattcatattaaaaaataaacttattatagaacgtaatagtaggaaccaaggttaagggattctaaccaaatggtccaaaattcgtccatttcggtaaggatcgagactaaatttcgcccatactttatgtttgctgaattttggtttaaatttggtaataattaatttctcacatttttttaatttcattcattttggtcccaaaatttttatacaatcgaatctgagaacactggtagaagctagccatgaacagaagccatcaagccaacaactcagtgacgagcaaagctgcaaaggagagacatagtactaaaaaaacagtagtacataatcatgcttagctcaccatggatgaaaatggatgctcttacacctccatgcttccgggtgtccaccggcctccccctccaatccactagccctgatgagctgctcatcacctctgtctgtctctcttcctctatctgaaacctggaaatgttctacgtgatctgagctgactgactgtatttgcagttgcagccatatatataaatttctgtctggctagtggcgattgatggacgcttgtaatatataaagggtgggtgttgtagtagaacattctccatgtggtagaacattctgcatgtactctaaaccttatagttcgcaataaatgtagtccttacacaaggtagtacagtactacacctgccagcaataaataaaaatatcattgattattttaccctatcacatcgaatatttggacacatatataaaggattaaatatagaaaataactaattatacaaattgcgtgtaaattgcgagacgaatcttttaagtataattgctccatgatttgataatgtggtggtatagtaaatatttgctaataacggattaattagacttaataaattcgtctcgcagtttataggcagattctgtaatttgttttgttattagactatgtttaatacttcaaatgtatgtccgtatatccgatgtgatacggcataaattttcacccctggatttaaatacagccttagctatgtattcattctctcctctctacccaaactattgcatattatttggtttttatatgctcttaggatctacttattgtctcctacacattgtgaaattttaacaatagtagtatattgcgtgtgcgttgtaaagggattttagttaaataaaattatcacttcccactattgctattatttttcatacgtaatctgttatttatacatatatttattactgacatgtatggctgtatgccctggaccttcacaccatctttcttctcacaaaaccacatatcctttctctgcttgaaaaggaagtaagggagtgatagacgtactgaggaattctttatctcaccaacaccgctatttcttttcaaataagtatagaataatagaaatacctatatggcaccctttggtaaggattgctgatgccggtggtgatggcgtgatcaagccgctgaagaaaaatgaggaggctgtgtccaatggagaaatagggcaggtgagtaggtgaccaggacatatgcagagtgcgtgagaatgtgaaaggacattgaggtgacactaaataaaaattgaactgtcccgcgagataacaaatggcagtacgtttaattgttactgaggtgaagtacgatgatctctgtgcgtgatttgaaaggaaattttcgtttgacaaaaaaatgcttctatttgtacattactgtgtaataaatgagacgtaactgtccacaatttaattgtaagtaaaaaaaatttttcttgacggaaaaactgtacaggaggtcctgcaggggtctggatcccatggagttcactccaactccaccgggtggatttgatagaatctctacggtctcttttttttatcaacggttgagacgaagccattagttcccacttcctactagtctcttttgaaaaaaaaaagaattcctcctaatcttgtaacaataacaaatcaccgtctacaatatagttagacattagagaatatacaggctaattttacttgcataacccagaaattctttgattaatccatggtgtaaacaccgtactgagcatgtgcctctatttttgcatgtatatggtttatgtgtgtttgcatgtactatgtggttaacacttttttttacatgaacatagcttcctgtgtttgggaaagaagagaacatgtatactttgttaatttggtaggcagaaacttaaccattactaacataataaaaaaataaagtaattcccattcaaaccataggaagcagtagatgccatggatttgataaaattcatccggtggagttgtactcaactctatgggatctgtacccgtcatgcatatatatatatatatatatatatatatatatatatatatatatatatatatatatatatatatatatatatatatatatacataattcctctctataataaaatataactgcagttatatttataactagacgataacccgcgctttgctgcgggatataggttagatattggaaaaatgatgaaatgattgggattgaaatattatgaaaataatttgagaatgatgatttagcatgtgtatgtttaattttagaataaaataaaataaagtgtaaatataattactataggcttgcatgttgagttttatgtgcttaatgggttgacgtggcatacttgtttatatgttttaggagtgctaataaatactatgcttgcatgttgagctttagatgtttagtgggcattaggtttatagaaagaagagactcctctttataatataaactagtgcatgtctttctttccaatagctaaggggtacgaaaaagcttaactattatcgctctaggttctattggctgagtaatggtcaaaaacaaaagtattgcctcgccagatgggacattctttgccgctcaaaagaccatggggtttaggaattcatgatctggaacttaaaaatatagctttgtttagtaagtggctatataggttgcttactatggatggagtttggcaacagctaatacataataagtatttgggttcacaacctctttctcaagttcagtggaaaactaggaacttatgttttttgctagcctaataaaggtgaaaaaagactttttttttccgtttcgaatcctttacaattaaagatggctctcaaattagattctggaaagacaaatggtttggagatgcaactcttcaagaacagtacccgagccttacaatatttttagacataaataaagtactattctagaggtctttcaatctggcgctcgaatctttttatggtgaagggattcaattggttcagaattagtagcttggaataacttattacctcggattgctaattttgaactaagccaggcgcaacatgagttcctatggaatttaacccatagtgggaagtttacagtaaaaactcactacttggcataagttcctatggaatttaacccatagtgggaagtttacagtaaaaactcactacttggcatgagttcctatggaatttaacccatagtgggaagtttacagtaaaaactcactacttggcagtggtccatagtgatgtccagaatataaattgacacctctagaaattgaaggtgccactcaaagtcaagatttttgtttggtaccttcatcgtggagttatgctaaccaaggacaatctacctaaacgtaactggcaaagcaatcaaaaatgttattttgtcataacatggagacaattaaacacacatgctttgaatgtcattttgctaacttagtttggtcgatcacttatgttgcgtcaagaattactgcaccacataatatttcacacaggtttactaaatggctttcaggtgttcaaaaatatttacagccgtatgtttctctgttaggggcggctgctatttgttggtcgcactggttatgcataaatgatatggtttttgacaaaaaaaattatttcttctcctgtgcgggtagtctatttaattatctattggctgcgcacttgggttatactacaaaaaccgggttcgcaagatttggttactacggtgtgtctattcttagagcaggcagttacggaattttttacccaaggggatgggtagcgatctagttttaagattgatggccataatacttcctgtaatttattttcttataaatggtgtgtgtcctagttatgcaacatccaaaagtgtgcttagtgcttttgtattatcctggtgtattggctgagttcaataaaagctttcattatttaaaaatatatttataggaggaacaagaaagaaaatgtaattaagggttaacttgattaattgacactagttttattaaggttaatttttaaccgcttgtgcgttttctcagagaagtatatataaattcttaaaaatatgttataactgtttgtctttttacgttatgttataatataagtgaaatgtctatagacaacaatagtagctattagggaatcgatgtagtaatgagcttatctctactactataaaaatattgaagatgtttccgctataattttgacgtcatccatgtttcaattggttttagttttatgtttcggttttaattttagattatccatgaaaatatgtcgacaagaaactaccattagaatttgttgtcaatgatgccgccagtaatatcttctccacaaaatagtttttgtgcagtttttgtgcatcttctctcactccacaaaatcatatcactatcattgactcaaggttttggttttgttagatgacaccccgtgtgctgcagtgagaccttgtaagtttacaatcaaaattataaaccaagagaaggatacatatataaatgggaaagtcatgatttaaagcaaagcgaatagttacgtcacaaattttgacaatttgactctttctgaaaactaatttcggaaatgaaccgtggccaaaacttatttaaaaaataatccttttgttcagtgccaaatcgtatggcgttgaacttagacacctcagcgccacgtcaactagcactgaatgttgtgccaccgtggatgggaggttgagtcggcgtgccaacgtgcattcagcgtcgtgctatttggcgctgacatgtgtaagtttagcgccatacgatttggcgttgaacaaaaggatcatttttaaaataagtgttgtccacagtttatttgcgaaattagttttcgaaaagagtcaaattgttaaatttagtgatagttacggagcccgatgtctagcatgtgctatccgtgcaagagcctgtgggcttgtcctttctccatgcgatagatatgcacgctgcttttttcgtgtgcaatactgattccgtgtgcaatgcttttgtgcacatcccgtactgcaacgcgcacttgttggtctaggtggttaggatcagacctctaggtatggttgtaaaggttagactagcctatggataagatatgagagagcttccctcctaaccagacttctagcaggttaggttaatgtcaaagcaggatgctcttctagcaggaaagtacgacactcactcttgatagttcggctagggtgatggttccaacctcatgttccaatcacacaaatataatgtagacaggtggtttacataggtttgggtcattcggaagcgtaatacaatgtgtatgcatgttgggtggatgttattctagatgagtgatgatgaacccttgcttcttcgcagttttttttagatctaacttatgctaacaggactaaatgtaattagttgaatcaaaccctctttttagtggcattggtcttccttctatatgccaacgtgataacacagtgcatacaagtgtatatgtgatattcagtcttgtcattgtccttctatggggaccggctggatgtgacgggttcactaatgggctgacatgtagaatacggtggctgaagtcttcgttccaactgttaatgggcccaccgggctgtcaccgatgctagggggagtgtaacgtgttagaataaatgggctaggcccgatttttctattaaaatcttaagggcccataataaatgtgaaggatagtaataccacccaaggaattaaaagtggagtacctcaacttaaatagggagttattggaggctccctattgaccggttaaggtggggatcgaaaagccacatgcgtgcgcgagcgcgccgagccgagccggcgggccgaggcgagggcgtgggcaaggcgtgccgtgccgtgcgttgcgttctctacatgatgatgatgcttattctattttaagcatgctcctggttatgtttaattttatcactagatcacctaacattgttcatgtcatgattattgtcttaatattttagattataatatgtcgatatatgactatatttctaacataacgccccgatttttgcctggtcgaaaaatctattttattaaataaccatgttcaaaagttttgttctttgagtgtatataggtttgtgtgtcaaagatatcaagtatttcattccttgtaaactcaaagtcttagccaaatcttttccttctaaattaaactctcaggattcgtattttgaggttcaagctctcctctcaatccttctcaaaaatatattcaaaccctcgtctttggttgtccggtctactctttacaatttcatacatctcaaatatcaagacctcagtcaaatacttgtgaattgaaattccaaatttgaattcaaatattgtccaaagcctcaaaatatctctccaataatttcccttccaatccagagattcgaacaatatttgtttttggaatcctaccgctgacaaatatttcctatgcagttgcatatcaaaaccgacagtcgtttctcccgtcgaatttaatcgggcacaatggaaccagcaaaaggcgagtttttcctccaatcatcctctcccaaacaaaatccccatgttcgaattctggaatccgaatcgcgtcctaaatcatccctcattttttctttcctttgtaactctttttcttcaagctgtactcgttcaaaaattccaaacaaatagccaaagttcatagtgcagtgacagtccttttgcaagctcaaaattgtctacaaccctcgggcaaaatgacaacagacaggcataagtgcccgcttttattttccacaatgcagcaagcaaagccaaaatatgcacacatagagtttttttccttttcttgtccctaggtattattctgctgctatatttaatgaaaagtcacagtctcgtgctgcttccccttaaaaaaatgcacgcttactccactgctcattttgtttgatgcctggaccgaaccttgctgctttcgtctctcagcaaagctcggcgtccacgccaagcaaccgatgttgtccactgaatgcgctccagtgcgccatggcacagcgacgagttcgtctgtgtcacttgtgcacaccgaaaggtgtaagccgagctcacccatgccgcaccgaccctaccactcgtgtgccaatctgcccatggcatcagccgaacagggcagctggcctcacttggccgagctcgctacaaaagcgcctgttcccaccatcttcctcccttagaatacaagctgtaccaccatgcctactatcgccacctcttcttggccttagccgcccgatgcttgccagccatgagcagagcgctgcccatttgagcccccgaactgcacccatccgcctccctagccgaagcgccgtgccgacctcctcttggcgccgcaacccggccagagccaccggcgcacccaacctcctcttgctcccccggcaatgctcccttcctcccctcctcttcccaaagctgtcatgactcctgccctctacactgctcagttcgtgcagccactggcaccttcccctctctcgggcacgcgtgcaaaagaagcagaggagagaagaaaagagaaggaagaagcagagaaaagataaggaagaaggaaaataaaagaaaaagggaaagaaagataaggggtggaacccagcagtggggccaagtctcttgactcctctccgtgggcccacttggcttgaaaactttgcaaaagtccatatctctttgttcctcgggcgaagcccaagaaattgatttccgtataaaagtctgtactatctccttcactcaaaacttttggctgaagcccaccagcctagcctcatctccaccaagtccactttcctccctctgagcctcacaaccaaggaatattttcatggaaatatttctttccaatttaataaatccttttccaaattctagaaaatccattaaccttccaaaattcatatctcttcaaccgattttggatggctttcactttttttaatcacgtgtcggacgtttaggagatgcatggacgctggtttttctcgaaggtttgaagaccaatagctaatgcaatccactcttcgatcatattactcctactttataaatgtattgtttgcaagattgcatgcctagtgtacaccgttaatttgatcggccatcaatctactagcatatgatggatggaccaacctaaataactactacagaaaaggtaaaaggtgccggtccagaaaccctaataagtgccagttttctgaaccggcacaacggagacagcacggatgatacttgtcatcggtgccagttctagaactggtgccggtgtttgaggtcaaaaccggcacctatatggtcctaataggtgccggttggcaataaaaaaccgacacctatattttgggtaaaaaaaaattacagaaaattcatccatacaacccgaattccatacaaacccaaattcatccctacagccctacatccatattcacaatcctccttcattcacattcatattcacattcacattcaaaacaaataaaaccctataaacctaagtctaaaaattcgtaagaccaaaatttcctatctttaaatcctaaacattggcatatatatcttaactcaaaatatgctaagtttaaaatacctaaatcgaaagattgtaagtctaaaaattattgcactcctagtgctgcaatcagtatacttgtgtaccgcattttgttctattgcactcgtagcatgtccactttgtcagctgtgtgcttcaaaatcttaggtgatggcatttgcagaaaataaacatgaagcagcatggccatgtgtagatataagtaaaataagggcaacagatgatatactatacagcaaatgaaagcacacactatcagcaataatttgcttctgtagaacagaaataacatatttcagaaaaatataggtattgtagtgccagctaattaagatgagttaattaggatgttgatggtactaataatgacatacatggtaatgtctaagttgattctcaaatgttttcatgaccaaaggctgacagtgttgtattggcacccaaagttcttactcttagttttagttttgtaccatccttaggcatttcaatatcttgccagtaatttatctgcacaaaattggaaagcataaaagaaaatgcaaacaaagagcatcaaatagtacactcaattatcacataacctcatctactcacagaattagttccacattcagcctataaaagctcgccctatgtttttttcccaaagacatggtcttctaattatatcctctggccatccataagaatctacaaacgacataatacttttcatgcataaacattcatgattagtgttcaacagttcagtagccaccaaatcccagtgtactactgaatccagattcagtttccttttaaataaactgatgatatctatgtgcacgaaggtaatcaagaggtctgatgacaaacaaaacagcaacatctactgctagcctatctaaactacaggagaacacattgccaaatactttttgtacataaacacattcatgtcgagtattcacctatttggaagtcaactgtagatggtcgaccacctaaaagaatgaagcaaacaaatttatggatctcaataactaaagatgcataattaaagatcaaatctgaataatccaataaatcagcaaatgaacgcaggcactacttaatacttgtcagaggatgcttcaaatgtaacagaaagagcagtaattagtttagcatgaatatgtaatcaacaattaagcaaaaaaaggcatataattaatttaggtcattcaccagaaaaatattttctgcagaaaaactgaattcagttgagtattaagcttaatatttctagtttaatcctataaaaatatttctagtttctaacaatttctcagagcttagcacctgtcaatatcacttagcacacaaaaacaacatctgcctgcgagtattaagtcaacataatagaaataagcttgcaacctttctggaatgtcaactgataccaaaacgataccaacaatatcaccgttttttcaatcagcaattcagcaccataacaccaggcctaatcaagcatttctcatgtgcatcttcaattaatctacagataaaaatctgcagatcaccattgttcatttttccctaggctgctctttgtcctaagatgcaatacaacaaacaggtggagtgcagcgtaggtgatagggaaatgatttactgccaagagatgggagaagaatgcatacctgtataccgcttgtcatcagccatgtccaaatccgctagcttggcgatttgtccctgcagctcttcaagcaagaaccactcctttccatctatggagtatgataggtgatcaaaatccaaagctcccaaactagccgccatgaacaatcgagaaatggaactgggaaacgaatggtggagctccgcctcagccaacaacgacctagagggcgctacgccgccgagggtgaggagggggagggtgcgagggtgagattcgttgccaccgccgtcgccgctgccgccgcacagagagagaaggagagagtgaatggataagggagagagagtgaagggataagtgagggtatttaagtaaaggacataggtgccggttctaacactttgtgtggcatgaaaagctctattggaacaaatgtgccagttctagacaaaaaccagcaccttcgttttgtcatacaataaccgacacctatgtgtggggcccaccaatggctagtatgggagggagaatattaaaggtgccggttttgggtcgagaaccaacacctttatcttgtcgaaccaagaactagtacctttatgtaggacccaccgttggatataaaaagcactattgaaacaaaggtgccggttttgggttgagaatcggcacctttgtcttaaaaccggcacctatgtgtggggagaagattaaaggttccggttttgggtctagaacaggcacctttatctgacacaggttttaggcgtaggttttatttaaaaaccggcacctatttagatataaaggtgtcggttttttaatatgtggcgcgtgggggtgggtgcatgggcggggatggcattatatgtgtcggtttttgttgtgttggcacctatttgccttttttagtagtagttgcattactttctataggatattatcaaacttgaccttgtcactccaccatagcagtaccccgacgcaagtgtctccatttaacacatgattatgcttgattatcaagttggaaaaacttgggttgtgaaaggtttctaaaacctgactcggtgcttttgaaaataaaaagtcttatggataaaacttgtggtgcgaatcctctcctgtgtggtttggtttcgtagctatgcacaagggctgattcttttgtgttttacatccgggcatggtacaatatgatgaggacacaactagctcggatataaccatgactatcttatgtattaatcaaccaatggtgcatatattctacattagatttacatgttatgtatttgaacaaacgttgctacacaatgagttttctgtgtttttatttgcagaggtacttgcttgggcgaaggaaaacagactgagcgtaacgaattcatggatgatcaaagaagttgattggggaccatatcaagaccttctccaagtccactttcatttcatcacatcacttttagtgcatagaagacaagagataaagttctacacattttagattcggattcgggcctcctgacagcatcaatttcaaacggacctaaccgcagatctagaaggaatttcggggcccatgattacttgttggaaagcttatggagtctactttcatatggttttggtcccacgtcaaaattcctaccgagctgccgggaatctgcaaaacaagacacgtatctcatccagtccgaatctgactcgggttttgggccttaaaattgtgtcgtgagcttagcccaagggggtgtgcaccctagggcaaccctaggacgtccctaatcatactaattcagtagccgtcatcgtttagagttcggttttgcttagattattctgtcaagaacagtttcgccgctagatcggtttgtggaaccccaaattcgagtgcttaatcattcatatgcaatttggttgcaatatatcttgttcttgcttgtgttcttcgattcgcatgcagggattagccttctcggcgaggttaaccgggtttcggcacggttgataactagaggagacgtggtgctgcgattgcggggcgcagtagcgtgttcgtccagaagccggatcgagttgtgtcgcaactccgcccaaatcgaccgtttatcaatacctatcggaagttcgggactacatccctcattagttggtatcagagcgtggttgcccgttaggtagttttcttcccatgactagaaaattgccacacaaaaatgtttattctttacctagacaatttgagcagttgcattgttctattagattttgctttgttgaattctaaattgcatcgtcgtgtcaagtgttggtttagttttagatttaattttttagttttgagtattgcatatgttcattactttgggtctagggtatatcaagttgtgagttgtacgtcagttttggatctagttttgcatcttgacggttgttgccgggaccttgaaaaatcgattctactcatcacagagtttccgtttttatagttttcacaaattttcgttggtcagttgcgaagttgcacaaagtcgcatttagggtttgagtgtcggcctttgatgttgccgtgaagaaaaaaaaatagtaacagatcggtttccatgtaatagaccgacctgagtccttttccgggtccacctcaagatcgagtcccacactgttgctactgcgagaaatcaagtaatatctccacatcagaagccctgccgagacaccttagtggaaaagaaaaagaaaattcctttagtggatttgagatatttttataaaaacggaacgtacgtgatgtgagcattccatttttgaggtgatctaattttagttttgcactttgcatttgagtccctgttcaaggtaagtggtcagttcttgttgaaaaaaaatagtaaaaaaataataaaaaagaaaaggtagaaaggtgcaaagaaaaagaaagaaaaagccgcacaaaaaaaagaaaaaaaagacagaaaggtgcttaaaaaaagccgcaccaagaaataaaaaaaatcattcatcctttgagtatgttttcagagtgcagagttgtgcattgattcatatatagtccttagtgttgtcagttgcttgcttgagctagagttgagtctaggctaggccagcacattgactagtactttgaactattattcaacttttcattttctcattagcacaattgcgtctctttgctactatatattgtgcctcccaagctacacatatatacttctggtcagcaccgctttgatccttgcaatcgccacatcacgtccttcaaggtgtcatgaacccgccaccagttgtaccgtccttagcattgctggtaagacacttgtaagagcttggtaaggtgcttcatttggctgagttgttgaggggcaccactacatcgcgtagtagattattagggataaccttcattgtttgttgttatttttatgtttgcaatgacaggtatgagtggcgctcgaaatcagcgataccaacaaggtgcacgtgatgacagtactttggtgcaacaagtgctaagttctcaaatggagaaagcagagcaatggcagtatcacgaattatttaaaacaaagtttgtggttaaagatagagcatgtcgtactataatcgatagtgagagttgcaataacttggtgagttcagatttggttgagaaacttgagttgcctacacaaccgcatcctcatccatattacatggaatggttcaactcttgtggtaagttcaaagtaaatagaattgtgaagctaaacttttcgattggaaattaccatgatactgccaattttgatcttgtccctatgcaagcatgttctttgttgtttggtcaaccatgggtatatgataataatggatcgcataattttgttgctaatacatacacatttagacataatggtcagaaaataaaattggtacccatgagttttactgaaattttcgaagataatcttgaaaggatgaagaatggaatcgaggaaattttcaaagatagtattgaaaggacgaaaaatagaatcgttgagattttcagagataccaggaaagatactaatattacgatgccttcaacatagtctgagttattacaaaatgaacgtattgttgtgcctattgctttggatactaatattttgcaggcatttgagaacaaccaaggtaatgaggaagagaagaaagacgaagaggaagatgagaaagaaggtaatgataatggtgctatagctattcaaggtatccatatttatgatgtgccaactatgtccactacttatgctacgttagagcaacccatagtgaaaacaattgttgaaatacctttgtcacaaaacaatttgcttgatgtttctagtgataaagaagagttgtgcgatgtttcacttatatccatgccataactagtgaatgaacatgttaattctatactagaaccactatgtgttgagtttcaacatgttattcacattgctagcgagaatgaagagcttaaattgctatcttctttaaatacttggggtcatattcaatttgatgatctttgtccactcaactatttagagaagaaattatttgctagatttgaattgccatgcccttctgatgtgatttttcatattattggcaattatgatagtaaagaagaatataatgtgtatcgagtatatatttgtttgaatttgactatacctccttttcatgatgaaatgtattatctagaggaccccatgcatttaagtaattatctatctagttcctctagttgtttaaatgagttacaggttggtttgcaagaaggggagtgttgtggtttttcgactacaaagatttcaggatccaactacatggccatcaagaaatgtttctcaccggatgttgtgatacataaatataagttcaatacgctctatgacaaggtgaaaccgaggacggtttccaatcaagaaggagaggatgatgaggacacaactagctcggatataaccatgactaccttatgtattaatcaaccaaaggtgcatatgttctacattagatttacatgttatatatttgaacaaacgttgctacacaatgagtttcctgtgtttttgtttgcagaggtacttgctagggtgaaggaaaagagaccgagcgtaacgaattcatggatgatcaaagaagttgattggggaccatatcaagaccttctccatgtccatttccatctcatcatgtcacttttggtccatagaagacaagagataaagttctatacgttttggattcggattcgggcctcctgacagcatcaacttcaaacggacctagccgctgatctagaaagaatttcggggcccatgagtactttttggaaagcttatggagtctactttcatatggttttggtcccacgtcaaaattcctatcgagctgccgggaatctgcaaaacaagccatgtatctcatccagtccgaatctgactcgggttttgggccttgtaattgtgtcgtgggcttagcccaatgggatgtgcgccctagggcaaccctaggacgtccctaatcatattaattcagtagccgtcatcgtttagagttcggttttgcttagattattctgtcaagaacagtttcgccgctagatcggtttgtggaaccccaaatttgagtgcttaatcatccaaatgcaatttggttgcaatctatcttgttcttgcatgtgttcttcaatttgcatgcagggattagccttcttggcgaggtcaaccgggttttggcacggttgataactagacgagactaggtgctgcgattgcggggctcagtagcatgttcgttcagaagccgtatcgagttgtgtcgcgactccgcccaaatcgattgtttatcaatacctatcagaagatcgggacctacatccttcatcacaatacgaccacacagacgtactgggaatcccctggatgagtaactagctaaaacgtaggtgtccaaaggtatggtggagtatatggcaatcacctgcagtgggaatgtgttggagtccatacggtggggctcgggtagatgaggacctgtgcctggcgtgatgcttggtggagagattccacccaactgtgggagatgggatatttatggattggctagggaaaggcttccgtactgggcagtattggtgtcttgtgggaaaagcgtatagtctaacagaggtttaactgaactattcaaacagccgtgctcacggtcaagggtgaaaaaaaaggtggcactagaaaaaaatgaccaagcacagggagtcaatgcaggtgcttacccacagcgacggggcttatcagcagtgaaagaggctgccacaagattttgtcgacgagcaggaggaaaatggcatcgactggagctccaatgatgttggtgatgctagaaacgaaacgatgatgaagccggcttgatctcacagattggcagctcgtgctcgcgtcgatgatagtagcacttttgctggagcttcccgtggcaacagaagtcatcgtcaattgctttttgcgccggcgaagaatggtgacaaggaaactgtagtgctcaccagtggctgtggtgataaaggtggcagaggagtttttttaaaaaaaatcataaactctttactcaactcaaaagcatagtacatactggattgcaaagttgcatgattagcataacatctcttgttgtgacaggcaatatgggatatattttgacaattgtaaattggatttaggcattatgtgagatttggcttcttttgctaacttatctgttggatagtataggtagaggaatactgtgtaactggaccaattgtattgaacctcagggagccgatatatataagagtacatggggaggagataaggaaggattacagatatggaaggaacccacacaaatcaatcctaccataatatgactctaactaccatatactctaacatcctcccacagtccaagcgtgagcagcgtggacacttggactggagaaaaaaccttcaagagtactcaacacgatgatagccctctgtgtcgtagtcgatgtagccaaagcaaagggtgcgagggagccatggtcaatgaagccgtgcgtagagtagccgtggtcgatatagccgaagtcgggaagctgatgttgaggtagccgagccgtagggcgcgcatggggcgccgtagagtggtcgtggacgcacgggagggtgtcgtggaccaaggtaagcgaggacgcgctggagacgatgacagtgacgcgatcctggcagtcgttgaggtagatgacgccgaagagccaatgtagtcgaaccgtgaaggacgagacgtgacacagggtttgccagaccccgggacaactcgggacgaacgcgtgtgctggtgttgccaataccgcgcgggcgaggcaggggtccaccatgaatcatacaccaatgtcagaagagactagcaaagaagtcctacgggacgagaattgccggagtagcacgcagttgctggagaagagcgaagtgtagtcaaggaagatacagcgacgcttgcgatgagacgtgctggatgaagaagaaggcggagtagcgggaccaatggcttggacggcgatatcggtagccatgtagaggtagctggaccatagtctagagcggcgacagtggcagcttggaatcgcggcggcaatgctcgaagtagatgcagaagaacccgacggctgaagatgaccagtgcagacaacgaggttgtcgatgtgcgaacggcaaggaagacgacgagaggggcgacacatggtgcggctcaatgtcgatgcagtggcgagaactctaccggtagtgaggccatcctgaggagggtgtctgttagctttccaacaaccagtgtatgtggaccacgggcggcagcactgcagcccaagggggcgatgcgtgctcaatgacgatcggttgcagaagtcatcgtagctgggcagctgaacgggtgatcaagccgaagatgcgcggggctgaatgatgaagtcgaagcagagtcaataccgatgtcagagacgcgtagatgtcgatgaggcagtgggcgacgcaaaccgatctctgatcagaaaaaaaacagatacatgcagcagcagcagtagcaatccagaatcctccagtgccacataatagtagtagcatgacccggtcaatatgttgaatgactctgcacccatcttgtctctatctgctcacttgctagccacgtgcaagatcataacagagggagacaaacagattagagcgggcagcttgatgacagatcacggcaatcacgcgcaagtgctccacgcatagaggccgggtagtcggaagttccgacgatgagggccatgtacgagcacagagagggcagaagctagagaccgatgagtggcggcgtcctcaggagtcacaggctcgcagggggcagcgcgtccggggccgacggtggctgacgcggaggcttgtgcagcagcccccatgctccgccgccgaggacaccgatgctcagcaggccaggaaggacagggctgaccaggcgaacggaggtggtcgttgcggcatgcggcatggaggtacagccagtgatgacgaccccagatccgatctacgtggaggtagccgatggtttgctagctgctgatgtgtggagattatgggtaccccatacccacacggcatggttatctgactggttataggggataacttatatctatgagatatgtaacggatcatgacttgggtattacgtttccttgtatattatggaacggcctaaagttctggtttggtaatattgtaaagtagattttggaaaccaataccgtattggttaatgtttctatctggtaatcctactcccatcctatataaggtgggcaggaagccctatagggggcatgaacacacctggtcgtcaaatcaatactacacccggcggattcaaatccccaaacaggagtagggcagtacctctcattgagatggtctgaacctgtctaaatccttgtctccgcatccatccacttttagatctcatgcgctacccccttttattattgccgaattcatgtttcgactgttggcgcgccaggtagaggtgcgtcgaattacccatcaaaaagtgcgatggaatcaacctagatcaaccccaccaagttcgaagacttcaatctttgacatagaccagtttgccatttcaatacagtattattagatggatttgtaatctagattgatctgttgttcgatttttgtttgcatgcatgaactggtgtttgatgagctctgccggctacttccaatgacggcatcaggagggccatccagggacatgcacacgcatgcatcatgcaacacagagaccaatatctagtatatatgtatgcatggatcggaactaatcatttgatttactaatgattttgctggttgtttgcatgtactcctggacggagctggctaagtttttgaatcattcacgatccaagtcctgcttagagaccgggtcatgggctggccgcacccacgtcaggaaccatgcgacgtgttgatccgatcgacctgctgtgcatcattgatccatatatggaacatttattttttttcctactaacagattgatcaaactttgctgtttgtcttttatgcatgctggagcgatggttgttctcatgcacaagatggcaatagagatctatgttcgctgctgggcgatgggatttggctgtgctgccgttcctagcttcctcgcaatttttgtttgtgtttagattattccctaacatatatttaccttttctgattttttggttgcatatacgggtgtcagcatgtttttccctatcgccaccacgtctctatgagagcccatctgaccaaccagttcagagatagtcacgtttacatgaaaatatgcacgcttctttccacatacttgttatcactaaccaaattggtttgttgtgttgtcctgtatgcatgccgagttgcagattgctcgattatgtgtgcacagtacaaaaccaattgccaattttctccgtctctgagtcagtccagataaggagatcaatctcggcgagctcaacaattgaatttccgacttcgccattagtaacttattgttgtttattggattgatctctaaatatcagattaatctcttggtactttttgctatttacatgtaatgctgcggtgccaactggtcccttcctcatggttggcctgcgacgccgttactgatggcgacatcatcttcaccgatcggcatgccttcgccgccgccgactggtgtctccgccttcacggttggcctattatgccgccattgttgggcgtctacgacttcaccgccggcctgcctccgtcaccgccgactggtgtcctcacctatacggttggttggtcacaccaccgttcatgggcatccacgtcttcaccgaccggcttaccttcaccgccgccgattggtgtctctgcctacacggccggcctattatgccgccgtcgttgggcgtctacgacttcaccgccggtcttcctccgtcgccgccgactggtgtcctcgcctatacggttggttggtcacaccaccgttcttgagcgtccacgtcttcactgccggcttgccttcgccgccgccgactggtgtctccgcctacacggctggcctattatgccgccgttgttgggcgtctacgacttcatcgccggcttgcctccgtcaccgccgattggtgtcctcacctaaaccgttggttggtcacaccaccgttcatgggcgtccacatcttcaccgacttgcttgccttcgccgccgccgactggtgtccactcctccacggttagtgtgcgccgctgccgttaatgatggcgataatgtcttcaccgaccggccgcctcgttcgccgccaactggtgtttccgcctgcacggttggcctattacgccgccgttgttgggcgtctacgtcttcaccgctagcctgcctccgtcgccgccgactggtgtctccacctacacggctggcctattatgccgccgttgtaggacgtctatgacttcaccgacctgcttgccttcgccgccgccgactggtgcttccgcctccacggctggcctattatgccgctgttgttacgcgtctacgacttcaacgaccggcttgcctttgccgccgccgactggtgtctccgcctccacggttggcctattatgccgccgttgtggggcttctacgacctcaccactggcctgccttcgtcaccgccaattggtgtcttcgcttacacagttggttggtcacaccaccgttgataggcatttatttacctacaccgccggtagcctcagctgcttgcacggttggtgcttttattgccattgatggatgactttgttcctacatccgctacctctgctgtcatcaacgggaatactaaaagctaagtcatcatttattttattctttatatgatattttccttttactctgcctcactacatcaactggttcgccgttgactagtgagtcggggggctacagatgttatatcatatttttttcaacaattttcataatatttatcttgattgcttgcgatataatctgagtacaaaagtgcctatcaagttatggagttctatcttcctatgctttttgtttggtttgtcgatggatagatgcctttgggccgattcctaccacccgggggctcgttggatggaccgagtaacgcaaggtgctaagtattactcggaagaaacaaaagcatagagataagataatttattttctgctcttaacaattgcaaaagtacccgagtagtatactctgatccgtgaaactttgttccattaatgacgaactcatgtcactcgtatgcatgtttgggaagtgcctaggtcgactcccggtgcgcaggggctatgactagtcgggcagagtgtttgaatgtaaggagtcatccgctcggggacataaaattgacaaaagcagaaatacatatttataaacattttgaaatacttgaatttttctcaagtactgtatttacatcagatactactcatcctatatgttttgttctgcaggatccagatccagatatgcataaaaggaattcatagctttatgcttatctcctatgctccaggaatggatcagtcagaacatcaccaccggcttgccgtcgtcgccgccgactgttgtcttcgcctatatggttggttggtcacaccaccgttgttaggcgtctacgtcttcaccgccagcttgccttcgcccccgccgactggtgtctctgcctgcacggctagcctattataccgccgttgttaggcatctacgtcttcaccaccggcttgccttcgccgcagccgagtggtgtctccgcctgcacggctgcctattatgccgctgttgttgggcgtctacgtcttcatcgccggcttgcattcattgccgccgactggtgtctccgcctacacggctggcctattatgccgccgttgttgggtgtctatgtcttcactgccagcttgcatttgcttccgccgactggtgtctccgcctgcacggctgacctattatgctgccgttgttgggcgtctacgcttccaccgaccggacgccttgtctgccaccgactggtgttttcacctatacggttggttggtcacaccaccgttgttaggcgtctacgtcttcatcaccggccacctcgtcactgccgactggtgtttccacctacacggttggatggttaccccactgttattgggtgtctacttcttcaccgaccggcagcctcatcgcctctgactggtgtttccgcttacacggttggttggtcacaccaccgttattaggcatctacgtcttcaccgaccggccgcctcgtccgtccccgacccctcacctctatggctggtttatgcagctgccactactgatggatgtcatcgtcttcattgctggccgccttgtttgaccccgactggcttgttcacctccacggctacgcgtcatcatcatcgtcggtttaccttcgccgccgcccatggtgtcttcactttcacgtctggcctattttgccgtcgatccaggacgtcttcgttttcgtcatcattctacttcttccatcactgactggtgtttttatcttcacaactacgcgtcttcgctaccggtttgcttctgttgctgccgacttatcttcacgtcatcatggttgtgcaactttatcaccattatggggcgacttcatcttcattatcttcggcaccggcaaattctattgcctctacttcgcaagctatttcaccaaccacgacatctccaagggcctcgacatctcggcatgcaccaccagattcgacaccgtgctattctactacaacaagtggttctgcaattttcaagaattctactcggatatcttcaacacgtatcttcactcaagcaatggctactagacgacaagctacagttctcgactctatgttcagttatttctcaactaaccaaagagtcgggggctacacaaatacaagactcaaaattcgacagatgttatgtcaacatgaagcaatcaattaaccagccaatgagtcattatcttcgtcttcgcttccgagcaagctttctacttcatcaactccaattatttcaccggcaattttcgcttctccgtcgtcgccacggtctacttcaaatttctcaagtatcaagtttgaaatttaatttacatgtccggtagttcaaagttatcaaccaatcagctcaatttcgacgagttgaacaacagcatctactttcctccaagtggagcatctgcaacggctataacaacaagttctactgctattgtcataaatcaagaggcgttgcatcaatctcagttatgcacgcgctatcgtccagaaaactattcgagcttcgacatcttctcaacaatttgaaggattattgtcactgacatcatcactagcacctctacttcatcagccctgacatctccgtcgttgctaagggctgactacgtcttcgccttcggttgcttatgccatcaccgactttcattgccgacttgttctttcgacttcacggttggcctactacgcaactaataatgggagacctcatcgctatcattgactggatcaacgatatcatcatgatcaacatcctgccatgcctcatcggcttcgcgtctacgccgactgcatcacctttagcattaatcttcgacattggcatacatgaggatttacacgcctacaccaccatgaatgctgcttatatttcatcaactacgagctgttgtgggtcaatctcaatgtgtcctttatatggttgaaaacccgaccgacctcatacaaggagtgcgattacgactggcccggctgagtgttcacttggcacccatgctgtcatctgcacatcatctgtctcaatttactcacatcgcacgtaatgtgctgccttggcatcaggatagtcaagcattttctgcatgcaatgacaacctggccgaccaatcaaaaggagccatcctcctacaagcatatgaggttttatgcaaccaattaaaaacaagttgatcaagtcctagcatcgttcttgcatgttggcatgcattatagctgacacgtgtcagtgcttggattacataagcagactagatggaccagcatgagtactaatgctgtggttctattgacaatcgcctacttgggtctgataatcatgatggcaatcctattcataacttggaaaataccaaacagatatgcataagagaaatttatggccatgaccttatttcctatgctcaacgactggactatttattatttcccacgaggaccatcagctgagtatttgcgccagtcggaaccaaattttcatatctactttggtacaaccagcgagggataattactctgatcagaagccgctcatatgagctacacttgatctacatcacccgggatatttgtcactcgggagcatattcataggcgtgctatacacgtcatattttcagggtatcggttgacatattttaggcctaggcctaatatgtctacagcccatattttcaagtgtggcctgtcacgttcttttagggacttaggcagtttttgcataggcaaaagtgcgcgtgatcaagtacccaataccttaaaatccttttataccgctgttactcaactttttaggagttggtacaatgcattttaaaaggtgccaaacagtaaagctttatatagctgccttactgacttttttataagtcaggacgctgtttggatttataaagcaattgattggatacaatatcgttgctttttgccacgtaagtgtgcattcttattgaccaatattatggcttaggctgattatatattttggtcgttttccaggcggttggtaaatcctttatgagtttatttactcggattttacaccacatatgccatatatttctaagtgtggtgaaactatgtgtcttttagggacttaagcacatttgttaaagcagtgtgtgcatggtgtgtgcccaatacatgcttttttatagttgttttttgctatgtaaattttcaaagatgtagacaactttaggttgctcgcatcatattttacaaagcagtcggtatatcactcggatcatgttattcggggattcacaccgcatatgctatatattaatatcaagtcacttggttgactataattatcgaaaaccactcagttggttggattatttattccttgactatatgcttgctttgttcaactagccatatagtcgggggctacacctattaggttaatctagtcgatgtacctaagtttacatttaattattttttagccctccatagtcttttgatttggtaaatgtactcgggagaccatggcaaagatgattgaagcacacggctttggagtaatctggttcgagagaagattatcttttcgactgtgaaggtctcagggctactgtggagattatgggtaccccatacccacacggtatggttatctgactggttataggggataacttatatctatgaaatatgtaacggatcatgacttgggtattacgtttcctatccagaatcctccagtgccacgtaacagtagtagcataacccggtcaagatgctgaatgactctgcacccatcttgtctctatctgctcacttgctagccatgtgcaagatcataacagagggagacaaacagattagagcgggcagcttgatgacagatcacggcaagtgctccacgcatagaggccgggtagtcaggagttccggcgatgagggccatgtacgagcgtagagagggcagaagctagagaccgacgagtggcggcgtcctcaggagtcgcaggctcgcagggggcagcgcgtccggggccgacggtggctgacgcggaggcttgtgcagcagcccccatgctctgccgccgaggatgccgatgctcagcaggccaggaacaacagggccgaccgggcgaacggaggtagtcgtggtggcatgcagcatggaggtacagccagtgatgacgaccccacatccgatctgcgtgaaggtagccgatggtttgctagctgctgatgcttgactcgaatgacgacgaacacaccgcgcagcagcccggagattgcactacttgaggatgcaggctacgaagactcgacgaataggaaagaaaaaaaaaacggtagccgtccccgagagatcagaaccctcccgggggcgatggcagcggaagcgatcagcggcggccctaggtcgcccactctgataagatgttgggtagtatacggataggaatactgtgtaacgtggatcaattgtattgaggctcagggggccagtatatttaggagtacatggggagtagataaggaaggagtacagatatggaagaagtccacacaaatcaatcttatcaaaatatgactctaactaccatgtactctaacattatcagctaatttgttcagctcccttaggatccaattggctccaaattagccttaagctccaatgcctttcttcttgaaagtttcgcgatgatggcactatctgtaagaaagtgaactccctgtaagtccaataatctggcagtctacatcgccagttcaaatgctagaagctcccccagcaaaggtgattgagccattgtggttgtagctctaataaaaatggcattatgagaggaaaggtgtgtgaaagaaaacgccaattcctgttttattatcactccaggcagtgttagcatctaattccattaggcaaattcactattcttgtgtttgtatcttcctcataaagatcctcctgcatcaaatcatttgaaaggaagtttgtataagttttaatcattgcttatgcttccatgcaaacttgagttggctccttgacatttccctgaaacataagatcatttctagctttccaaagctgccacatgatatccaaagtgttagaatatgtgtcgaatatactagtcctatttggttacagttggacttagagttataataggtgttaggggctggagttagagtcggactctgcaacctgacaactctcttaaatagagaggggggcaccacaatgtaaccatggcgactacaatgtctcgtagatacgcagggagatgatgacggcgtggccatagactcgtagcggctaagagctatattgattggggaggagcgcccataattagagccccggggatgtaggcttcggctgaacctcgttaacaaatatcgtgtgttcctgtgtcgtcatctggcgtgtcttcggtgatcaatgactgaagtgatcgggaaggttactcgtcgttccgctatatcgactagcttttataataagtggtatcagagcggaaggtttcagcattggatcaagaagacatgtagaggaggaaacacgaggtgaggatcgtgcatcgacaggagatcgtcagtcgtggcgatgagatcgttggcgacaacgaggatgttgtgggggcaacgacgtcgctcgcgatcagaccggcgatagcggaacgtgaacggaagacgaggccgggcgtggccgaaggcgaccggagagatcgaaggggtagcgccatggacggcgcacccgacgcacgcagcgaacgcggatccgcggcggcaggtatgccagtgacggaagggcgaagccggcgagcgtggcgcggcccagcagacgtgcagggctaggacgacgaggtcgtggacggtgaacacgagggctgcgactatggtgcgtgcggaggcacggacggatagcactggaggttgctatggatcggacgtccgatctgtagcaaatcgtcggacggtgttgcactgtattattgaagaatgaatgtttcactcctcggtaaaaattgtttcaatgaaaatgtttcagatgtttcactatcagataaaaatatttcaacccttaagcaaaattgtttcaatcaaatacaatattcaaacaatactaattgcaacaccaagaaatcaattcatgcaacatcaagtcaaaacgaaatgaaacaccttagtaaaataaagtgcaacaaaaaaaataaataagctgcaacatcactaaaaattcctaaaaaaaaacatacatctatcttcttctattccggccaccggaaacaagtgaccggcatgggagagacaaataaggtgacggtgttagacgcggacgagggcaaatacaacattcaaacacataccaatggcaaacacgaagaatcaatacatgcaacattgaatcaaaatagaatgaaacaccatgatgcaataaagtgcaacagaaaaaacaataggatgcaacctcgctaaaaaactgtgacaaaattaaccgacctctatcttcttctactccggccaccacaaccaccaacacggcagagggaggtgaaagcgcgaggtgggcggactccggccagggcctgggccaaccacatcagatccaacacctcctccccatcccacgtcgccgtcgccgccgccgccgccgccggcgaggtccactgcctccaccctatcccacgtcagcctatgcccctaccatgccgcctctgccactgccgagtggctgtcgtcgagatccagcgcctcctcccaaccacgcgccgccatgcccggccgccgatgccgcgtgtggccgccggcgacgcgtcgccttttctcgcgactcccctggcgtccatgccccgactcttactccgtcgctcatcttcctgccgtctcatagtattttcatttgataaaaatggcgcagtgttggtagttgaagcagagagaaaaaggagaatacgagaaggctagaggagagatgagttattagctggatggataagtctggatggatggatgccgatatgtttcagcgttgactgtttctgcgcggtaggatggaagcgtccgatatttttcgttccgtcggacggcagatgcaaagcattttcggatggcactgggtgctgttctatgcgcacatatatgcacgagaaaccaacgcacagatgcctaatgcatgcaggtggcaaatacatgtacatgggctcgtgaaaagggcatggatgtcacgtgaaatcaatgcattcacactttgtgtgttgctctgattggaaacatcaacatgcaaagggcaggtggcggtacatggaggtctggtgcatgtaaaagaggtcgactcggagacgcaggagttgcaccgtggaaccaagttgcagtaggatggaaattggagatcaacattgggtctgactcggaagaaaattggataggttggatgatttcctgtccgactcgtctagcaaggatctttgagactttcacaagttgaagactgacaagtaccatcaccagcaaagagggtgcacggaggcagcaggcggtctcgcacgtcgacgggcagttcggtggtaggagttcgtgcatgaaaagtgtgtggttttcgatccgacgaggatggccgtacggtcggaccggaaatggctggttagacctaggggcaaagccagtcggattgaggtgaacgtcatatctggcgaagaaatgatatatctaggactcgatgaggtgttgagatatatggagtgaggctagaactgaagaaaatcccgggcaacagcgagtcaaatatcgttgatggggtcaacgatactgtttagcagtacaggatatatccaagatatgcagatcgacatgatgggaatatatgaaaatctgcgtcactgaagaggaatttcttcgggtgattcaagacaacggtgaattttctcaaattattaggaatttagtctacggatacgaaaagcgtgaatgttggatttgttagctcagttcataagatgacaaggaagaaagggttctcttcgtgtctaatgagtttgatttatctatttggtgatgacatcggttatctggccatggattagatcaagtcaaattttaagacggaaggtggatgtgaacatggtattcggggagtctattatgtgatagttaggaagaaattcaattcgcttggcaagacgactatggtgatatgagagaaggtggagtactgttgcaggtggaatcaagtggaagaaattacagggatagcggagtctcttgaaagcggtgtgtctggcgcagactcatcgagcggctcctggtgaagctgcaaaagaaaacaacccaagtctggaggacaggtagatcagcatggtgattctacgacttctgggtggcgtatattcgccaaggtggagtttgttagaatatgtgtcgaatatactagtcctatttggttacagttggacttggagttataataggtgttaggagctggagttagagtcggactctgcaacctagcatctctgttaaatagagaggggagcaccacaatgtaactatggcgactacaatgtagcgcagacacgcagggagatgatggcggcgtggccatattctcgtagcggctaggagctatatttattggggaggagcgcctataatcagagccccggggatgtaggtttcggctgaacctcattaacaaatatcgtgtgttcctgtgtcgtcatctggcatatcttgggtgatcaatgactgaagcgatcgggaaggttagtcgtcgttccgctatatcgactaacttttataacacaaagttcgaattaaggtggaattggaagagccattgttaatgatgtaagcaataagaagagccataggaacattaggtggaaaaatatcagtattgagctttgcttctgagattatccaagttaatttactaatataaaaagaaaaaaggaggtggaaatctgtttctatttgacaacatcagcagcaggctgctgaaatgttttgaatcctctgatttagcctttgggaagaaggaaagggcgtccatgttgagtctccaagcaaaagttttaactttgggagggacgtacctgttcttccagatttgtttcaagatagaaagtgattgagagttaacctaatgagcatttgaattttcttttttgtaaacctccttataagcactctttgtactgcagataccattgtttgtgaatttccaacatagtttatcttctgttacctgctgaatcatttgaacctgcaaaatctatctatctttatatactaaaagtccattaaactttctaaaaatgctctcaagccgccacgtggcttcctccaaacgctcttaaattgacaagtggcaatctaataaaccggtggacccactatttttaatatattagatttaatttacctttaaaaaaaagagactccacgattctcctcattttcctgttccacaccggcccacctaattaaatatgtactctcttcctctacttctccggatatattggaccaaatgaatatatttccaaacaaaacaaaagcacacgacgtatcctcctgccgcacatacacacatgtgcgtttctcctctctgtctctgtgtagtgtaggtacttcccccggccctctctggaatgtactagctaacaacctcatactgtcatacataaacttaagtagtgctcataatttttacgaagtaatacgataactccacaacgatgtgccgacaaatcaaaacattaaatagctaggctttcaacatgcgtgctgcttgctttaggctgtgttcgggaagaggggttgggaacccctcctctccggcacataaaacgatgtgtgcattagcgcatgattaattaactattagtttttttaaaaaaatagactaatatgatattttaaagtaactttcgtatagaaaatttttataaaaaaaagcacaccgtttattatatagtttgaaaagtgtgaacacggaaaacaagagataagttaggattgtgaggtaaagaactcagcctaatttggttatccaaataggctaacctgtaatcaactagggattaatgcaattagcattaggtcttcaacaaatgcgggtgtgcactattttcttttactcgctaaacaacaagcatcctaaataatcaacaattttgcggacccattaaaattagatcgatggtgtctttaaaaaactatagattcaaccatggtaaataataatttttaggtactagacttctacactttgtatgtttttttaattaccatttaaaaaaatctatagtaaaagtccattaacctacaaggcacctatactatcacgt

SEQ ID NO: 31108 - DNA, 9128 bp, Oryza sativa
  unsure (1)..(9128): unsure at all n locations
gatcccccattaagtcataatgtatcacattttaaaagttagataaaatataattcaacgaaaaaataaaacatctatctgtcggttttcacttaaatcaatgacccattatttttaactattagatcttctttctctataaaaaaaatcttaatccaccacatatatatcatctgttaaagatttttagaatgagaaaacaacaaattctcacctacattatttagaaacattagaaaaacaatgtcccctccacctccctctccaaccatatgtgcacaacactattacactgccaacccatctctagctcgagttctatgttattcgttcctctccaatctcctctctattttcagctactaaaataaagagataaacaaatattgaaaataccataattttaaactacgcatataagtttctaatataattgttgctttatttataattaaagcacaattcaagatccatgtgcctatattttgttatataaaaatatgacatttgggcacattccaccgtgcactttgcaggttatccaaatagtgatggaatataaaaaacattatcgacatatatttcgtaattatacatcaatcttttttaatgatgcacaacatcccttcctttttacattttattcaaatttccattaaaaactatgaaataactcaacaacataagttgcaccatcatatattattttgcaaccctacatgactaaattagacattcagttcgcaaaaaatagcccaaacacgaatatttcaagcgagtacatagaaaacagttcatagggataatcatccaaattgccataaaagaataaaaaaaatcaaaaaacactgattgtatgtgcattgttttttcaaatagagttaaactagatatacatatataagaaatataactatctcaaatctaattgtctaaaaattggtgcttttacttagataaaagaatccgattaattcatgatactttttgcaattaatatgctcaaataatccaaacaagccaaccgatcttctgccaaagtgtcctaaactttatttaagtcgattagatgattgcttttttttatataaaggcgccatatattaccccgcacttactcctaggccttttaaaccgatgaacacattattttcatccgttagatctatctcatcttaaaaaacaagtgtgtattcatgatgcatcacattcaaaaaaatatatatagcgcaactatatttcttcatccaactgtattcactctaggttgcctggagcctcccacatactctacacataacattcgcatatggattgtctcttaaactatataattatattagactatataaacacgtgcatttagggaagcctcatatcagaccaattcacccgtcgataaacaatgataacctatattcaattaaaaaacgccttacttttgacatgacactttatttgatatacatgtttctaacataaaataagtctaccttctttttagatgatgaagaagattaattataaataattatttgtagggattaattaaatattatttgctataaagctaactaatagctaggttagaaaattataaaagcaatgctgatggaaacaatttatggagaaattgtatatagcatatgttcaaattaacatagcctacgacacatatccgcgcgaatgcgcgggctacctttctagttttgttaacagcatgaccattaaaaatggagttgagcttgtggatgtcccagcttttatcgcggcatagattcgtaattcagtgaaaagagagaatgaggagagtactactgacgcttttcataggggaggacagggagctgagcagcgaggagttggaggagcagtagtgataggaaaaacggatcaaactcatcaaagtgattcaatttttgcattggagatcaagaaagagattagctagtagattagaagtggcgatctggccttcactgaagcagagttgtgcgaacagactgtcattgctgagggaggaggaggagggagattgagaggtaactgggagttggaaaaacggatacaagctacaactcttgacggagacttaatttttgttgtttgtggcaaaaattgatggggaatatgaagggatcagtgagaatagatggaagggacttcatggccttcccttcatggcgatttgtggcaaaaaaacagatgaagaaagcgcggtggttcaagttatgacgatgccgcacgcgcggaggactgaaaattggttgcagggtggtatcggcccaagctaggctggtgcacatactccgtccgtcccataaaaaatcaacttagtataggatgtgacacattttagtgctatgaatatgaatatatctttttacagatttattgtagtagactatgtcatattcatattcagtattagattcattttttttcggaacagatagagtatatgtgtggtgtgaggacatgggctgtgttactttgactgatgcaccctgagaaaggacagatggagagagagagagagaagagatcaggaggaggcaacaagaggaatccggaaggaaaagaaaaaaaaaacaaaggaagagaggaaataggaaaagataaaggaagaaaagaaaaggataggattttttttgggaaactttctggatttgggatttgtaggatttggcagaattcatgaatttgagctctacttccaaatctcaaataaaaaccaaataactccaattaacaaacgataaaaaaaaataaatggatggcataattgatttatttagtcaatttaaactttgtttgatttatgaacttttcattaacctatttgagacgaataaatccgaatgtaaattttcgaaattaggcaaattcaaaaacacaaaaaacaggacatgataatttttcttgtcatataaaaacaatcgtgttcgaatgaacgaatagttaaaccgatcaccttaagaaagatattaataataaaaagaagagatttggtaaaccgttttggacctccttgtgcgacccacaccatgctctatctttagcacggcacgtctgcattccttttttttccaccgtctctggaaatctacattgattttctttctcctggatagtgtcttattaaatttcacaatgaagttcctccatttctcctcgtaccaccaaattatttactattactaccatatatatcgttacatccatgtaaatataaacacgactcatttcatttcaagtttagatcacagccataccattccccgtgtcacccttcctctgctcttgggccacaaccctctggtcattcctatatacatacctcctcgcgaagaacacgtagatcaccagcgccaccacctcgatgatgcagaggacgacatagaaccggtcgagcttgcccttgttcaaattggccccatccagccaccctccgccgttggttcgctgggtgacacggttcgtgacctggatgagaaggctgccgagccatgctgatacaccgaggatacagtagaagatggagctgccgatggacttcatccccatggacgcctcgctgcagaagaactcgaggagcccgacgaaggaggtgacgtcgacaatgccaatgaggaagaactgcggcgtcagccagaacacggacagcgggatcccagtggtggcgtcctctagcccgctctcctcggcggtcatcttcctcctcgtctccaccaccgcggcgattgcggtggcaacgatagtagcgacgaacccgatgccgatccgctggaggtgggtgactccaccgacgtagcccgtgagcctgcgcagcggcggcacgatggcgcggtcgtagatgatgaggatgaccatctggaagacggtcgggatgaggaacagcgtcgccggcgagatgtggactgcgccgagcctggtgtccatggtgttgccctgctgcacggtgaggctgaggagcagcggcaccgggatgtagctgagaacagcggccacgaagatgggcgccatgcgcagcacgatcttggtctcctccacctgggtcacgctgcacagagaccatggcccagcgtcattgccagtttccactgccgctttctccaagcacctgcaagccaatgaaaatcttgatgctacttattaagttgaatggacaaacttatttaacctataaacttcaactgttgagagaaagaatgcaatttacttataatccaacgctatcgacacaaaaagtctgtttcatgccttgtaaatggaatattatagaagtgggttgccatattttatttaattgaatgtctatcatgttttcatcctgagacatctggctttgtgccattatgtcgatatagaagatacatttaccatttgaacccgaaatcttaatctggtgagagaagatgcaccatcataattatacacctctgcaccaacattaccgacagacaaagtctaaatcttgccaatgttcagagtttggacaacataccgaaatccatctgttttggggagaacttcgtgggcattggcatcgtcatcttggttaatttgcttcaattcgctgggattctccggcaaccggacgtttcttttcttgaatgccgctacaaaaacctgagatacatagctttattatagtgtcatggacacagctccaatcgaaaaagaattaaaccaaaagaacagttttgctattcgtcatccgctttaaactattttatttatgggttcttcttaacttacacatatattttgtttgaaacaaactaaacttacaaaaatatagcttcaatttacactgcaatctattttttggggggaatacacagaagacttcaacatgtttgtattaacattggggaatttgcagtgcaatcttagacgaaatttagctctgcctatacaattttagcaaaattttgtagccttaatcaaggaccctgtttgtcagtctcgtatcatctaaacatccacaaatataacttcacacaaccttcaatacaaattacacaaaacatttaattactgcaacattcagaaatctcaaaagaggttatatcaaacacaaccatcgataattcgatttcatatacacacctgcaatactcttgtgatggggctccccatcggcagctggttccggtagagcgggaaggcggcggcccagacgagcaagccgagcgcgacgaaggcggcggagacggcgaagccgacgccccaccccttgctgttctgcacccacacgatgaagacgaggccgacgaagccgccggtggagacggcgaaggtgtaccagttgtagaagctcgtctcctgccgctgctcgtccgggtcgcccaggtcgaactggtccccgcccagcgccggcaggcacgccctcgccgcgccgtcgccgatcgggatcaggtacagccccagcagcagcaggctcaggttcgcgccgcgcaccggctcgcaggtggtggtggcgctcgccgccgtggccgccgggctgcacggcggcgggtgcagcgaggtggtgtacgcttgaactgctagaaggatgtagccctgccatggagtaaccatgcatccatttgtcagaactgataagcttgtttggatggttattttcttattcatgatcttgtgctaaacaaatttgtcctttgttttaattttgagaaattttacaattcttaagaagtcaaatactaaaatttcacattacgaattttgatacctttagagatatagtatgtgaagatttcaagttttacacttaaaactatggtatctcctgatactttagtaagaaatgataaatttaccctgtgaagatatttaccggttggaaggcagaattaatacttataatttaaatttcaaatactaggttttctgctggtctaaaatttaattttcaatttgaatttggtttccgaaattgggtaatcctgtcatcaaccaattttagcactgccagctagtgcagtttctattagaaaaccgcatcaatactgattacggacctgcagtattaggccttactttcaattctatataaccaattttgccctgttaatttatttcccaggggattcaagagaattttgagaataattcctcaattccctcctaagaattagctgaaaaagctcttatggtttggtttagataataagaaatcataggtgaaattgggacgtggaaatgaataaagtattaggataagaaaatgtgagagaaaatggatatctagtatttaaagttactccttaataggttgaaattcatttctctttcccattatccaaacatactcttagatttttttagtcgtcgaaagttactccttaataggttgaaattcatttctcttttctacttaacttgatgtcgcttatcaatcaattatttggttgtggacatccttttcctaattaaaaatctggccattaatcagcactcggcagtctgattgccaatcacatcggtataatcatacctattgtagttgagagagcagttccaaagttgacagcttctagaaaggttgtcgaagaaaagatcgagtaggtgctatgtagtaagaaaaagtgactaatggcgagttagtaaataatataaaatatattatatgtcgtttcttggatgataatgctccaataatcatgtgagatcatgataacatgtgtttattaaaacccttaggtctttttattttgagagcgctattcctcaagtatttcactattactcacaccctaccaacttcatctgcaccatatcacaaaaaaaaaaatcgtttcgtcccaataatgctcaactctgtctcccatccccccccccaaaaaaaaaaaaaatctgtctcccatgataggctgcatgactgcatctttcgttgcctaatgcctatcatcattatctatgccccatatacatatatggtgatgtgtttccttctcctaccatgcataaaaccacagtgggtggtctgttgttggggacacctagcttctttgttactctctttagataaatcgaatgcctgcagtctaattaattattcaattttgaaatttggggtaaaacctgttactatcggattgaaatagagcacataagtgagagaacgtcaggcgataccctatagcatttagatttgaaaatgagttgaaatttacatcatggtgctatatgtcaccatggaaaattttatttaaaaatcgattatgcatcaaggaaattaaaggaaaagataagtttatgctttgcagactgacagaacagtaagttcactgtccatggaattttgcattttgtcaggggccgatccactgccctgttgttgtgttgaacagcttcaattttgcacatattttctgccaacatttacatgtatttttccgctacctccagagctgcaatgtcgttctaggctatcaacgtggtgggttgcttagttgcttgcttatatctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcagatcgctcgcctcgcctggcagggcagatcagggtcactctgtggctgacagctatgaaatgcttctggcaaacctgagaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatggttgtaaacctgtggggtgcaagtgggtgttcaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31109 - DNA, 436 bp, Oryza sativa
agtggatcccccgttttttctctctactgatctttccacgtgataaaataaatacgatacccttggaatactctcgagtgaaatgctacaatggtatatccgtgcacttgcggataaactctgtaaccataatataccaggagtatttctgcgccattgctgggaattatatttctagtaatgtcgttaagaaataccaacaatggcgacgacggtcgttgttgttacaatccctcctgcttcgccgacgtcagttcagatgttcgcgaagattgccatcttcacggcgtggcggtgtaggatctcgttcttctcgaggtgagcggtcgccggaggtatgtcttctgatgaggtcttctccatccacgtcctcggtaggtcgctcttcgttcctgctgcttcggcaaatgcgacattgaggttcgtcacggtctcc

SEQ ID NO: 31110 - DNA, 436 bp, Oryza sativa
aaaatctaaaacatcaagcatttctaaatatggtattttcggttaggtgtcactgaaaatttctaaaattaaaaccatgccactcccattactatttccgtcctcctctctcatgtcgacatcctcaccgtcacagcccgcccccaacgccaccgctgcggctgaccttgcgcgcctccaccggccattggcgcctcgcccgctgcgtacaggcggggtccgttggcggtccccgcccttgtaccattccccaccctcgaagtgcgacgacggcgacagcgtccgcaccaccaccatgccacaaaactcgccggcggtgagcgttcattgtgcggtgtggaatgcggcgcgcagtgagtaccagagcatgagatcagcgacggccgggatgtggcagaaggaagctgccgacgaggcgcccggattcgtcactact

SEQ ID NO: 31111 - DNA, 3787 bp, Oryza sativa
  unsure (1)..(3787): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttctgcagcggggcgactccactccacaggcaatccttgtcagcagcgacgaaaccaacttcaacaagacagctcccactaggaagatcttcagctctggtgtgggggaaaagagagtaagactgagtactacccactgtactcagcaagtcataccagaaaaggaggtacgatgcaggatataaccaaaggaggctaaaggttcttttgcataaaactagcatttaaaagcagtagttgaaagtagtaaaaacaattatagtaattagtaaatattaaccactcactgtcaaacgctacaccacgttacaacatacccaaccaaccacctgaagtacaccagttcattaagctaaactaggggtgagactaatcacggtgaatctagttgatcgcccataaccgcgggcacgactattcgaatagttttactctggctaaaggtgtacaactgtacccacaagacacgattctacacatgtcgccatgccccaaagtatcaccatgatactgcaaagggggaaatcgtgacaagaccctttgcataacccaccgctaaccatccacaccacgctaaggtttcacccccacccctcaaaaggcagtgggaagtcccctcgtgcgtcgcggtgaatccagcagctggacaaccggacaccctggccgacccaactccatcacgcccaccctcgccaccggtgcctaggaaagggtcgagctatactttagatcaagcagttacccactcccgcttgtggtaagaatggtaagtctcccagggtttcccgtgaaccggtccttaactgccatgggtgcgaccagcaaaaccatgcacccacggcccaccattcagtgtattttaattaactaacaccattgcggtggcaccaatccaaagctatgctaatagtcaaagtctatgtaataatgtgatccccagttgtgtactagttgaactaagcatggctaagcatttcctaaaccaacatctagtcattttgatacccaagttatcaatggcatagggtaaacaataaatggctgagtaataggacccatcccatatgatgttgtaaaaggatgcaacatttaatagaaatacagaatgtttgtaaattgggtacaatatgatcaaatgtaatgcatgacttaccttgctctcgcactgatgagaccaaagcaacatcttcgaggaaccgtggattgatgaaacggccaaaatctacgcgacaaacaaagcacacaagcaaaacacactataagactactgaaacaggaagcaaaaccatttttattggattctagggatttttatgaatttactgagacatgaatggacttaaacggagcttggatgaattagttatgaattttagaagattctctgtgtttttcctaataaagaaaatgccttaattaattattgcgcaataaatccccagggctgacggcagcgaggggggacggctcggtaggcgggccccgcatgtcagtggcacaaagggcggccggtctaccgtggacagggaccacctgggtaatccaccgccggtccacgggaccgacggtccagatcagccgggaggccgatcggacggcgtgggcacggcgaggcacggctcggctcggcacaaagccggccggccggccatggcggggtgacggcggcgcgcggccatcggcgacgaccggcggcgtgggagacggcggcggccgtcgcgaaggcggcggcgctgccaaggcatcggcacacacgggagaagaaaggagggggaggggcttctcaccgcgggttggccggcgtgggaggaagacgacggcgaacgacggcggctagcggtgaacggcagggtgcgcgggatggacgaggcggtcctcgacctcgcggggccgatggtggcgacggagtggcgtggcggtgggactagcggcggctagcagcggatggaggcggtagtaggcggcggcatgtggggagagcggtacggtgatggcgcacggcaagcgtgcgtccgccgagatagctctcgcggcagcgaagctagcggcggcgattgcgcggctcggcggcggctagagcagcggcgacgcgcagtcggagagccgcggcagcggcggagcttggcgagatcagcgcgggcgcggtagggaacacgggagggtgcggcgagagcggaaagagggagagttggctcgggggagtgtttttatgggcgcttgaggggtggaaatggccggggatggcccctattttgccggcgacgtggggagtggagggagagagaggggtgaattcgaattcgaatcccgcccatttttgggcgcgcgcgagagcgggaagatgtgttggaggtgggcggcgtgggtgcggggtgcgggtgcaggaggcggggaaggtgggtggcgtggggagtggcggtttcggcggcagttggcgccggggcgtgggcggctggaggtaggggatgacctgacaggtgggccccacctctcagcgttccgaagagaggaggagggggcacgggccggcccaacgaagaggaggccgagcgcgggaggcgaatgggccgacggcccaagaagaaaaagaaggaaaagaaaaggaagaaaaaggaaaaagactttccccgggattaaatattgcacttgctcatttttatttggttaaaattatttatagggctctgaaaattccacaaaaaatcttgttaatgcattagggcatggggaactcaagaaaaattccaccacgccatttccgattattaattgcatttattaattagggattagctctaggttaatttaaacaatttcttgaggcaatttatttaacaatttttcaagaaagaagaaggggaaaacttcagggcgtgacagcggctgtgcgtgaggacgcgcgggggatggctcgacacggctcggctcggcacaaagccggccggccggccatggcagggtggccgcggcgcgcggccatcggcaacgaccggcggcgcgggagaagaaaggagggggagggggttctcaccgcgggttggccggcgtgggaggaagacgacggcgaacgacggcggctagcggtgaacggcggggtgcgcgggatggacgaggcggtcctcgacctcgcgaggccgatggtggcgacggagtggcgtggcggtgggactagcggcggatggaggcggtagtaggcgacggcatgtggggagagcggtacggtgatggcgcacggcaagcgtgcggccgccgagataactctcgcggcagcgaagctagcggcggtgattgcgcggcgcggcggcggctggagcagcggtgacgcgcggtcggagagccgcggcagtggcggagcttggagagatcagcgcgggcgcggtagggaacacggggggtgcggcgagagcggaaagagggagagttggctcgggggagtgtttttatgggcgcttgaggggtggaaac

SEQ ID NO: 31112 - DNA, 9925 bp, Oryza sativa
cttcgagcttctgccgcgcggcgccgtcaccgcgcggtccgagggccccgtgccaccgcatgcagaggccatcgcctcctcctcctcctccttgagccactggaggtcggcgtgcacggcggctcgcagggcagcggggcatccactgcggcggccgccaccaccacgacggcatgcgccatccccgcagcgccgacgaaagaggaaggagatggagaggggaagacgagggatggaggggaatgggagggagatcgaaggggaacacgtggacgcctccggtcgcgcgccgccgtgcatgccgaccgtcggcgcacccccacgcggcgccgcacaccgcccactgtccccgtgccatcctgtgcgcttgcgctcgagataaagaaagagagagatagaggcagtatgaagaggaggagagaagaagagtggttgggctgacaagtgggtcccatgtcttttttatttgttttggctgactagactgccacgtatgcgtccacgtaggaccaaaaccgccctggatcgacttaggggggtaattcgtccggtttataaagtttagggttaaaaataactggtattggagtttaacggggtaaatcggacgaccgcaattgttcaggggtaattcatactttttcctatttattattaatttggtggtcatgttattgtcagccgccatattatttttacagctctattgtgtttgacccacattatagctcagcaattagattaaaaaaccatccaagtgtgttaacaaatttgaaaaacaacaccaaggtatttcatgggcctcacatgttatttaattttttttgacttggatgtcacgtcagtgaaaacaaccatatgtaaacatgagttgatggttttgctatgatggggatgaagatttttggtattgcaatttaggtgagggacgtggagtggacttattcctattatatacaaaagcttaataagggctgctggggtcattttctccacatcaggtttgctcgagtagagcatttcgctgccaccaccggtgccggctgctcctccaatgcccaccgctgccagtgaactcgaggtatgtggttcgagtgtccattgtagaatgctagtatgtggtgcggccgtgtggtccctcttctttgctggttacgatgtgagatcgctttgggctcttggtgtctggttgttgcacaccgtgtttgtagttatgcttcaatggaccaacagaggaactttcgctgtttctgtgaaatgatgtttctcagctcagaataatgtatgtttgccatgttagtaatactgtgggtcccagcatcacgtagtagtaacttttgatacactccacagtgtttaatacctactatggtaaatcaggtagatgcgccacaaacaaaaatcattgataccaagcatcaacagtgcacaaataatatattttacttgcttgttgccggtagtaagtatactatctggtagcttttactacgtaccacaatgtataactgctgggtacgaaagaatagtgtttattaccagcttttccactacatcgtggatgtgttaacaccaaaatttgataagattctttagcggattcggttaaggaatgagcgcaatcagctgatgaaaacttattgttggtatttcttaacgacattactagaaatataattcccagcaatggcgcataaatcttctgctttattatggttatagagttcatctgcaagcacacggatataccattgtagcatttcacccgagagaattccaagggtatcgtatttattttatcctgtgggaagatcatgtagagagaactcgactaataatttatatattacttgtgataatcatattctaagcaggggatgagataatctaaggatagagtgacacacaagcattaactactcattctcataatatattatctaagctaagtggatagaaaagagaaaaataatctaatcctatacttctaatatacatagtatacatacattctagttaactgatatactagccaataccctctatccgatgccctcctggtacttcgagaagccacccctgactaccgagttccttacgacagcccgtcatgatcatacaaccggggctaaatacggaggaatacactccccagggaattaacttaggattatataccggcggcgcggaggaatacccgtactgagctatcaccatcagcagcccacctctcatccgtaatatataaccccaaataatgatatcccctaatctagacaccacgtctaaactaccagatattactctaatatcatcgtcatgacatagagtaattacataagcaaacattatacccgcaccaaagcatctcccagataagctagccgtatattcagtataacatgaacataataatgtaatgtaggtacttatatactcggaaagtatttcaataccataaatgtatttagaagagtattctaataaaagtacaaagcttacaaaagagaagagaaaagctactagagccatacccgaactcttccgaagacttttggactcctgatttctactctattcctattccaccagctagatactactaatctaaatttgagagaaatgagagagctattgcttgaggtgtgtgagtgaagtgagaaggtgaagtccttttataggcaggtatgacggttgtaaccgttgtgaaatatctgaagtacaccgcaacagctatcaggacaatatatggaccgtccctgccaaaccccacatccaacggtggagagggaggatcggccgaacctcctggttcggtcgaaccaggggccggcccaacctggcacaaaatcagcaggtggcctcctccgttgcttcacttcatagacttgcaaattttggcccaattcatcatgtcaattctgagttcttggcctattcacacataagtctgattctcgacatcgtccgattgatttatcatttgagttgatgttgattctcctccactttgtggttattctctgcaaaaggttagtatacctaataccagtggaatattattattctaacatatttatggattacaagcatcactagttctcctctattttggtaatattgatggtcgaaactgatcgataacgaccgtcaacacttatccagaagagaccaagttcgaggaggaatcgtgaagaccacggaatgatagtttaattccatctattaattaggcaagatatagtaattttccttttatgtttagaaaatatttatcgagtgtctgatcagcacttgtaattttccttttatcattagaaaagtgtgtttaatgtccgatcgggactcttaacggcctatgggtataaatatgtgtacccggggtcattgtaatctatctccaaagatcaacacaatctactttcggcatatcgccacccttttattttcgatgagttcttgtttcaagttgggctgcatcaacttcgatctccgatgagggataaggcttgttatggcggcttgcattgtcgggattagtgcttcaattgcttgaacactctaattttatccatgtaagacgtcgagttattatatacattattgttggaggcatgtcacgagggccttcgaccggacctgccgaaaccatccaaccgacgaggaaacaagccaggggcgtcgggttcgaccaaggcaaaggcatatggcgaaagccatgtggtgaagcatgtgggcgaagaccaaagccccgtatccaaacttcgcaatcgagaggatcacatgggcgaaaggcacatggcgaaggttatgtggcgaagcacgacggcttcgcccaagctggaatctatgcaaaggaggaggactagatggctgctaggcccatggggccccgttcgccatgactaggccagcctaattggcacattagagcccataagtgtaatagacactgtgtgcccttactaatatccctataataagggtatccatgtaaattcccctgtacaatctaaaccatagaaggtgtaagcctgtactaaggctataaatagccccctagggcaatgtaacgggggatcccaaatttttttttcaagtcaatatattgttttactgttcaaaacatccaaccaatttccttgttcttcgacgtgacgcagttgtcattcgacaacaattatatataatctagattgatagcgttttcttcttgcatcgaccgatctccatttagggttttgtcgatattggctagattactttttttggcttagattatataatgtttgcaccaccctgaaaattagtcaaaggcttgattgtccagatattatatttcttttcatacttagtgttgcatcagttaagattgatctactaagtcgtgcttagaaccataatctctagcttgcttcttaattgccaataagggttttatcgggtttcagccgatgagttatctggacgttgtatcggcttatatggattacatccaagttggattgagccgattgcagcaaaggtttcattgattatctaattgtttggatttaatgacatcggacctccagccaatgtatgttttaaccttcggattagatcagtgcttattccatcatatcgttattagccgattggtttatactggtttacattgttctgttgttacattatcattagccaactgtttctatatcatcatttactcaagcattagaatatacattggatatatagccaattatttcaaaaccctatcgacatcggctttttgatttgcaatctatataacttgtcagttgcaggatcaaattgactggcacgcccgcatctcatcaatattttggacctgcactggagctaagcagatctcctaggccgttgcgttcgtcgacttaattcgagccaacatagatctggcaccatcggccaagcgtgaatttttcgtcaacaggattcccatcattttgcatacttttggtgtaacgtcccgcctctcccaggctaggcctgcttgcatctgatagctttcataggtcataaactgccctcacagaccaacacaagtcttttctgcacactttgtcctcactcgtgtgcacccgggaagaatttcccggtcggtcacccataggtcatagactgccctcacagaccaacacaagtcttttctacacactttatcctcgctcgtgtgcacttggaaaatttcttttctgcacactttgtcctcactcgtgtgcacccgggaagaatttcccggtcggttacccatcccaaattgctccaggagccaacatagatcctctcccaggccgggcccgcttacatctgatagctttcataggtcatagactgccctcacagaccaacacaagtcttttctgcacactttgtcctcactcgtgtgcacacgggaagaatttctctaggccaagcacgcttaaccctagagttctttggaaatcgacttccggaaaagaagttgcaacttgttgatatgagtattctattaatcctattaagccttgggctgggatgttacatcctcacccccttaagagagatcgacttacaaattgttgatatgagtattctattaatcctattaagccctgggctgggatgttacatcctcagccccttaagagagattgacgcccccgtcgacgacgggggggatgggatgttacatcctcacccccttaagagagatcgacgccccggtcgatcaacccgatgggggggctgggatgttacatcctcacccccttaagagagatcgacgcccccatcgatcatcgacgcccccgtcgatcaaccccggccaggaacgttctcttggccacgtccgtgtgtccagtgccaacgtatgtatcatgctgtctgaccactccgggtccacaccagccatgcgcaccatgcccactttgtcctcactcgtgtgcacccgggaagaatttggcaccatgcccactttgtcctcactcgtgtgcacccgggaagtgaagttctttataaattggcttccggaaaagaaattgcaacttgttgatatgagtattttattaattctattaagccgtaggctgggatgttacatttggtttccaactaccagtgtaagttgagaaataattagcgatattggcttattagatatttctctgtcgctgacagtacaagtgtacagcagcaactgaacaaagaattactacatgtaaggtaacatttgacagatctttgctttgttccaagtctaatttttataagtgatatgttattgtacaaccctcgggtgtgtccaatttttgttttttacgtaatggtgttatcaacacaccgttgacagcccttaaatatcattgggaattttttatgtctactactcggattgcagtggtgcacatggatggcttgcgtggttctagccgtcagaggctgtccttggtctcatcagcctcagccaatcagtcatcaatttgctttatgagcccttaatgctcctgctttactcacctgcatcttttgtatttttgtgtttcaattctggtataactctcatttcctaacaacttcatctcttggaaatctgacctgtgcgcacatttccaatttatttttttacccaacagaattttagttgagttaaaatggtctcttacgtaccataagcattgcccagtgatgatggttaattgccaatgcaatcaagatcattagtgcattgcattcaaattacaaacttgaagtcgttccaaaatccatgtagtcttattgaaacatatgacttacttcagctcctggatcttaaaactgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcctgggcagggcaggcggcgcgcgtgcacgacgtacgcgtcgaatggtccgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacattccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttt

SEQ ID NO: 31113 - DNA, 10066 bp, Oryza sativa
cttgggaggtgacagagcgaccctatgggtgtaaacctgtggggtgcaagtgggtgttcaagaagaagcttaggcctgacggtactattgaaaaatacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaacattgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgatcctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaataattctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcctgggcagggcagggcaggcggcgcgcgtgcacgacgtacgcgtcgaatggtccgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacaaaaacatgctaagattattcgatgtttacagtagcagtatagtcgccgaagcaaatacagatcaaatgcttcgaacaatcacttgatgggctgactcggtgagcatcccgctccaccatagtagaactgcaagccatcgtccgtggtgtaaggacgcccaacatcgtagcagtttggctcagttgcaaccgtgttgattgttttgagagcaggagttgcaaagcttcccgacgcgtcgatcaccttcgcatcggcgaagaaagcggcctttgtctctccttcatcagcaggctggccactgcccatgggaggaaaaggttcccctggagcagcttctactacacccatccaactgatcacgtctgcagcttcagacatgtgagtcaagagctttgatggccagtaccccactatttcttctccaactttcagcacccagtctcccatgaactattcattccagagaaaaaaaatcagatatacaaagtgtcccagttaaataatgcaaggttattggcacagtaaaggattatttaccttaataatcttaactctaatgatgtattgttttccattgacagtggaaactggcctgattattattccagggattgcctttttgctcatctgaacaaaccccgcacaacgaaggttgatacatgacttatcattatcaacctgttgcatgtaaagcaggaaacagttatttctcatgtttcctcctttggttaatacaaattgacagatggcatttttggcacacattcttacccacgcgatctcgaaatgaacaagattgtctccgtacagatgtggatcaacctgcgatcgaagcaccataggtttttacattagtatttgactgcaaagtatgtcaaaatgttcaacatttcatatgtactattgagggttagtacaagtttattgtttcaataaatgtaccatttctgatatgacaaaaagtcttcttctgatgtaaatagatttaactgtcaaaatgagattctttgagattattaagaacttacagaccatcctacagctacacgacttcctccattttttagaacaacaattgccccactaaaccttggtggacgtcctgtaccaagatctgtttcccatattgaaattgatgtttgtagtccgtaaaaagtagatggcactataacaactgcagccatctagaacaaaacagagaaggggagtcaatattaatgtacgattaataaaaacaattctaagcataggaaagaaaacatgggagataatgcaactacagaactataattcttacttgtctatttcctttgtcatttctgttctcactgtatataatcttatcgaatgatcttgtactcatggatccattgtagcttgttaggattggcaccgtccctgggggacactcaatttcgctcatctcaacattagagatgccaaatttagatccttcatcatcatcggtactgtgaggaaaggaaattggtggcatctgcattaagagtaagattcaagatgtatctaataaaaagttattgatgtttcttgggaaaaccatgcatgactaatatgaaatataagaaaataataacctaccaactgagtggtatgattcatcagcaaaggatgcctcaaggatggttgcgatttgaaactaacacaggcaaaggtttgcccatctgcggtctgaaattcgagcaacacaacagctttggatcagaacagatactgtaatcgtgcgttgttaaaatgcaatgtatacctgaatcgtcttgatgattaaattgttgtcaacctcttcttttgtcggatctacactgaatattagcaaatgaagtagaagaaatgtttttatggtccatcctttgtatcccatggtcagagactttgcatagatatgtatggtaaaatctatgcgaaataatgtacttatatcaatatgaataagcacataaatctaaatcttaaccaccatatttattgctttcataaatatacatctaaaccaacatatttattgctagcatcataatagcaaatgaatcgtcttcctttatttagcatttatatcttctttagtattttccattttcacttgtagacagaaatgcactagtttcaggggatgcacatttatgttgtcagactttcataaatggtgctgactgatttcaccaataaactataaactgaaacaaatgtttggattgccttccgcatttttgaaaatcaattgattgaacctatctttcttctttgtgtaactattaaaatatatatcttaggatggcgtagacaagcatggacatttagctattggacgcctagcacaaggattgaattcagcaaggtccttaaatgaactttaagggattcttacaacaatgaaaattctagacaaatacgtaaaattttgtgcatcattccattttgtgaagtagctgtttacacccaaatttagcacctagagtcgaaatagggaaatatttccaaaatttggaatgcgtcgggtttccttcatggggtcggtctaactaccgcctatgggcgggtctgaccgacatgtagcgctagtctgaccgccagcatgtggttggtcagaccggcagagtccgattctgtcaggtctcgggtttccttgcttcggaaggtattttttgagtttcaattagtttctacccagagttagacatggaggagaacttatagaaggcaataccaacccctttataagggctaaggctggttcgattctagcccccaatatctcaatccctacacaattgaatcattcttttccctttactttttagccatgtcttttacgttaccctagtttcatccatatttgtcgatttgcgttgtaaaacgtccacctttgccgtgagagtgcgatcatccctttgtaggtttgccctgtaaaccttccgttcaaccacgagatgggtggttatattcaaatcgatctaaattgtcctcgtggctagttttgatctctaaatcagctccagtagccggttcaatcttcaaaacccatattgatttagagttatctagatcgaggtggttggtgactccattaacaccgccaaccttttaggtgagtctcgtgttgggatcgaaaaagacgccaatagcagccttggatgcaaatctttaatacatataaatggcaaattgtcctaagtttctcaaaaaaaaaaataagacttcatatgcagacctgaactaaatttaaaataatagatgtgtttgaaaatcgaagtaatgttgttttgttgtcaatgtggccttttcgtgtggtcagtgatgtatgagagagctttctcaacctaaatccatcgttgtccgatctgttggatttgtagttaaagctaacatgtatgaaatattctatccctcttggctcaagctatagaggcaatgttgagccgggagggatcacacttttttttgctagtgtacctttctttaaatgtttaacaaaagggacaagccttgccgctaatcagctgtgaaggcctgccttgctagcccacaacccagtgctggcgaacagcgatcactactacaaaatcggtttttcatggcggaaccatatttttttcgctgacggccctgtgcataatccgcctgcgaaattgaaacgatgagtgaggggataaaaaccgccagcgaaaatagattttctctgacggttgagttatgtagcatgctagtgaagatatatatagctattttcgctggtggctcacttaaccaaccgccagcgaaaatcgattctcgctggcgatagctaaagaggtccgcttgcataatattatcaccaaatataaattgaccacgtggctcaccacctagtgccacccaccccttcctctctctctctccaccaccaccacccaggctggcagtaccctctctttcctcctcctctcccctctcatccctctcctcttggcgcggcaatgacggcgaggaggggaggagaccgcctgcagcacggcaacagtagaggggagagtgtatgtggctctcccaatccactcccctcccagatctggttaaatatacgggagctcgagaagggcgcggcgcggcaaaggggtaggtggcgttggcagcaggtgcgagtgctcggctacggctccctcctcactcacccttcttcgcgcggcatcagcggcggcaacctcctccctcgatcctctcccctctgaaacctctcttggcgcagcatcgacgaccagaggcgtcctagtggcggtgggattcggatccggttgcaggaggggaggaggctggtggcggtgccggcggtagcgccccactctcctcccctctcagatctggccgaaggaaaggaggccatcaacggcgtgacaacagtagaggggagagtggcggtggctcccctactcccctcccgtcctatatttggccttatgagagctcgagaagggggcggcgtggcaaagggggaggtggcggtggtggccggtgacgacaaagggcaggggctgcataggtggatgtggctgatctggccgtggaggcgatggatccagccatggaggcagcggcgagtagatccagtcggcgacccgtctcccagatctgggtatgtatcctctccctgcagtctctctgtttcccatccatggatgttcatggatgcattggttagtgatctgtctcacaggacatgacaagatcgctggtgctgtggttgagggagcttgcagatcgttgtttactgtttaatgtagattgaaaattcgtgaatgttgtaaatctgtctttagtttttctgttattcatttgtagatttgtgaaacgagtaaatgctataaattgtggtgctctatggatctggcaatttgggattcacttttgtgatttgggaataattgttctggattggtgatctggtatgcatgagggtattttttttcccaaaatcatctacgctggcggtcgtcctgaccagccaccagtgaaaataacctcatcgcagatggttagcttaacctagccgccagcaaaaaccattttcgctagcggctggcttaggtcaccgtcaatgaaaataatttttcgctagcggctattggccgtcagcgaaaatggtgtgtttttactagccattagtcactggcggtagcgttggccgcatgagaaaactcaaaacggtcacgaaaaatccattttgtagtagtggaggcgaactggttcatcactgcaggtttgaattgcttaatggtaaatgtgtgtgtcgttctctgggaagaataaacactgaaggtttggtttaatacccttttgctcttaccaactagaagttattccgaaagttgatggcttgaaaaacatgtgaattagtttttttttagataatggaatttaacatcccagcctttgctcaaaaagagctacagccaattattacattgtatcaatccagaaaagaacgtagttcagctaaataggacaccaaacaaaaacagaggaaactaagccaaaataaggagaacacatttattgaagtctatttgtgaacctccatctataattggcaaataattgcataaccatggactccaacttgcggtatgcaacctttagaaactccctatcatcctcacacctttgtagctgtgcccaaaaccggagccagtgcgttgccctgaaaattacctgcatatatgaaatagatggtgatttattaaaaaccaaatcatttctactcaaccatagagcccaacaaatggcagaagctccaaccagtattagtttaatctttttcttgtcaatccccaaaagccatccatcaaatatatgagatatactagttggaagattaaaaccaaaagaaaactgaactgctctccatatgaattttgcataatgacaatccatgaagagatgttgaatagtttcatttttcatacaaaagcaacaccttaagctaccattccaattctgtctcgccaaattatccttggtcaacacaacccccttaagcaaataccacataaagattttaattttaagcggcatcttaagtttccatatatatttgttcctctcaacataaccattgttaattaaacctagatacattgaccttactgagaacctaccattctgatgataattatatctaaaacagtcagaagaaggatttaattgaatatgtacaatagaagcacataactcatgccaatatacaagattctgaccaactaaagctcttctaaaagaaacattaagcggaacagatcccataacagtggcaatagtggatgatttccttcggactatagcatataaagatggaaatttatccttgaaagccaagttacctagccatttatcttcccaaaatcttatttgttccccatcattcacaatccaagagcccatatctaaaaaagtacttttgactttcataagtcctgacaaaaaatgggaatcaccttgtttcttgtccacttaggttatagacttgttataaagatatttccttttcaataagttctgccaaaccccttcctcatttattagcttgtacaaccacttactcaaaagacatttattttgtaattccaaattatgaatcccaaggcctccctgatccttaggttggcaaataatatcccatctagtgagtctgtactttttcttatgatcatcaccttgccaaaagaaccgtgatctataataatcaatcttttgaagaacccctttgggtatctcgaacaaagatatcataaacatagctaaacttgaaagtacagaattaatcaagaccaaccttccctcgacagataaatgtttacctttccaactactaagctttttctcaattctttcttcaatcactttccaatctttattagatagtttcctaaaatgcattggaattcctaaatatttaacagggaaagaaccttacaaccaaagatattggaatattgatcataacactcctttgcctgaccaaaacaaaataattcacttttgtgaaaatttatttttaagccaaatagcttttcaaaaacagttaaaatcaatttaag

SEQ ID NO: 31114 - DNA, 673 bp, Oryza sativa
  unsure (1)..(673): unsure at all n locations
agaaagcctattcctataaaaccatctaatatcaatttcctcttgagtcaaaaggacattttctgcctttttatcagcaatttaacttatccaataaatcttttttctcttttttataatataccactcgtgtgcttagcccatcccctcaagtgttgccttaacnnacgtatttttgcttgtcagcgctccatagnagagtctccttcatctacactatcccaaacctctctcaccatatcaacaaaaccctcacgtaaaagccacccaagttcaaacttaaaacaaggttgagcattactttgagaagatgaatttgtgtttaaaagtaaaggagtgtgattagaaatatctctgttaagtgcaaccaccgaggctaaaggaaaattatgttcccactctgtcgacattaagactctatcaagcttctcataagttgggtttgctaaattatttgcccaagtaaaatttcttccagacatctgcaactccataaggcacaacccatcaataatagcattaaaaagaaagggccatcggtcatcaaaattgctattacttttttcattagggctgcgtaaaatattaaaatcaccaccaataagaattggtaaggtttcacgagagcacatattgactaattcagcaagaaacttatccttattctcgtttt

SEQ ID NO: 31115 - DNA, 595 bp, Oryza sativa
  unsure (1)..(595): unsure at all n locations
tacgtacgtttgtatgtttgtacgtacgtgcagggatgcttgaatgtgggcctgtagggataggagagggaggtggaaaaaacaattctaatggtaattaaaaatagtgggtccagttgtttattaaagtgacacatggcgttttaggagtgtttgtaggactcccacgtggcggcttaggagcgtttgtaggaagtttcatggacttttagtatataataatagatagatagatagatagatagaagatagataactaaaataagcaagttgtaaatacacatgatattggatggttgagatcaaagcatgagaggatccaaaggctagattttttggttccaactatataggatataggatatatagattggataccatctgtctttttatggcatnnnnnnnnnnnnnnnnnnnnnnntttaacccgaaatattaagatggtgaaagaatgtgcctaattcacttatactatagcattactaacaaattaaaggaatactctgataaactagcaatgttcagagttttggccgacatacccaaatccatctgttctggggagaacttcgagggcattgttatcatcatcctg

SEQ ID NO: 31116 - DNA, 1213 bp, Oryza sativa
tcttaagcatggtgataatcaactttttgctcagatttatgtggatgatatcatctttagttgttcgactcacgctttttttgtagattttgctgagattatgcgcagggagtttgagatgagcatgatgggtgagttatcgtactttttgggattgcaaattaagcaaacacctcaaggtacttttgtacatcaaacgaagtatacgaaggatcttttgagacggttaaagatgaagaattgcaagccaatttcaacaccaattggttctacagctatgttggatcctgatgaagatggtgaagctgttgatcaaaaggaatatagaagtatgattggatttttgttgaagctaactggctttaggccagacatacaatttgctgtgagttgggtgcacgctttcaagcttctcctcgtgcttcacattgtcaagcggtcaagcgaataatgaggtatttgaatcatacacttgagtttggaatttgttattctacttgatcttctatatgcttaagtggatattctgatgctgattttgcaggtggagaaatgaactggaaaagtactattggaacatgttattttcttggtacatcattgattgcatggatcgtgtttatgaaacaatctagtgttgctcaatcactgctcaatatgaatatgttctgctgctagttgatgttcacagattctttggcttttatctactttgaaagattatggtcttacttttgagaaagtacctcttttttgtgataatactagtgctatcaatattgctaagaatcctgttcaacactcacgcacaaagcacattgatatttgtttttactttttgagggatcatgttgagaagggagatgttgaattgcagtttttggacacaaagttgcaaattgctgatattttcactaaacctttggattctaatcgctttgcttttctttgtggtgaattgggtataattcatccttttggcatggtttgagggggagtttgtacctcatggttttatcgagcaataatatgacaatgagaaaaattgagaaaagagagctttgtttatacatatggtattttcttgtacatgctagcaatactttgaagttatttgtctcaacatagcttgatgtattctagtcttttcatgagatttagattttacttttaagggagatgatgcatgacacttaaattctatacttgaatt

SEQ ID NO: 31117 - DNA, 3515 bp, Oryza sativa
agttaaaaaattctcttggttgttttgtgctaaggttatttgagaaagagtgataaatgccataggtatatatgtttagtgttaatttttcaacctatgtgcttattaagatgttgcattataaatcgtatgaaatcatgaatttagattgttgattcaagcttaattgtaaaatctttggttcatggttatactttaatgcatgcttgttatattatagatggatttatcttctttttattgcaacacatgacttgatatgctatatgtatgctaagctcttgaacattaatgaacataattcctattcttgatgaaatcattgtaaaaagggggagaagtaatgtgaaaatttttggatttttggagaagcaaggcgaatttttggagagttgttgagaagagcatgtttttggttcaattgggaatttctttctttttaaaaagggggagaagttttcttttggatttttgagcacgatgtgtacatttgtacgaagtgtgctttttaccacttttgtttttatttttccaaacaccaaaacattttttatgggtttgccaatgtgttcattaagggggagattgtaaaatcaaaggtgtttttgattattattctttgatgaacaattgggcattggagattattggttttgttatttggaatgtattcacgaagtggttttggagatgattagattcacaggtgatcgcaggattcattatttcatgtgaccggtcagaccgggctctggtagccggtcggaccggcggtatgcgcgcggtcagaccggctagcccgcggtatgaccggccgacactgtgtctgtttcggttcgggttgtttgtttggatatccgtgattatttcatgattatgacttctagatggatactatactatgtaatactgttgtttgctactaatgagtcaagttggagatagcttggtctcggaatatagtttctttgtttgttccatgtgtaggtgactcgatgtctcgggagagtatttgcggtgatggatcgggagtcggcttagggatgaggcgacgtccgtggtggttagagatcatgcgggatacttaggctagagttgatgcacgtggttaatggagattccatatggcatacgatggagttattgtgtgcatatgggatgcggagtcaaatttggaaggagtccaaatttggtacgattggttatgtaaagtttctttcttgtactagagggtttcctaatgtgtttaggactcttagtatgagtttggttcgtggctttagcctgcctacctcatgtataaatagagggggagcgtgaggcttcccggtatcgcttttgagagcaattgagttgagttttgagttagggtttcagttttagttgaaatttttgtaaggagtgttgttggtgtcttttgtaaatacagagagaatcaataaagttgtcatctactgtaagagttttcgatttgtgtttcccggggtttcgccggtctaaccggtgacacaccgactgtcagatcgacggcattgcggtggttagatcggcgggtacacggcggtcagaccggcgtcggtgacaggcgtcaggagcagatcttgaaggtcataccggagattcaacaccggtcagaccggcggctacgcttcagtcagaccggctaatctactccggtcagaccgatctcatcgaaattgagggtaacttttatttccgctaaaagttttcggtttttgggtatagcaaccattcagccccctctggttggcttagttcttgtgattcgatcctacaagtggtatcagagccttgttttcttctttggatttttatcgatctagagtttttgccatggctactcccgctaggttttcaactaagcctcatgttttcgatggaacggatttttctcattggtatagtaggatgcaatcttatattatggctgaagattatgatattggagaaaagtttctcatccttatgtgattcctgaaactattaatactgctgctgaaaaaactgcttttgaacaaaattgcaaagctcgcaatattcttttgagtggtatttctcgtttggattataatcgtgttgctcatcttcaaactgctcatgagatttggactgctttgagtaattttcatcaaggaacaaataatattaaagaacttcgtcgtgatcttttcaaaaaggagtatattaaatttgagatgaaacctagagaagctttggatgactatctttctcggtttaataaaattttgagtgatcttagatctgttgattcttcttatgatgctaattatccacaatctgagatttctcaccactttttgaatggtcttgacatgtctatttgggagataaaagttacatctattcaggaatctgttaacatgtctactttgactttggattcactttatacaaaattgaaaacacatgagatgaatgttctttctcgaaaagttgattctaagtcgagtgctttggtttcctctttggatgttgatgcttcttcatctaagtcttcttttcttgctatttttaatgccacatccgatgatcaactcgaacaaattgaggaggaggatttggctttggttgctaacagaattgctcgagctatgaataatgccaggaagaacctcaacatgattttggatcaatcaaagattagcacacataaccgtggtttaggttttaatccttatgctcataattcttgacatccacctgttgtgttaggtgttggtgctagaagtggtgagattttggttaaacctgatactaataaaactgtgtttaaatctgctggtatcatatctactatgaatgcatcttcttcaaaatccaatgttgtgcatgcaaaatctcctgatgttgctcatgttgctaaatctactagtgctaccaatgtgtctaatcatcgtgaaaaatatacttgttcttttttggggcaaagatggacatattgtggtttttgtttcagattagctcataaccacacaaaggagagagaattgcctttacaaaatcaaagtggcaaatatctggttttccctcgaggaaaccggacagaccaaattgggtcccgcggtcggacccgtgacctatcaaaccggctgaacagcctcggtcagaccgaccaccagtcagactagcggtgatgcctcggtcatacctgcccccggatagaccggctgcacaccctcagtcagaccggcctcggaggaatttttccataaattctaaaattgattttgcacgtggatatatgcctattggatcttctggtcgtgtgtctcagtactggattcctaaatttttattatcatctaacccaagtactgaggcttcgacttctgcttgtgtgtaggctttggtgacaaagaaggagaacgtgtggatcgtggattccggttgttcgcagcacatgaccggtgataaaaattggttctcctccctaaagaaggcatctaagactgaatcgattatctttggtgatg

SEQ ID NO: 31118 - DNA, 21103 bp, Oryza sativa
  unsure (1)..(21103): unsure at all n locations
tactagaaacaaaccctggaacagaatcatgcagatttttattagaaaccagcaacatgcatttagtttacagaaaagtagcatcagacagacggtcaaagagagagaaattgaatgagcacaaattgaaaaacacaagcagaagtgcaaacacaaatacaccaccataagacattcaaacagacacatgattgaactagttaatactatgtagatggacaaataacctgatgaaagtgtggagataataggaaagtgaatgaaataaattaacttcgaaaactcagggttcacacttaccttgcagagagtggaatgcatagaacatgacatatgtggaataaataaaggaggtgctaaaagatctatcagtaatttctccacaagccattttgttcccatcatttccttattctttttatgtaactttttgtgcattttctcaacccaaccaggacaatcaaatgaattatgtccacaaatgcccgatgaactacttgaaggtaccacgtatcaatgcatggtgaatggtataatggtagtgctgagctactaaaaccacatatgagttatctcatttgtctcttcttcccagtattatcggaaacggacaagcgagttggctcatgtgtgtgatttcggaaagagaaacggcatgcaagatactactcagaagacgacaaggttgctgaatccgagtacgttttagatttggggtgctcaattcggcaaaaaacaattggccacatttttcaggtaacactgcttctttcaccagacaaacttaaccactacaattcttgatcagcacggcaagttcactggaaccaaatatactgatatgctggaaacaaactaagcaaaggatgcccaggtaggattgaaatctgcctaaggccagaactaataaccaccttttcctattagagctgatgagaagacagctcattctgcagtggcatcgttaataattaccaatttcctacagggttacataccacattagccctagacaccaataatacacatcagatggaaattttattaaattattcattcagccacccttccagtggttagaacattgcattattaattggatgccatatttgtaaatcaaacatgtatcctatgaacacaagggcagaatgtgaggcaactgattaaatgtgacaagttcataaccacttcaaagtctgcactagactaaacagaatagcatggaagaacagcatgcaaaaattatttgcatgggcacactgcttcactcatgccggtagctcacgcggtcatgtcctcgcaccactccaattcaggatgcatgccaaagaagctcgaccaatcatcaatcgcatctttatccctagcactgtcctaaatccacacaactcctacagcactgaaacatcaatcttgcctatacctacaagtactacgccaatgattgaacacagtaaaacttcaattgcaatcatgacgctacaaaattggacattattcctaattgatatgctaccgcaacctcgaatacacgcagttagctaatcgcaacaagctgttaatcaactaacatgttctcctccaactaacggaaagagtaacacaccgtggtctttggcaaagctcaagaagccgcagaattcagcgagaaaaaaaaaatcagacgaacaaccgaatcaaacgaatcaggcgcagcaatcacagctaaaaacgagaggagctagttcttcttccccctcacctcacagtaaacgctactatcaaagttgaccaaccaagaaagggaacccaacccaagctccctccagattcagagccggcaacccaccaaagaaccagccaccaaacccacccaaatccccaaccctgaaccgccccccgagggcggagcaaccaccagcgaaagaagaagagatcacaccgagtccaatccatccatccacccacgagagattccgggcacagatcggagcaaaaagcagcgaactttcggggagggagggcgagagggcgccgaatccggcgtcaagatcgcaccttttcgcgtgccccggcgccggggaagaagagaaagccggcggcggcggcgaaagaaatcgcggcgaggatgggatgtaagaggaggagcagtagcactggcagcacatgcagcacagcgtgtgtgagctggtgtggtctcccgcggtgcccttaaatacaccagctttgctagttgctactgctacagaagagagccagccacatggtcgtcgatgcggcagattcctctatcgtctactctatctttatctatctccgtgtgttcgtcgtcagaacgcgcgtgttagaagaagagggggggaaaaggcgtgtgcttttctctcctggttgtagcttttccttttttaattaagttaattgattgattgacagaggagcaaatgccatgtgccaatgtatgtgtgtttgtttatcaggaggatgtagagggttgtttctataattttttttatttataaaagtattatatttattacattcgtattataaccatattataagtagcggaactcaaaactatgtatatagtttgtaaatgcgagaagtcaaggtgttgctaggagtaagggtgtgtttttttaaagttataggtagattttcggcgacacgtgaaatacaagaaaccgcatatgattaattagtattaattattgcaaatttaaaaattagatttttttgatttttttaaaaaagaacttttacataaaaaaatttatgtgctaacggagatggtttgaagttgatgaaaataacgcaggataagctagtgggctgggttcctacccgggttgctcaacagcttcaaaattaaattctggactgaattatgttgcttctttctcaatactaatatttttggtattttacattttgtctgatgtagtttatgggcgtcatcatttaaaatatttataaatatcattgcagctcgttgcgtgagtctgaaaagttggttccactctaacgtggcttatgttaaggtaaaaattaatctaacaatatgaaggtttagaaggttcaaaatttctagggtataatttgacatcagggaggtataaaattaaattatatcagttcttatggcatgatttacacacgtggcatggatagattcaatgcatttgattgattcatccgacttttgacttagcttctatcaaaacaacaatattgaattggtcaaattataggagattgggccatcaaggatccacgttgactgacaaggcttagaccgatacctcaagagaacatattggtaattaaagatcatttatgcatttctagagcctttcttgtatggataggtcaatgtcaaacatttagatgataatggtattagggtgtgcaccaccatatgatagaatgtgaaggaaaaaagtttcacaaaaacgggtcatacagattcaaagttgaaatggactcatgatgtccaaaatgctcattttaattaaattgcggtaaccgatatatataattaaatggttatggagattactgttacacattgatcatatcctctaaatgccattttaacattttcatgatatgatatttgttatatgcttagaaattacggagatttactgtaatagaacctacaaaagagttgaaggtaagatgatatgggtaacatttagacgacgccttttattttaataccaatttaatatgtacacatgtaactctaacatatatatacctgtagcgtattacaaatactatacaacatatggttgtaataataacctaaaatatttctggtgtttcgatataacgatgcaataaaatagagtgagaggggagacaggggaattaatagaagaaagaatatatggtcttgatggctgtgtaccaaaattcctgtgaaatcgtaggacagagagggagatgtaatgggttggtgtgtgagggtgaggtggcaggctgagccgttggtgagggaggaggtaaccacaccggcgctggcacccggttttaatttgactgaccaaacgcgccgtcgggtcgggtcggctttgcattgcattggttggttcacatcacatgccactgccctgctgtccctgcccctccaattcttctcctcctttttcttttcttttgtttggaacacaatcaaaacgaaaagttcctccaattctttaattttagtccatagatgtgataacacaaaaatacattatattcagcctctttaagattatggtttttatttaagggaagatattctgcgtatataagttttgggtgtacttatgaatgttattaaagttttagaaaaaaattatacatatactttcaatagtattatagcctcatcttcagtagttatagttggcttctgaactttagttatactttggcggagtatatcattgtctttctttcttcagactgaatttggtaggtttgacatttttttaacaaacaaaaactagttcttccactcttgccagcctctacattttctgtaggagaaaaaaagtacagattgtgttagtttagttagttgcatgcttggatggtagaacaaacaaacacctaataggatgaaactattctgaaatgatcatcatagggatgaaaggaatagacagccatgagttggaggagacgcgcggcacatccaatccaatcatgatttgcatgtgggttagctctcctggctctgaattttttaatctcatttaattttcactctgcaaacaagcttgaagagaatgtcttatgatcagcttagattctgtttaagctgacggagattattgtgattgaatcttttgtatgcactattattcagaaaatccaaactcctcttggttgtcagtctcttgtagattgttggaattttgggttgtgtggacgtttcctgggaacaaaatcaggtgtttgatactccaaatgaatgcgaccgacaaattgagaatgcactactccgtattatctttttgtgtagctctgaatcaattgacagagtgagaatatcttctacactctttactgacatattgttgatcagacatggtctacaatatgtgaaaagtttcttactacatcagatcatttcttgaggatatatatgatgaaaagtagaaaaccactaactgttcagttgttcctgcaaatctatgaacttgttcttgataatcttctcctcttatgtccttgcaccttttgtgtatgcaagcgtgccagttaagctctacttaatttttttcacccaatgcttgcttgcacacgcataaagttaattcttcttttgcctttttgtgttagtacactaatgctagtaagatcattgctgtcaatttcatggtatgcttgtgagaccagtaactttaaatctctcatgtcatgtcctcacatgggcatttcggaaccaggatatcactggattaattcacacaaaaggagagcccgctatgtcaaataatttgtgaatacaacatgacatgttcttcactatctaaaagtaatggctttaaaaataaacttctatgaaaaaccccccaaaatcaactctaaatttaaggttgaaaattcaaattggttgataagcataagcgaaaagatgaggttgtaatttgtttgagatccatttttttaacactattaaatggcaagttcagcttattgtgctggattgcaacctgaaatccgactgcatgttcggcccaaagacagtcttgtgctttctatggcctatggacatgaattaggctgtgcccaacatgaggagcagcagcagacgactgataaaatctttcgcaaatcatcatggttggcaactgtcatgaggcctaaggcagacttaactgtcatagatattctaagatatttgagcaaagattaggaaagacaagattaagtgacaggccaaagcaggcctaagaaggttcagatagctcagcatggttggtaaaccaaaagcatcttctttaaactccaagctagtagcatgacaagttggattgccagcgacttggacaaccgattttatgggatgcattctgagctgtcagtgaaatcgacagcttaccttggatgcactctgagctgctagtgacatctaaaccctccttatttagtttgatcaccaaccaccatcagacttctaacattcaacatgtgtacagcatcaatcaacaagtctcagttggaatagcaaaagcaagagtcctaaagggcgtggtatcatcatggaccaacaaacatgttgcatgctcaacttcaaaaggcacaaaggtcacttccagcttcagcaaacacatgaactgagcactcacagatcaccagggaaccatatagggatagaataaccaaaacataggaggtttcatttcttcttctcaaagtagtgtagcatctttccttctttcaccattacataagcttaagcaataacagataacaaatcctcctcctcctctaggtaaaatattcaaacacaatacccttataagtacttattattaggaaagtagcgtgcatgggcataaatggcagcggggggcaggttaagaatcacaatgctgagcagcgaggaaacaaaacaccataatgggacagagcaaaagcctccgaaagggagcttttaggcagaaggcttctcccacttgaggggcttcaccacctcccaggtgaagtctgggtcgtcccttccgaagtgaccgtaagccgccgtcttgaggtagcgtccgttgccgcctttcttgaggtcaaggttgatgatgatcatgccaggcctgaagtcgaagttctccttcacaatcttgaggatctccttgtcagggatcctgccagtgccgtatgtgtcgacgaatacggacagtggctctgggacaccgatggcgtatgatacttggacaatgcagcggcgagcaaggccactagcaacaatgctcttggcagcttgccttgcgacgtatgctccactgcggtcaaccttggttgggtccttgccagagaaggcaccaccaccgtgagctccccagccaccataagtgtcaatgatgatcttccggccagtgagaccagcatcaccatgaggtccgccaatgacgaagcgaccagatgggttaagatggaagattgtcttctcatcaaggtactgctcgggaatgacaggcttgatgacatgctccttcaggtcagcagcaatctaatggtggggaccgtcttataaggtgggtagagatgaggacggtgtggacacggacagggaccctggcaccgctctcattgcggtactcaacagtcacttgggtcttcccgtcaggcttgagccatgcgcaggtcccattcttgcgaacctccgtaagacgagcgcccaagtttggtagcaaaggacatggtgaggggcatcaaatcaggggtctcatcagttgcatatccaaacatgtgtccctggtcaccagcaccaatctcctcagggcgcttggtgaagtggccggtgcacaccctgtgcaatgtcaggggactgctgctcgatgttcacaagcaccttgcagtggtcagcatcgagaccgacatcagctgacacaaaaccgatgttacggcatgtctccctgacaatcttctcatagtcaacgttagccttggtggtgatctcaccaaagaccatgaccatgtttgtcttggtgcaggtctcacaagcgaccttgctgtcagggtcctcggcgaggcaggcatcaagcacagcatctgagacttggtcgcagagcttgtcagggtggccctcgttcacagactccgaggtaaagaggaaggtatcaagtgcggccatcttctcctatctgcataaaatggtatttcacatactttagacaaagaaatatcatgaataaaatggacatggtgagcctatgagaaaaaaaggggtataagtgatagctaatgtgagggaagctgatagcgacaattgatttctggaaatgcttacataacacactgagaggacaatactgatccctagaacaaatggtttatgcaacaaaatttgtcctgagtaaacaggttaaaaaaacagtagcaaggaacaaaacattccttttaatcctctatatagcttatgtacgccaagatgctgttttgttggcacctgacaagaccacaattttgggctaaaatagttgtccctacaaagagttgactaagttcctaagttccttgggcaagtgttaggtatttgtaatattctctacaagcgcaacaagcaggtatagagcacaaggaatctaacaattttctgccggaatcagcataaacgcataatcaatcgtggtgccactatgtattgtaactatcacataaatataccacttttaggggtaaacatatcatggagacctggaaaaaaagagcgaaatcgctggctagcttttaggggttctactatactctttacatgtaatctttccacaaagacaaacatcataaatcattgaacatgcgcatcaactaatcaagagcataaaacaacagcagaaacatatcaattcgtcttggcatatttaactttgaagtggcaccaatcaatttttttttccattttccgttcatttataagaattccaactcccaagaccaaggggatgactcgaatctaccgcagaacagtcaaatgagctgacagccaaagacataatactagcactaaaaccactgctctagcatgttgtttatcagcaagccgtttgataagcatcaaggtattaaacatctaaaaggaagtcatcctactgcttctctctccatctccatccataataataagcaagcatgacaaaaataaaacttacaacacctaaatccaaccaaagaaaccccatctaaatctaccataccacaagatcgaaagaaaagcaataaaccctccttataaccctcccaaaccagcacaaacaaatcaatatctaggcacgatgatacgtccgcaagacaaccaaccacgagctcagatccaacctgagagcttgatcctaccaagaacgctaaaaccctcctctcccttttcaagccgcaagaatgaagggagaagccggacagcagcagcagcagcagcagcaacacacacgcgacaacgctaccagcaacgaggacaggggaatcggcggctcacctgcggcggcggtggcggcggcggaggaggaggagccgggccgatccgatcggggggaggaggaggaggtggaggaggtaaattaattagatccgaccgggcacggcgagatgggccttggtctcgcgcggcccatttataggccccccctcaccacgggaggcgggtgggcgcggccgcacgatgggattcggtcgggatcggacggtgggcgccgcgcgacgtggggagggaggagttgggtggcggacagcgacccgcacccaccaacacacgcgcacacactgacactgacgaggtgggccccacctccgggcggccgctcgcccgccaccaaccgccggtgggccccccctgcactggccgtggtgctgtctgcggccgcctcgtccacgcgtgattcggtcagggactttcttttcatttcgcctaatttaattcgatttttatttttcatttagacactgttgaaatatattttttttcacagactattgagacggattgtttaattgattaataaaaaaatatattttagaaaataaacttcagaaataacttcatatagtagaagaaaatattttaggaagtaaatatttttataagcgtgaaactaatccatgacccaaaatttggggaaaaaaaggggggggtgctgttttggttaagcgagagtgcatctccaccggttcataataaaaaagacaagaaaagagtgcttctctaccggttcaaaaaataaaaaaacatgagaaagtgcagctctaccggaaggtttgagagctggtgataatgcagtacgatttgagtcagagctagagagtcaacttctcataaacagggggagcatgacaaggtccaagttgctccttcgcctttcttactactagtgcctcttgccttgtcgcctttcataaattatcacggctacatattttcttcatctaaaaatataagtcatattttgtatctttaaaacaaaactttgacggaggatgttgcatataacaataatgtgaaaagtaatgggaattgtactagcaacactacttgaagtcaatatgccccttattccttagcatataggccgagtttagttccaaacttttttatttaattaaatattttctacacatacaaacttccaacttttccatcacatcgtgccaatttcaaccaaacttctatttttggtgtgaactaaacacacccataagcgttcttggataaccaagtctagaagaactactacaccccatcacgacactggtacttctcatggcgtgtagtcaaccatcaatgccgaacagcgcgacaaggtcgaggtttgtcgggtttgcagaaatgtatcttatgtgaccaacacgagaaaacaatcgaccacattctaatccggtgtccaaagacgctccagctatggtggatgatggtcttgcgtggtattggccggcctcaccgctttcaggcaaacaagcaatccttcctcctctcatggtgtcatagccgggaaaaaagcgcaacggctagaagacgaggattggacactgtcgatattctaaagcctagacaatttgaaaggagcaaaataaccgagtgttcagcggtggttgcaaaaccatactgaaagtggcggagctagagggaagcaagagtgccaatctaggcccacttggtcgccaaatgaactgcaagacgtcgacctatgtgtatatagttgatttttctttttctccttttatatggttgctgcgcccgtgtgaaacatctaatttctgattttaatacgaagatacggactttgcgtattaaaaaaaaattgggcatgacaagcagcgaaaagttcctataattcacggcagatggtaatctcgcattttcaggatgagttgcataagcatttaaaacacctaagatgatcataatttagcttgggaataaggacagaggactctgtccacttgaaaatgttgatataggtctacatctccatttaaactggagacaggtgtaggcaccactaaatatcgcatctgtgaaggttgtgtcgtacatagtataaattggtgctgagatcttgcacatgcatccgatcctacattccagatgcccccttagttggtgacaagcactgcaattgccagcctacgtaccacaaatcgaattgtctctctaatatttttcaaagttattttgatgacaattcattcatatcgtgttactacatgaactaaaattatgtgttatcttgacaaattcccaactcttaatttatttgtgtttgcttgatttactcttatctgtttagctaatctagggtctgagagaagaaaatataatctgacttttctactccattcatgcatgatttgttagtcatccattcctgtcaactcatttgtcatggatcaatctacaccatcacgtgtttcacgaggcagcatgaattccactaatcccctttctgccgatcgagcttggcannnnnnnnnnnnnnnnnnnnnnnnnngaaaattccattgattgctccatcaggttactgattattttttatatatgcttatcttctgttttgacattgtctatagtttggttgctacaatttctgtaataattggccttaacttctgctgaagcaaagactgggtttactcgttatctaaaaaaataaaaataatcaggctatcgatcagcggcaaaatgcttctcacaatccgttgctagttactactgaaattcagagaaagaacagcagaacagcagtggcgatgcattcagacgccagcaggaggtccagcaactggaactgatgatgctggtgaaagatcccggaatccacctgattataatctggagttttggaatcataattatacagatgacatgacgccacgtgtgcatccaccagattatgtggagtgagtcattgtgcatctcaactaccaactctcatcaatcttggctgcaaattgaccataaacgaatgcatgattggagaagaaaaaatgttgcaggcgtcagcccaagatgacggaccggcaatattcagtttcagtttctctgaacattgttttctttcccaccttgtgcaatgatccacatgtaaactgcctcaaaaagaatcatcaaagcagctactacttgaatttctactgttctatcagagaaagattactgcatctatatatatatatatatcagctccaggctgtgcatgtaaaaatgtttgaaatcaacaattatatgctaattttggggttttattgggagagtagtgggctttgcccccttcccgctggttggagtcgtagtttctgagtctttttttcctttggtcttttgtttcccacctctcttggtataagtcggtctggcttaatgcgttatgtaacaaatatttttttattctaatatattgacgtgtaatttttttttgtgcgtttgagaaaaaaaagttcagacttgaagctggcgatgccttttctgaagtcgtctccaagctaaggtaatcagtctggtgtggtgactggtgttgcgtagctgagttaggtagcatcatagaaaagtacactgaactgattaaccaacaaacagcgagttcacctaccaaaccaaaccaaaccaattcagatattcagagaagctggcaaaaatggaccgaccttacatgaacgtccagcaagcaggcaaaaacaatctcaccttcttttcttttttaaaaaaaagaaatcaaaggctttccatgcatggatgaatcaattagaaaggcaacaagtgatgaacactaccaaagaaagcttcagcatacatcagcattcagaaaattcagagaaggagggttttgctagagttggagcaggagctccaagagatcctcctccaacccactctcacctactgcatattcattacccctgtcttattcaatatcactcaaaactaatcaagaaagctaattaagtatttctgtcttaatcatttcactcaaaactgaaccacttggtagttggtactcccatttgtcacttgcatacaagaagcccaaacagtggcatttttcctgggctgttcttggtttggggtccagtggaagaggtgtcactggatcaatcacccaccagggcccatctgaaggcccaatctctcatggccctagtagtttcccgtggatcgggccaagattccagtttgaagtggaccagataaggcctccaaatgacatgggcttcatatcggcccatttactcttatggtcggtatctgttcaatatgtgggccacaccagaaagaggtctaaaaggctcttagtatgtgggccaacccatttacgtgattgtctaggcccaaccaagttcttgctgctttttccttctttatttctttgattctctctctatgctcttctttcataaagagctgccccttttatttaaagcactgcagtagaaacaaaataccgtgcagttaaacttaaactagaaattatgataccttctaaacttacacggtacacaaatgatctcttcagaggagaggaaaaaaaattaaaagatacgcaaaacgatattagtcattacgtatgattaatatagtattaattattttaaactttaaaaataaattaataggatcatttaaaatatatttttctgtttttaaaacacacatggtttataattaaggatcaaaatatagtgttacattcttcagagaccaaaggaatttgtgtgcagatctgtagaagttcatacgtactagagataaaccaaaggaatgacaaattacagcaaaaataatctctctttaattttccaggccaaaaatctctctagctaatttgtgaaaaatacgacagcgaatgcgatgcatcgaaatatcaacggaggagtgtgtcttcagccttcacggtggtctgggcttttcaattgcgatgtatctgattttatatatgtcgggttgtgcaaaatttcaattatttcatcggtgaaagctagactgaataacaagctagcttagcatatggttggtggccaggagcttttcttcagtagtagtacgtacgtgctcaaggttcttcgttgacaggagaaaagatttttctaaatggagatcgacgctgcaagaaaaagtgacatccgacctgttattcttgattaatcacccattagatcgcatcgtcgattcttctttagtttatttaacacgtagtgcagtgatgatcatgataaatttggcacataattaagtatgtattatgtcaaatcatagctgaatgcatgtatatagctgatggggcagttcagaaatggtattgctgaagctaccaacttagtgcaattccagagaggtaacttgttgtcatgcacacaaagagtcacatctgaatggttaattatgttttctatcggtatcaaagagagagatggtagtttttgaagttcactttttatttttcttatatatccctatagataataaccatggcaaactcatgagagagtaccgtttcctttcaaatctaataactattttctaggtaaaatctgttgaagtatgtaggttgttggatcaaaatcacctcacatcctaccttttctatagtcatcggtcctactcgaagtcgaagtctgatgaccattagctggcctcacttattggtcatcgatatttatcatatttcactatcgttttaattactcccaccgttctataatataagttgttttgagttttttctagtcaaacttatttaagagtttactaaatttattaaaagaataacaatatttacaacaccaaattagtttcattaaatatgatattgtatatatttgatgatatgtttgttttgtgttgaaaatattgttatattcttttaaacttgatcaaattttaaaagtttgaaaaaaaatataagcaacttataatatgaaatggagggagtagcgggagtcatgacgtcgtgtatatataagtaggacgattatgttagctagtcctatattactttttcagataataagattaatcctttaatttatccacaggaagcaattgcacctgaattcaggctgtaattaacaagatcggtcactcattcagtaatgccagatcatgtttaaaatgtggagctgaaacagcaagcaacttataatctgtaccattttcgcaacgaaaaagaaggaagaaccaccattatattgttgatatattggggaatttggtggctagtgctttgtcaacaggtcgaatctgatggccaattaggtgaaaggcagcgtgttcgggcttccacatccaaaggatttcaaaattcaaccgatttttaaatttccaatcaaataattaatgtggtacctagctagaaatgaaagaatcaaatgaaatctttaccaaaataaaacatgaatagcacacattttactccttgaataaattcacccatatatatggtcagaagcacaatttatttttgcccaattggcacactcagcatcaaaaggtaaaaaatgaaactgaaaataaaaataaacaaaagttgttgtagtagtagtagtacattgaatcatgcacaaacatataaggaaaaataaatcaaatgagcctcatgcatgcatggcaacagggcagtagtgtttgtatatatgagaatcacaaacttcacgcgaatttaatttgagttaattagttgatcctggagcagttgagcctgatctccccctcgccgccggtgagcacgtcgagcttgctgaccttgaccagcgcggcggcgaagcgggcgagccaggctgcggggtcgccggcggcgtagagcctgacgagcgccgccgtctccggcgtgtcgaggagggccacgtcggaggcgaacgtgacgttcccggcgagcacgttcctgtagtactggttgtccatcttgaacggcgtcacgtcgtcgagctgcaccatcgtcgcgtcctgctgcgccgccgtctccggcgggcacttgctcttcatgtccgccgcgtacgccgccggcatcgacgggtccgtgccgtacgtgccgtagtacttgtacagccggtttgtgaacgatgagcagtgagacgtgccgatagagtgcgcccccgacagcgtcaccatctcctccgccgtaaaacctaagtaatcgtatatcattaatatggtattagaggatatttctttgttggttgtatgtcatctaaatagttactaaattttttaaaaaattgacaagataatttaatataaaatatagatatctaaaatatatcactctataaacataaaagtcaaattcgactctacgagttacaaccaaaagaacaaattaaattgaaaataattattgaacatttgcagttatatttaatacaacttgtaaaagttaaattttaacttgtatgtttatagagtgatatatattatattaatctatcttgttaatttttttcatacttttataactatttaagtggcaatcataaacgttgggatatcctctcgagggataaaaacactttccgtatatcagagctaaacaactctcactatcttgcattcataactcgctctatgatgatttatgggacatcggtatgagggagagcattaacaagactttagataaactggcaagtgcatatgatgaccccatgaaattgttaccgatgatatgcgtatctatgtagtacaagtatataatatgtacctttagcggtgaagtttttgaggaggtctttggcaccgaactccgggtgagggacgttggagaggacctcatcctccttagagacgaagccatcacgacgacctgttgggatctcgaagtcgagcccaccagcaaggtaggcgctatcacgagccacgagagagaggatgtcggcgcaagagacggtgtgtggacactccttctcgaggaggtccttggcatcatcgacgacgtcaaacccatccaagctagggttgttcgccttgttgtccctctccgccttgttccctggtgtcgactccagcaacaccgatgcgtcacatccctagagagtcatatatagctgcctagttagaacacatggcacgatatggtgcgtcaacataagctaagtacacgtggcacgacatggtgcgtccacgtaagcacaaagctgcctagtgagcacacgtggcacggacacgatgcatccacgtaagcggggtgctatacttacgcggacgaagcagtcgtggaagaagaggcggatgaggtcggccggcgtgccgggcgccttctcgaacgccttggtcaccgtgtcccggacgatcgcctccgccttggggcacgattcggcgtagaacccgacggacaacccgccggccgcctccaccttcatctccggcgccgacgacatcatcatcagcatccctaatagtgccgcagcggccatcggcacatgcagagacgacggcgccggcgacgagactgccattgcttatcttatcgtcgccgtgcagagatcgagatcgaaggaactctctcagctacctgctagctaagctgtctagtgaaatggctgtgagatgttggaaaggacaagaggtatatatatagacaaatggttagcttgcatttgatagttcatggtgccatggcgatggagcgccattgattggtagaaaggtagctgccacgtgaacaattcgtttccttgtgcgagatcgatcgctatatcggttgttggagaaaggaccaatgcatatgtgcatggatggtccacacacgccggatggtgtgctgggcatatctgcgaaacaaagctgccatccagagctagctagctgaactctcaagctattaattgattttaattgtaggtaacttgttctgaattctgaaactaatttattgtttcaaagggatctcgacaactgtattctatgaatattaattctctctcaagaaaaacagctctagaggagaggacactctatggtacaattagctttctatgtgttcttttttccattctaaatagttgaatgaatgaatagctgaacgatctatgataaaatttgagagtacagacgaattaattaaatattatatttttgaaagatggatttaaaataattttaaaataaattcatatatatatataaagtttttacgaaatctgcaccgtataggagttcggaatgtataccgctgaattaaatagttcaattccttttttttctttaaaaaagaacacgctagcttatcatggtttaggctctcttaatttgccacaactccagatctaaatgcacattcgatttgaagtttgtatattaaactataatgatttaaaattttatatttcatttaagatagaaggggaaaaaaaaatccaaatagcccttaattataagtcagctgtttttctactcttctcactttcgtacatataaaggccctctacaagttcagtttctctttttaattttccctcttctgctagttttcattgatttatcaccgttggttcaactcctcgactcctcatgccgcctagcttccaacatagcgagatgaggtatccccatgccgtatcaacaagggagaatacctcttgtcaactagggatatcacactgagttgtagatgttccgaatagccgtgttgtgttttctgttgaggtttattgtcgccgtcgctgcgctcgtggaaggtagaaggaaccccacccttatcaagatgacatggccagggcaactccatttctccatgttggatgcccacatggcacaagaacctgagcaaacaatgatgaattgtggaaaattagcaacatgcagaactttggaagagaaatctaatttgcagagggtcttttgtatcagagtgggttgcagggggagtgtaaaaaaatagtgacttataagggggttatttgaattttcccaaaaaaataaagaaaacaatgttccatccagaacgtaatcgcatattcatatatatccatgaattttgaagttgtaatacaccggtccaaaaaatttttagattcggagccgtgtcaaacataacattaatttctgaagttcaacttctaaatctggcaattattgaaaagtaatttttcatcaagacataattgagcagataactaaaaggtagaatattttgaaaaagtagaatctatgaactagcgcagtacagaagaatgtcagggtgacaatggatgtagtgcaaggtgtcaccaacttgtcgatcgatagagcccaacccctctgcgagaattgccccggaaatatcttgcttttccttttctttttttcgttttcgtaacaagcagagccagcacagcatgcacttgcttttacttaaatcaaattgactccttgatcaatctatatattttctggcctgctggttggtgctccatgtccgtcatatcttgctttattttatgcttccttctaaagtgcagggactgagttgaaaggcatgtagtatgcacgtagcttgcttgtagtaacctgcattgttttgtttttaaaaaaatagaaatgtgacccccttggtcttggaatattgttaatgactaacctattaaacatgaaacctgtacgttaataccataccgtctgcataaaactatctcggcatatgtattgatgtagtacatactcgtaggccatttacgtgaatggtttacagttcacatggaagtatgtaaccatcgacaccattgaagaaaccatcggcaattgattttttttgttctctacatgccgcgtaggctatttggttatttcacagctgaccttggtttgtattagtgacttgtagtccgctaactaaaatggtatagggaccttaacaattatttatttctttctttttaattataaaatgtggctctaataagcaattaagcatagtatctcagtcacacaatcgaacatacatcatagacttggattgtatgcaatactcaaggaaacagtgttgttccctgaaaaaaagaaggaacagtattgttgacgagataggttgaacttaattgtaagtaccataaaactttatgaagatccatccatgcacaaacatattgttgtgatcatctctagttggctttgacttctaagtccggatcgttacggtcttatatatatggaccgtttattacacatagacacaggcacacaatacacataaaagtcgtattcatagttgtgagatactacaaatcatccgatgatttggttgcattctataactatggtgtaaaaacatatatatactccttatctcaacatcagcgtctaataataatccactccattcctcaactacaccacgctcagatccacattgatcttgtatttgtacccatctacatctcctttctggtaccgacattgtctcatatttcttgtccatatacatgattcgtgccatcgaaacagatgcaaccaaatatccacacctttgtcatcctagtcacaaaagcctcgcccatttccgcttcccttttcacgctctgacagcaccaactcaaccatccatgacttaaaatccgatatacttttggattccactcgaattgttctccaggatttgtgcaaattgtaaggctcctcctgtagctagccctgttaagtgtgtcaccatcattggcatgctccataagcggcaaatgcgttcatctggtgatgtgttcttttcatatggaaggaaagcttggaacataatagaaccatacgaaaagacgatagatatcgagctcaaacagaggtgacacattgggtgtcaacgacactagtagctagggttaacttgcaacttgaggaagctagctagctagaaaaaaaagagagaaaaaatgtctctatatatctaaccttgtatggccgagtttagttccaaaatttttcttctaacttccaacttttccatcacatcaaagctttcttacacacaca

SEQ ID NO: 31119 - DNA, 16566 bp, Oryza sativa
catgcttaattgatcgatgccactaaatcaagatccaccataattagggagatagtataaagctaaaatgcaccaatcatatatcaccaaactgcagttgagtgcatgcatgatcgatcgagctcgtcagttacacgcacaagaaatgggtctcagttcatcatcatctccacaggaggttcggtcgatcgatcgatcaaccacgcacacgcgttatcttacatcgatctcagatcatctatatatatgtaataatcgtatgttttgtactttggtctcacatgatgtaacaggacatgcttgtagcccagacaaaccatgagagggctctcgtgggtctcagacagaaatagaagtgtgtgtattttttaaaaaaaaattagaaaaaatgcccatacgttgcagtgggtgaaggctattttaattttattatttttattattgtaattcatcgtgggaattcgcttgggtttttttcttttacaaaatcatgaattgcaattaggagtctgatcatctcaatttagcatgcgttagtattaaattgcatgcatgctgggtgtaatctaattttagggatgcaagtgggttttttagcccgcttatctcactattctagttcattttttcttctaaattttgtaccaccatgtgagaaataaactagcaagcgggtttctatgcgggtagtgggactacccacttgcatccctttaatggaactaataataatatgtgccattgtattttagccacacaatatacatatttgtgttttgaaacgcgcattttgcaggcaaagtacggttagcacaatttatttactttctattttactcaaataatggccatgcaaatctttgctaattaatcatggatgaagatttagaaatagattttttgacaggaaacagtagtagagactcctactgtgaaaatatattaaaaatacaagaggttatttacaaagggaaacaaaaaatatttacaaaagatttacaaaaatattttaaaatgatttagaaatagatgcatgcttcctgatttttattttttcaagttttcatccattttatggtttgttttgttccttcatcttttctattgttatataagagcagatagttgtcctgcaaacttggtagtactagtaattactataacttctgttgaagtaaagtctgggatttcttgttatctaaaaaaattaactcaaatatccaggattcaaactccagatatgtaaatgatatacccttcagatttacatcagttatgtcattacagttcaagattatggatgagagcccagccaattcactgaacttccatagcccagtacatagctagcccttcctgccacgttacaattcattcggcccagattgatttactcgttgttatgtgggatttatagtcataagatgggccatggtatcaaaaaaaccattctacctttacaatatagcattttcctcatttctgatgtgaactaaaatcttctgtttttttagataacagtaaactaaaatattttctccactctgatttgaaacaatataagaaaatcttctcttgtttgagttaacaatagaatcttttcttaatcacaatttgccacacaaaacaacaacaaaaaaatttccacatgatgaaatttgggcgtgtaatattactaattctacatgtataaaccagctgcagatgaaattatatatatactataatataagcttaattattgattgacaactagtagtggttgttgaccatgaagcacttctctctgatctctccctcgtcacccgtgagcacgtcgatgttgcccatcttcaccatggcggcggcgaacttgacctggaacaccttctcgacggcggagtggagcttgacgacgccggcggtccacgggctgtcgagcagcgcctggtcggagttgagcaccaccctgtgcttgagcacgttcttgtagtactggttgtcaaagctcgccggcgtcaccgggtcgagcggcacggtggtggggtccatctggtcgtcggtcgctggcgggcaccggcgcttgagctccgccgcgtacgccgggtcgatggccgggtccgtcctgccggcctcgccgctgaagttgtagaggcgggcggtgaaggaggagcagtgggagcggccgatggtgtgggcgccggagagggtgaccatgtcgtcggcggtgaggcccttgcgctcgaagctggcgacgagctgggcgaggctgaaggtcggggcggggacgttgtcggcgagcacctcgtcggagacggagacgcggccgtcgcggcggccggaggggaccgggtagtcgacggtggcgccggcgaggtgggcggagtcgcgggcggcgaaggcgaggatgtcggcgcaggagacggtgcgcgggcagtgcgcctcgacgatggccttggcgtcgtccaccacctcgaaccctcgcatgctagggttgttcgccaccgaatccttctccgccacgtgtcccggcgtcgagtttatcagtatcgacccgtcacacccctgaaataatcaattaaattcagcacaattagtttaatttcgtccctctttataatatgagtcgtttttaattttttccatagtcaaaaattaatttttaatttaatcaaatttacagaaaaatataataaaactttcaacacgacacaatgatattatcaaaaatgtattcaacgttacatatatagtgaaactaatttggtgctgtagatgttgttctatttttctataaattagtttgactaaaacagagaaagtatcatctaatcatgactaattagaggccttaattaattacacgccattgacagcttcttcaagaatggcacgtgatatatgtgtacttactctgacgaagcagtcgtggaaatgcatgcggatgaggccggcggcgaggccggggtcacgggcgacggcgcggcggacggcgttgcggacgatctcctccgcctgcgggcaactgtgctcgtagaaccccaccttcagcttcgtcggcaccggcgacgccgccgccacggccaccatcgccgccgcccatgcaaacaccatccacggcgacctcatcatgatcaatcgatcgaagctagctagcttagctattgatcactatttatctcactatctagctagctagctcaattaattacttctctcttgaggttaattaattgagagatcgatggatggatttagattgattttgagatggaagacgatgatatggagtggagtggtatatatagggaggctaccaaaagatcgtagcagttgggagttggcgcgttttgcatgcgtcctcttcatgtttgcaattaaccgagtcaacaacacgactaaatctttgtagtagctaatgatctccattaattagacaagctaacaaacttgatttgtttgttaagaaagcgtgtcagacgcgtgcatgaacctgtccatggactttgggagaaactccaaagtttcgcgaatctcgaggagcgatggacggcttgatcttgattgatgatcatatattcatattagctgaatgtccgtgctttgctatggataaaagaaaattttaacataatatttttttcacatcttttttttttctatgggaaatgttcaccttaattctattttatatgtggctatccatttagatttgtttgcttcttaatattaaagaagttcaaagagtaatttgtaaattatattaaaataggtgaggtggtagattccaataaatatttccatgcaggtctatggatcaagaaaatttccaactttgggtcggctgcactgagaaagtgagaaagggatatgggtatgaatgcaaattgcatcgtgtcatatattactatatgcttggaatcgaaggaagaactagtaatagatagctgtacatcaattaggccgacaaaataagtacaaataatattgtaattgtgtgtcaccatcacctaatgttgctcagactttgtagtaacagatcgatcgatctacacacaatcatttgcgtaagaaggaattagaaatgggcaaagatgtgtgtgtagattacttgtaaaacattcttaacccacttaaagacagaaagcttttggttgagagatcaatataataaaatttgacaaggtcgatggggtgaccgggacaaagtcgtgtgagtttggaggatgacgcatgatgtatatatacatatgtttagtaagtgtacatttcgttttcctaagtttaccttttgtccctgaagttaattacctggtcaaatgatatctcatgatcatctagcttaattagtctaccaagtagctgcagatatatatgtaataaattagatgcatggggatcatggcgtcatgcatccaagaaagtctccaaaggcaactagaaaagtattttagtagtgtgtatgcatgctctctgcaatagttagttagttcactaggtgatatacgtacagattattgtcgttgcacagtttgatgaagttggtgaattaatttgaggctcccttttgactatatcttagcacaaatatacaactccaaaagtcaaatttaaacaatacgtactagtagaaatggtctgcctctaactctaaggttagcaaacaacttgtcctataacctatgtatatcttcctttcaaaacatagatataggcaatgtattttgggtggttaccaatttaccatgcatgaacatgtcttgcaaaaagttagctgcattgctgcaggtatgaaaatacaccgatttgcaaacattaaatttcttatgtaattaagtatggtagagaaagaaattaaatgtaaggcgataagtgaatgcacaattaatttacagggacgcgtttacttttgcagctgttgcatcgatcattcgcatagaactttttggtggggtaggtgtagaagtcaaaacatacacaataaactttttggtggaatacatgcttacatggtgtagagatgaatgtttcttgtttgtgttctttgtttttttccgtgttgaactttcatctccatgtctcgcatggtcaagttgtcttaattcgattttcagaggcgcaaacaactgattagttagcgtgttgggccggagtagcatttagaagtccattagacctagctgatcagagttttgttttgaatgggctacagaattgaacgtgccagcccgtacacgtggatgggccacaattttggcctatacaaacgaggccctaacgggctgatgtttttattcgctcggcccaactaggcccaattaggttggatctgctcatacgccgaattttttgtatttttagattttttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaaaggagaaggggaggagaagaaaagaagaggcgaagccctgccagtttcaaacttcgatttcaggtaatattcgtagattatatacgtgactaaatatatgataaatgcattgtatgaaatagagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagatatgtccagtaaacttatatttcaactataccatggtcaaggaaacgtccgttatgggccaactggggtagatctgtcagaatttattgtaacagcaaggggaattgataggccagccgagaggagtgtaccttctataaaaaaatggttgatgcggggcttgggagttgatccacagactagtgacattacaatctatgttgtagtaagtcgggcaacagagggtttttattgggaactaatgccggttcaaaactctgggatgtggagatggtatgtggagaatgcattgcaacgtgggtggcctctagctatggttccgtatgttcatccgaaggatccaagtgtacagatgaacatggatgatggcgaggggccaagtgcagaagtgaatgagattgaagtggatcaggtcaacgcaccagaggaagatggagtagctccagtagtagctccagtaggcatgcaacctggtggagtggctgacgagggggagactgtgggtgccattgtggacgaaatggaaaaagaggatagtgacaacgagcgtgtcgaggaagatgattcgtcagatgatgacgagaacaatattaatccagctgaatgggctagtgatgatttttctggtttggtcatctctgaaggggaaaatgtgagatgggagtacaaggaaaacgagattatcgagggagcgaggtatggtaatggagaagacatgaaggaggcggtgaagcattatgcagtgtcacttcatagggagttttgggttgccaagtctaaccggacacaatatgaagttaggtgtgttaatgaaaaagatgggtgtccgtggagagtgcacgcctataaggggaaatggaaggactactggacagtgtcggtcgttacgaaacatacttgttatctacctggtgttcaaaaataccacaggaacattacatgtgcatttgttgcatctgagatgtatgcgcatgtcgtggacaatctggcatatgaaccgaagtcaataatccgacatatcgaacagactttcaagtatacaattagctatgccaaggcgtggagggccaaacagaaaataatagagatgagatttggaacttatgaagcctcatatgacaatttgccacgtctgctatctgttatccaacaaagaaaccctgggacctcttgtgcactcaagacattcccctcaattgaacatcctggcaagactgtgctgcaaagagcgttcttagctctacatgcatgcaagatggcattcgtgcactgtcgtccagttctttgtattgatggcacatttttgaccgggaagtatcggggccagatactaacggcaattggggtagatgggaacaatcaggtattgccgttggcatttgcttttgtcgagagcgagaacaccgacagctggtactggttcctccatctggttaagacagaagttgttggtatgaggcccaatgtgtgtctaatacatgacaggcacgccggtatgcttcgagcgatagaagagttaaagtttgggactatggaaagaggataccctggccagtgggaagatgtacaaagcaggtggtgcatgcgtcatatgggagctaatttcttcaagcaatttaagaacaaggagttgatgaacatgttcaagaggctatgcaatcagaaccaggagaaaaaattcaatgagctttggaagagattagatgagttgacaggcaaatgtagtgaccagcgtgcaacaagaccagcggccgctgtacctgaccctcctcaagcactcggagctctcccaacagacagtgtaacattggttagaagaactggggagcaaattcgaaaattttctcagtggattgagaatgagccaaaagagaaatgggctaagacttatgacacaggtggtgctagatatggtataatgacaacaaatttggccgaagtttacaactgggtgatgcgcggtgtccgtggactcccactagttggtatactggatgactacggttccgatggtgttcgacatctgtgtcgagccgcacgcaccttaccgcgtgatgcggcagttcggcttccgtcagtcctttccagtcccgtttccggcgggcgtcacggctgccgttcaccggtaagccgttttactacgatttaatatgttgcattaacatcgggctgtccataataatttgctttgtttgtcgtttgccctaatacaatacattaatttgcaggtactcgcgcaagggtcagcactcagctggtcactggcctgccaagttggggccttttctcgacgactggttgcttgctaccgaggaggtcgtggaccacgcgggagagccacacacggaggaggggtatgaggcgtacctacgttggtatcagccacgcacccgtactagagtcacctacgctccgacggagcaacaggcccacgccgcgagcgccagagacctctacgccaggcaccgcgaccaggacttcgctcgtgcggtgagtaccttgcatcgcaccatcgtctcatcatcctttctgttggacaaaggctacgaatatttacgttgtaattaaccgtgcaggccgttgagtgcaacagggtcgtcgttgatgctacaacggcgatccaacggttaggcgcggggattgaggtgggggcagacgagcacctgtcgacgtacacgcggatacgggactcgatgcgctcggttctccgtgcgctgacctgtcgtgctgccgacgttgctcaggcagacgcagcaccacaggtgcgtccccgaccgactgctcctcgtccagctgcgcacgttcctacgccgacaccccctcccttcggaggtacgtatattcaaggtctatttgtacatcatcaatcaattgatactcaatttatgtgtaagcttacaagtgtcgcgtcgtcgatgtgtaggcttcgctcagcctgggacgacgccgggcgcccactcctggcaggctgcggggtcatcgtcacaggcaggtgtgtcggcctcgctgtctgcgcagttctggcaggacgccgggacttcgtcacagccgcccggcacgtcttggcagggtcctaccgggacttcgtccgagcacgggtgggcttccgccacgcacttcgacattagtgacttcgacttcccggacattatcggtccctcacagcttggaggcgcaccgccggtgcacacgcaggagcagtcgccctccaccccactcccagaccctcgcgctacccgtgctgtcccaccggatcgcttcacgtactcccaggaccacgtgcgagcacaggcccggaggaccaagcggggtcgcggcgcgagtcacggccagtagagcagacatctctttatttttctttacattcttgtactatatggttgtaaactgaatatgttgttgtttatattcgggactcgcattcctacacttcgctgttacgttttccaaaaacaggagtcctttccagccgttgtgcagagaggaagctgccgcccttgcagagggcggcaagccctcggctccccgcggcccgtgcgcgccgtcaagacgcacacggcgccgtgtgccacgtcggcttgccgcccttgcgaagggcggcagggtctagttttgcaaattttttcggcgctataatatttctgtaaatattaaaaaaaaaaatctaaaaacaaaaaaaactcctcatacgcctttgcactagggcctcctagctgggggttgctagttggcgcgcgcgctggcgcgccagctgctcccggcccatcagccctttttttcttttttttcgtaattatttttcgtttttcttttgcgatttttttcactttttttccttttttttctgattacttttttttaatctttagcacacttattttttaaaaaaatgttttgagttgaaagttttcaaatctcgatttgaaaatttataaatctgatttgaaagtttttaaatctgagttgaaagttttcaaatctcgagtcgaaagttttcgaacccgagtcgaaagttttcgaatcggagtcgaaagttttcaaatctgggatgaaagtttttaaatctgagtcgaaagttttcatatttttttcaaatcttaacttaaaaattttcaaatctgtacttgaaagttttcaaatctcgagttgaagttttcaaatccgatttgaaagttttcaaatctcgagttgaaagtttttgaatctcgagttgaaagtttttgaatctcgagttgaaattttttaaatctgagttgaaagttttcaaatatgagttgaaagttttcaagtcgaagttgaaagttttcagttgaaagttttcaagtcgaagttgaaagttttcaagtcggagttaaaagtattcaaatctgggttgaaagtttacacatgtatggaaaaatttggaaaaaagaaaaactaaccgtgtcttgccgcctattaggccgtgtgggccggcgcttacgcgccaattaggattcctgctcctagctagcgcgtgcgcgctactggcgcgcacctccccctcttaaggccttaactacctctattagttaacacttgatactaatgatagtaattaggtaagattctgaatatttttttagagattattttactaacagaattaaaattttttaagttagattaaaaaactttcgatttaagtttcatgttttaaagtcaaattttgaaaactttcaactcagatttgaaaactttcaactcgagaatcgagattcaaaaactttcaagttcagatttgaaaattttgaaaactttcaacttgagatttgaaaactttcagctcgagatttgaaaactttcaactcgagattcgaaaactttcaagtctagatttgaaaattatcaaaactttcaacttgagatttgaaaatttttaactcgagatttgaaaactttgtcctaatttaaaattttgaagttaagatttaaaaactttcaacacaaaacatttgaaaaacacgtgtcgttggaagattaaaaaagcgaaaaaaacacggaaaaaaagaaagcaaaaaaataaaataaaaagtaaccgaaaaaagtgaaaaacaaaaaggaaaaaatcacagaaaaaagaaagtgaaaaaaagagaaaaaacagcgcgaaaaaaaagaagattcgcgcgcgcgtgttgggccgtgtgggccagaatgcgcgccggcaacgtgcgcgtgcaagttaggattctcgctttgcactcttggatgggtaacactaccactaatgggcagttgactatcagagatggatttattttcagtgaaaatatataatttttttaataaatacgctctcttaactacttgtattccatttatgaacgggaagcatatagcaaatatttgctcgagggattagaattcaattccattgagtttattgtgctaattttacatagaaattttacggttttccagaggtaccaaaagaccaattttttttagcttaatatctaagatactgagagacatcaaattttacagtagaaataccttcatatcgctctttacataatgttttaaggcagctcaaacaaaggaatcccgggtagttcgatggtttggcgccaaacagaggcacacgaggatttgctagtccagtttctcactgtcattcatcatatcccaatcttcacagtgacaaactgacaattattaattagttggtactacttgttagcaaacatacaaaaaagaaaagcacacagatgagttctcttatcaagacaaagaacagccatacacagtgtaaagcatcctacattattctgaagaaagtgaatcactcaagtacagtctagagagagatacacacataaatacagttatgcagatacacaaaaatgcataaacttgcatacatgttcatgaatgattgagctgatgagatgagcgtgctatgtcgggccacaagaatccaaagtgtcattacattatttggcactcaatcgcatgcgctcctgcagcgattagtggctacaccaacacaagcatccaaagatggcaacactgctgctctgacgattcagaaagttaacaggaggagattccccagccaccatcgccagcaacttttgttttgttatctgatcatcttcttctagcccatctcgtagtaaagctactgtcagagaagcttcgcatgctgtcctttcacaagaacaataatctagtcagagtttcagaggaacaataatataagtcagagagtttgttccaatcagaacacatgcatcgagctgatcgagctaccaatattttaaaacagcaagtgatgatcactcttgtgaatttactaccatatggtctcatgttctaagttgatccagcattgatcaagttggggggtgaaaagattcgcgtagaaaaggttggcgccaatatactgcagagttgtggtcgatcggccgggtcgtcctgctttgcttcagacttcagagttgaattttttttccattggaggctacatgcgactaagtacactactagtagagtagtggagtagtagattattaatctaatcgagctggtcaattgcatccagtgacactaaaattttgtctctcttccttgctgcatgcagatcccgatgcatatgccattaactttcagtgcagactgcagactgcagtttttgttactgttcagtagaagtttccatagcaattagtcatccccgttcacaaatctaacaatttctatttatttttagaaaaaatcaatacaggaaaatttcttacttagacgtaaaaatatattaacaaggatttcaaggttatttaaccaaaatttagattgacgagaaaaaaaaatctcaatgtctctgttatgcgataggtaggtgggagccaaaggatggtagagataagatataaaaaaaataaattagaggtgatcaatgagataagtagtactctatttttcttagataaactttaaatgtttagaatgcttatatacttttagataaattttaaacgtttagaatgcttatatctgtggggagagagggcgagagtttaagacagatggttttgttctccatccaacctgtagcccaatgctgtccctgcttgctctgactctgaatgtatatggactgaactggaactgcacttgtattttaaggcagaaatgttgagcagctggtgcccatattatttgcacatgcacgcatgttagccctttggttgatcccatatgtgtaaaggagaacgaaatgtcgaaatgtagagagagagagagagagaaggaaacaaaacatgcaacacgttggtttgtgttacaacatgccacatgtgcatcaagataccatgtgtctcttccattgggcagcagctggaccagttcatcttcctcttcttctacagccaacaaacatctcagtgatcgatcgaattatatgagcaagaaatttcagcaatacacactgtaacagtaactgaaaatcaatgaactatcatgcaagaaaattcagaccaaaggtcatgaataatgaccctgttctcactttgctgtagctgaatattgaatatttgaacttgaaagtgcataattgaaacttcagaattagaagaaacaaaaagacgaagaaaaagaaaagtgaaaagctatcaacacctgaactgaacaaatgccgatgtgataattctaccctctcttatgttacaacttacaacaatgtcatcaagtacacatgatcattgtgtgaagcagcatgaaatcgaaggtgatgttgaatttttcgatgaaattttgctgatcatgtcatgtacaataatcaatcaatcaagcagtatcgaagtgcgtgcatggttggattgaatatcgatcgattttttttaaatataattagttcactttgttgcagtattgccggatctcgccgggtgggccggtgagcacgtcgaggttgcccatcttgaccatggcggcggcgaacttctgcgaccacagcttccggctgccggcgtactgcgccaccagcgccgccgtgtcggggcggtcgatcagcgactggtccgacgtgaacaccacctcgtgcgtcagcacgttctggtagtactggttgtccagctgcagcggcgtcttgaagtcgagctgcacgacgcggtcgaggcgccccggcgccgcggcgcacttggcgcgcgagcggacgccgagcgtggcgttcatggcggggtcgatctgcgggtagaggcgggaggagaaggaggagcagtgggagcggccgatggagtgggcgccggagagggtgaccatgtcgtcggcggtgaggttcttggtggcgaagcgggcgacgagctgggtgaggttgaacgacccggggggcaggttggcgagcgcctcggacgcgctcgagacgcggccgtcgaggcggccggcgggcatggcaaacttgatcccgcccatgatgcgcgacgcgtcgcgcgccgcgaacgcgacgatgtcggcgcaggagaccacgcccgggcagcgccgctccacgacgcgcttggcgcggtcgatgacgccgaagccgcgcaggctggggaagttgggcggcgccatcttctccaccgtgccgttgctcgccgggtcggcgtcgagcagcaccgacgcgtcgcacccctacgtacacattcgcattgcatcgaacacctctcgatcatcagctcaaccaaattcgaccaagtgaattcaaccaaattaaccgcaatgcgatatcagtatcactgaccctgacgaagcagtcgtggaagaagaggcggatgaggccggggccattgccggcgtcgttgcggacggcgccatggacgatcgtctgaatcaggtcctcagctccggggcatgagttgttgtagtagcccacctgcagccccgccgccgtcgccgcgtaaccaaagaagatcgccgcagcagcgacgagcacactacacgatcggcggcgagcaccgccgtctctgctaccggcggccatcgagcacacacacacacacaaactatctcttctagatagctcagctagacgaggagtctaactgatcaagtgaaggtgactaggaagaagaagagggtggccatccaatttatatgtatcagctgccatgatcgatccaagtggggattagtataatctgatagtgattcgtagctagtgacgacctgcactgggtgattaagctaagctaagctaggtagcagctgcatgcaagtgttgatcgatgctaactgggaacatggccagtgtgtcatgaggagacaagaacatggggtcacaagttgaccggcctgcctctcttgagctaagctgatgaagctgatcacactgacactgtctgttcaagtgtagtgcatggtttaggtgagtaattaattggcgacgattagtttagcagcagcttgctgcagctagcgtgcatgttagttatggacttatggtaaattgagatcttgttaatttgcaaggcgccacgggtgctgacctgcagcagtgttcgtcgtcgtcgtcggcggcgatgggatggatggatctggactgaacatgtctgaactttcttgcacatttcggataccggatgaacatatcatctctgaattgctgatgaaagaagacgcagcatctgatgaaaacgacgacgaggatgcggtcagtcaatttggcagggcgtgtgtacagatgaagaggtatctagcacgctatgcagtcaccataaattaattgaagagtgatcttggatcgatttcgtcagtttttcaacttcactgtcatggtgacttaattcagatccaatgttagcttctggtccaatttattattattgtttatatataaaaaaaaaccatgccattgcatggctgtggcacgatcgatcgagatggatccagtagtttgacagaaagtgaaaaaatgtttggattgagtctgatcagattgtgctagctctgcaattctgcagtgagcgattgaccaatattgccgcaaggcttcaagacgctgtcctgcgaattgggcgaaattgaagcctaacgggctcgagacaatactttttggcccatcacaaacttcgtttatttgaggccttaacacgataaaatcctttagcccacataaccttccttactatgggcccaaaaattgtctaatctgttcggcccataatatgaacgatcggtagcccatagtaggaaagattgtgggctaaacatctctgaaatttggaggaatacgtctatattcctccctcaagtagtgcccctggttgaatcacatccttcaaccgttaaaccgggtataacccatcccctaactcttaaaactgttgcaaattgactccctaggcggtttcgtcctatgtggtagttaactcgttgagtcatcaagtgggacctatttgtcagcggcctccacctcatcccatcttctccctcatctctcgcgccctctccccctttcatatctttatcagcgtggtggcgatggcgcttggcatacatgggaggagcttctcggccggctgcatgcgggggaggagcgcaaggagctcctcgttcactggccgtccgcgaggaggagctcgccggtcgggcgcc

SEQ ID NO: 31120 - DNA, 36509 bp, Oryza sativa
agagtgagagagagagagaagctagataagagggaggagaaaggctaactgacctgtgggtccgatatttatttttatttttactcactgatatgtaggtcctatttatgtttgtttttattttaatggcacgtaagcactacattgatgtcacatggaatggaatgaagactaagtcaatctgacacgtaagcacacgtacgtaggacaaaaccgcctccaaaaccgtccagggaattgatttgcaacggtgttaggaatcaagggataggttataattatacccggtttagctgttgagggatgcgattcagctagagtcatgagttgagagttgagggaggcaaatagacttattccaaatttggaacacaaaggcagcccgtctatgttcaatttgaggcccagattttgtgctggcatactgaattactgatcagtgtctaggtcacttcagaatttcaatccacgtaagtacgagtactagttaagggtagatgacttatgaaaatcatttcctaagtagtactccgtactgtatagtactgtaccaatcaaagtgtgttatgaatggctgacgaaagtctgatctaaggacgagaatcgtgacgtattccgtattccctccgttttataaaaaaactaggtgattctccacgctttgctgtagaaatttctaagtaacttttaatattttttaataatcaagctaaaagtaaaaattatatccgttattaacaacaaataacattggtttgtccaactatgttcagagagatatttagtagactatatatgagattgtagatgaaatttgatatcatacactttgattatatggatgaatatatgttaaggattataaaacgatagatatatacatgttaaaaatattgtgaaaattaatgtgaaggaagatgattggatgttgatttgtacaattcaatgaattatagatgatgttgcatgcttgcataagttttgcatgtaattattgctagtggatgatgaggtggcatgtttgcatattgagatttatggttagtgggttataactttacagtaagataggatacgactaggtttgttttgtatgagctacatgtatcatatccaatactagatttggtttttgaagataacgggagtaatcccctcgcacataaaatagagcgacttattagcacataactgattgatttatagctaaaaacatgaaaaatggatcaatatgattttcgaaacaactttcttatagacttttgtttaaaaaaatacatggttagcagttcggaaagcatatggcctaggcatagagagagaagagtacatataggtagcataccagataaaaacactacatacatatagctatcatacgcgataaaaacactgcacctagaaataagaatcaacaagaaaaaaactttgtttaaaattagcaaccatcaagtttgtttcttgatacccctctgtaaccatcaaagatcattaaagtggctaatttctctaaatagcaggcactgagaacaaagaaattcctagaactatcgttttcctatagcattaatataatttattagtatgagtacttcattaaaagctcgtttggtatagctcctacttcaacatttttgtctcgtaaagttggagctgtacctaacacttccaagctagtgtgagaatatagagtaaagctaccacacagctcttaaaaaagttgtaccaaactaatgctagttaaaactactgaaagaataattagcaaccatcaagttgtaaatacgagcgccggtactaagtctagtacatgaatccggatggataggttctaccacgtggaatctaaccagttgagctagctatactcactgatgcatagtggtttagtaatttataagcatgtaataattaaacatgaaattaattaagtcatatgtgcatacttgcatatgtgcagcaacgtagttggagagatagtgagatacagaggatatctgcacatgcgacgctatgaaataaacgcaactgcgcaacacaatgcacatgcgacgctacgaaatatataatgacgcgttcaatacatatactcagtacgtgctactcatgcctagcgtcgtattgccatcataggacggaccaggacgacccaatttttcaaatcaaataatttatgggcttaaacaaacaaagtacttctgaaatagggctcaatcggaaaacaaaaatggatcgagttgagtcttcctggtccctatacaaatgtatatgttacacgatgccgtccaactaccaaacatcacaaattcacaaaacattggcatatgcttagtttagcagtgatgacctccaatatcacacttgttttcttgttgatgatgtgcttggcagcggcagtagcagcagcagcaacccctggagtcgccggaggtaatgggctcttgcatacaatcccttccaaaaactctctggctcactgcccttctacctgcggcgacattggcttctcctacccatttgggatcggccatggctgcttccggcaaggtttcgagctcatctgcgacaacaccactcatcctcccacactgctcctggcaaacactacaactaaggtcatcggccaatcaggccggacactagaggtgatagaaatcccagccattgccttcaacatcgcgatgaacaacagcagcatcatcgactacatccgatactgggtttctcctgccaatggtttcaccatcgtgaacgagagcaccctgttcgttatcggatgtgggatcgaggcgtgcctgttcgatcttgacacgaacgagaccatgggttcttgcatcaccatgtgttctgacaatttggggatcatggagatgcacgatggggattgtaccggcatcggttgctgccatatcatcgtgagaagggagctgcgtcggttttggttaaagcttgatcatccggatgatagaacaacaccgcgatcatatcgggtgttgtctcgtgctcaggttttcatcctgccaacaattaacagctatcaattcaatacgaatgatcttgtttcgtccagctggatgaacacgagctccattggtggtactcttctccgtggtgccatcatggaccaggagacttgtccaggtgcatcagcgagcaaagcaacctatgcttgcaccactaacaccaattgcttcaatgctacaaatggaggatattactgttcctgccgcaatgatgtcaccgatggcaatccttacgttaaccttggctgcagtgacgaccctggtacgacttatatatattctttttctatgtatgcatattacccgtgcgctgcaataggattctaattagataaaattatcattgacccgatattaccatattttttcacaaatattatttcttaatttctgtcctttgatcgcacactatcctttttcctttcaaaacgaaaagtacaaagttgcaggtggtggttgacatgtgggccctttgtcctaatagtgtaattttccctttcaaaataaaagtaagttggtgatgggggtggtggtagattcaccactactccattctaaaggtccattttaaaggagtatagatgttcctattttgtattgcctagtgccatgcatgtgcattgtaacaggattggaattatgaggtttagtttttccccttttttggttgatttttcgtgtagaaactggttttaggtgggtggctatttttagtgtgcggatttttaagtggggaactatgatggtggaaaaggaaaaaggacaacttcgttttcaaagtagtaaatttataagaatcaactaagtgagataccctagataacatatatactacatagtaatagaaacagtaaggcacacattggtaatctttctatatactaatttagaaacccatggaggagagagaaaagtaaggccagcaactttattctagatggttcagaaaggctagaagaatctcattattaataagaaatttttataattctcatattgatcaagaaaacctagatacataacacatccaatttgttttactaatgatgaacccatgcatccacatgatgagctactaccattgtagaaaacatttttaagcattagaaataatacatatttgtagttgcaaattcaaagtttacagatattatgcttgcaatatgggggcaagaaattctgaagggagaagtctattttaggatgttggttttccccaagtccagttttcactctatactaacaaatcattcatttttttacacatatatttcaaaatcggaccagatatcaacccaacgtgagctaatctcacaatgctccaaacagtgtcgtgcttatctcctcttggatctggcaagagttcacatgccatctttaaagatagagttttcatatgcacattttttaatgttctagattttcaaatgattaatgtcaattttaacttgtagaacttctagactttcaaattaatgttgaaatctacttttgttacctactggtattaatataggagcatgcaggagaatatagtaaagggtgaagatggattgctttattcatttcaataaccagcatactgcacataattgttactgatgtatggattctccagctccaatgtttgttttttccttccaaaaaagaagggagttggtggtgggggtggttgaacatgtgatcctctggtcctacagtttttttttccttttccacaaaagtagcaagtttgtggtgggggtggtggcaacactactttcttttaaaagaatatagattatacagttctaatattatagacatgccatactgcgtatactcgcacttactaacactggggatacaacatacctatttttatgggtaaaggtattactaagtatggataaatatataatttcatccacttaagaaaggaccatgtagtaattctttatcacgatgttttacctttggctaagttttgtcatatgtacttgaaccccgatatttgtctctaaaattaataggttccactttgtttttttgcttccctactatttacagatattgagtgtttaacaaaaggaaaatgtacggcatcagctaagagacacaatcttattgtaggtaggtcacttcaaacaaaatatattcaagtataattcataaaatgcatgacgtcttcatgaatacaagtgttattggatgaacaggtataacaattggaattgggtgtggccttggctcaatcattcttgcactcggtgcaatagtactaatcaacaagtggaagagaggtgtacaaaagagaattcgaagggcacacttcaagaaaaaccaaggcctactcttggaacaattgatattagatgaaaaagcacaagataaaacaaagatattctccttggaggaactagagaaggcaacgaactactttgatgctactcgtgtacttggctctggagggcatggcacagtttacaaagggattttgtccaatcaatgcatagtagccattaaaatgtccaaaatagcggagcaaacagagatagatcaatttatcaatgaagttgctatattatcgcaaatcattcatcgcaatgtggtaaagctttttgggtgttgtcttgaagcagaggtgcctttattggtgtatgagttcatatccaatgggacactatatgatattcttcacagtgatgtaagtgttaaatgcttgctatcatgggatgaccgtattaggattgcagtagaagccgcaggagctcttgcttacctacactcagctgcagcaattccaatttaccatagagatgtcaaatcttctaatatattgttggacgacaactttactacaaaggtttctgactttggagcttcaagaaccatgtcacttgatcaaactcatgttatgacaaatgtacaaggcacatttggttacttagatccagagtactactacactggccaactaacagcgaagagtgatgtctatagttttggagttatacttgtcgagcttctagtaagaaagaagtcgatttttataaatgaccaaggtacaaaacaaagcttggctcattactttgtggaagggcatcaacaaggagtagtcatggagatcttggattcgcaagttatggaagaggcaaaccgggaagaaattgatgaaattgtctcaattgcagaatcatgcttgaaaacaaaaggagaagagagacctaccatgaaagaagtagaaatgaggttgcagtttgttagaactataagacaaagaaagtgccaacaatttccagtaacagaaggagaaattgagcatttcccattcccaaatactagtaactcttcagatggcaggttcagccattctactggtttaacttgcgactctgtctctggaagttacagcttggagcaacaattttcttcatcaatcaatttgccacgataaccattggtgcaacaatacatttgacttgtaggtgcttgttaagatgaatttgagtcggttgccctatgttttagtttcattaaataatatatttgctctatgcatatgttcttccaacatattttcacgatgtggtttgtgtaccaatctataatcccatacatataatgcataattattaaggtttgatatgctggtgaagaaaaatattttgtagtgttctccatacttcatatccagaggtcagaaactagtctgatctgatctggctgtgttagctgtccctttttttttttttgagaagggtacatactcaggacgcacactcacacacaccacactcacaccacaacacacgcacacacacgcgtgcgcgttcctaacacacggtcacactctaggattgagattgaagacactaggccacagtgtacgggaaacgtgcagtcccactgaacgcgcacaagtgtgtacccttttacctaaccaggaccaaccgaagtgagtcccggggaaagggataaaatcccggtgcgaaaggttcaagcccaataagctcgaggccaatacttttttgggccatgagcccatgaccaacctgtactccgtatttggtttcaggcccgaacgttataaaaccatccagcccacagtatttcgaatttggcccgcatatgaattcatcttaaacatttgggccataatctcttcaaattggcccacaacggctgcctgtttcggtataaattcaggcccatctgaactcgctgaatttgtgcacaaaggaatcatcgaacaaattaaatttacatttttatttgataacagaaatggtcaacatcttcaatctttgttgttcggaacacagccaaaggaattataatttacatgcacaatatggagtgaagcaaactaggaaaatgactgaaactcagttctgcagaaaccagaaagtaaaatgttttgattgaatctgatcactgataaggctggtgaccaacttggtgcaaggcttcaagagttccaagactgttgggcctttcctacaattgggcctttccaggatcaatagaacggcccatcaaagcccaacggactcgagcccaataccttcctggcccagcatatttgatgaaaccatttggccagcaatctttcattctttcaaatctgttccatgatctaaatttttctgaacttttttggcacataatctctcaaatttgaagatattcaactatcttccacttttagatatggtgtttaccaatttgccgcatgaacttacatgtcatagatacaggatttggcccataactgcaacctgcttcagtttaaattcgggcaatagaacgagaaaagtactaaccactgtaactgatcactgaatattcaaagatagtgaattacaattcagttttacaacagcaagaatcgatgcaggtaactacggagtacaaattaagagatcaaaataacaaggaatatatatattatgtggtaatgatccagccgatcgctggagaaagagaacttgtagcttaattatcagctcgccgtgttggtggcgaagcagaccttcctgacctcgccggcgttcccggtgagcacctcgacgccgcccatcttcaccatcgccgccgcgaacctcgccatccacgccaccgggttggcggcgttgtcgtcgaccatcgccttggtgtcgtcgcggctcgtcagcgtctggtccgacgtgaacatcacctccccggcggccacgttcttgaagtactggttgctcagcacgttggggtcggtcacctggttgttgctcaccgccctcccgccgccgccgctcgccggcggcgggcacagcttcttgagcgccgcggcgaacgtggcgttcatggtggggtcgacggtggggtagagcctgccggtgacgaaggcgcagtgggtgaggccgaaggagtgggcgccggagaggatgacgaggtcgtcggcggtgaggcccttggcggcgaagctgtcgacgaggtcctggaggtggaacgccggggacgggatgaaccgggcgacgtcggaggcggaggaggcggtgccgtcgcggcggccggagggcatggcgaaggcgaagttgccgttgacgacggcggagtcgcgcgcggcgaaggcgaggatgtcggcgcaggagaccttgccggggcagacggcctcgacggcggccttgatcttgttcacggcgtcgtagccgcgcagcgggatcgccgtcttctccggctgcgtgtttctgctcgtcgggtccagcaggatggacgcgtcacaaccctattattgcaaatacaatttcattaattacttttttaattagatagttaacctttgtcttcaaacaggtagtttaagtggttttcttgattttaatcgagctatgattttataattcgagtcatttgatttgtaatatatgtgtaataattggatgtactttctttaaaataaagactggaatgaattttattgttaaaacatagttaaagaaatagtgttgggtaaacatgaatgtaaattgttattattaaattgaattaaaccaatccaaatatgacacgttgatgaatttactacgaaacttatatgttttataaatgatagttttgtacgtaccctgacgaagcagtcgtggaagaagaggcggatgaaggcggcgcccatggtggggtcgttgaagatcatcggctcgacgacgttcctcaccgtctcctcggctttcgggcacgacgacgagtagaagtcgtactgcagcgtcgtcgtccccgacgccggcggcacggagctcatcgtcaccgcagccgccatggcgaacgccatgagcatcactgcaggccttctgcatgctgctgtcgccatcgccatgtttcagagactaaactcctcaaattaattaagctatttagttaaccaacaagagagaatgtctgattgcgactgtggtgtgtgtgcatgtcctgctcatctctgcaggtatttatagcatgacatcgactggaatgcagtgttaaccatgcatgggtgatgatggatggatcaatgattaggaggtaattaattaagctagctgcaacaaattattggtatagctgaatgagctaattaattaattaagctagctaggtatatagctgggttgacattgccacacacaagagggtacttgataattatcttgttcctatgggattagacaagagttatctggccggatatatgcaatgttggttagttagcatttgactctatggaggtatgaacactagttacaactgcaacagaaaatgttatcaaatctggctagctttggacaccaatatcctagctaattaagttgatgactttgagaacttttagctagctaccggcagttaagattaacagaatgaatagaacatagtactaattaacccgacccccaattatctaaaaaagcatggttaattttattttgtaggcctggaaatgtccctagctcctcaatttaattttggactcatgatgatcagttcacaagttgaattagtagggaaacgaattgaatcctgtattaaaaaaaacacaagacaatttattttaagagtaaatttaacaaaactacagatactttgatcaaactattacaaaactacagatttaagaatgtatttcacaaaactacagatttagagtcaaatttatcacggaactacagatttaaggtattatatcacaaaactattgatttaacaactattttatcacaaactacatatttaaaaactattttatcacaaaactacagattttataactttaaataaataatagtgctatgatctaaactctaaaatatgtaattctttgataacttcatcactaaatctgtagttttgtgatatggtgcattaaatctgtagttccgtgaaaagtttgacgctaaatctgtagttttgtgatacacattcttaaacctgtagttttatgataatttgatccaaattatctatagttttgtgaaatttactcttattttaatttctatgtcccagcagaacatcaaataaagtcttggatggaaataaaatggatattctagtctatgcaaatgttactacatatatacatgcatgattaaatggacttaatgcaagtctttcattgaaggaaacacggcttgtcgacattctctgcactaattaaggtgtctgtttgtccacaagaatgtcaacttgataggtacttaattactggcagatatactccataccatttttatatgtcttttcggtgtaacagacagtgtatctactatttgctcatactgcacgttgtgctgcatttgtgcatacccaactgaaaaattctcgagttagcgaatattgtgtcgacctaactgataacagacaaattaaattaacaaggatgacatatatatgtccatgcatgaatgaaaaggttgttaattatatggacatatatgcatgcgtgatttatatatgaatgctgctagctgagcttgacgtttattgtccaagcaaaaaacaataattttactacacttgcgagccaaaagatgggtggacatccacccaagtaattagaatccatctccgttacaagcaggaaatacttttaatcaggtggccatccacccatttgttgcatgctcgtgagggtaagtacatttcggtaggtggctacattaagccattcgtctgtgaaaacgaaggcatttttataggctgacgccgagctcgccgtcgtcgtgctcgatgcatggcacgcacgcatcatcgccgggtcaggccactttcaccgcgcaaagacgcgggcggaagaagcgcgggagtatcatgctggccgaggcgttggggttgagctggcacacgcgcgccacaacaaacgccaaaggtgaggagcagcattatccaaaggagtaatatctactatgattgtagggttcggattcgaagccgaatcatgtgtgtcaagtttccaccaaatcgatagttaccttcacttgacggaagatcgggcatcccgttgccatcaccagccgacgccgccgaggaagcccgcgttggagtagacgccccggccgcaccttggcccaaacatcatacatggtggcggaaccgatgctcggggggcgagaaggtggttgacggacaggacgacggttgagcgcgtcgtaggtgcgggaagctgcgcagaacagtgtgaaaccgccgccgtggaagtagatgacgatggggtgcggcgacggcaagcgctccgccacggcgttgaagatggtgatgtccgtggtccgtccagccgacgccggtggtgtccggtcggaaataggccggtgctttccgccatctctatgccgcgtcacgtcgatggcgggcggcgacggcgcggatggtggctagctggtggcaactcgctggcttggaggtgacgaggaaagtagtggaggaaggagaggtggccaatgacatgtggggcctacactattttttttttttctgactaggataccacgtcagctaaaacaaacatacctccaccctactataggacctgatttagactgttttgccgagaagaggggtgaagatttctggtaatcaattaagctaaactcgcgtgaagatgagggatttcagtggacttattcctcatttgggccgtaaccaggcaaaacagctggtggtcggatgtaggccaaaagttacctgcacctaatcaaggcccatatacatattcgtctagacctataagcccatacggggagaggaacgaaattgaactattattcaatttgggcttaaaaagtaggtctaaattggacaattaatttaagcccaactttagagccaattttcatccattacagatttcaaaagctttgattttgtgaattttgccgcttgggcaaatctatgcctagattttcatgcatccgatctaaatctttaaagaactattaatattttaactttttttaatgtttgacttgaaagatgcgtgtctaaactccaaaataatactcactccgtttcatataacaagacgttttgtcttttttttttaaagttaatttttttgttttgactttgaccaagtttaaaaaaaaagcagcaacattttcaatccaaaacatatatagtatcaaaatatattcgacgttagatttaacaaaactaattttgtattgtaaatattgctacgtttttctataaacatagtcaaacttaaaaacgctcaacttagaaaaaaaacaaaagtgtcttataatatgaaactgaaggagtatatttatgtgaccagtggtagtatagcttttggcgagagcgcacccgcgtactagtataaaaagtaataacattataaatttagaatcgaattacttgcatcccaatttttttttgaatgtgtggcagtacaacgaattgaatttaaactacttccttcgttccaaaatgtagctacctagtacaggatgtgacattacctattactaagaatctgaacaggaggctgtccagattcctcctgtccagattcatagcactaagtaatgtcacatcatatactagatagctacattttaggacggaggaagtattagcagtggaaaagaaggacggaggaagtagtagcagtggaaaagaataaagtacaatagagttatagggatcatatcagagtcaaacatttagagagagagagagagctactgcatcgatcatcttatgtcatcgtcgtcaatggtggtagctgttgacggcgttgcacttggtcctgatctcccccttgctctccgccggcatcaccaccagaaactattttaatttttgaacaaaatttgaacaaatatttccaaattcacaaaaaaatgttttctttaaaaaaaattccggccgaaataatatgggcgtgcgtccggaattacgtcctaagcgtagaaagagacagagcgcgtgcttgtataaagagcaatattagaaatttacaattgaactactttgcatcataattattttgaaaagtttgcagtacaacgaattgaatttgaactagtactcacgcgggcgaaggaacaaaaaatacaatagagttacagagatcatatcatagtcaaacattaattcaaagctactgcatcatatatccatgagatcgttcgatcgatcgatcgatggaaggatcgtcgtcgacgtcaatggtggtagccgttgacggcgctgcacttggccctgatctcccccttgctccccgccggcatgggcagcttgctcagcttcaccagcgcgtcgccgaagtccacgttccacagcgtcgcgttcttggcgtactccacgacgtgcccgcgcgcctccttcccggtgagcagcgcccagtccgcgtggaacgtcaccgccatggcgaggttgttgtggtagtagctgttgtccaggtagtccctcgccttcctcaccctcgccgcaaaccccggcatgaccctcgccacggcggcgccgtcctcgtcgcgcacgttgttcaccacgacgtggttgttggccggcgtcggcgacacgccgccgcacttggagacgaggaggctgcggtagcccgggttgatctgggcgtccggggcggtgaggcggccggcgaaggaggtgcagtgggtgacgccgatggagtgcgcgccggagaggatgacgagctcctccacggtgaagttcttgcggcggaagttgcggacgaggtcggtgaggtttgcggcggcgtccgggaggaacgcgtcggcgtcgcggctgcgggagaccacgccgtcgaggcggccggcagggacggggaagtcgacgccgccgtggctgaggtacctggacgcgtcgcgcgccgcgtacgcgatgatgtcggcgcacgacaccgtgttggggcaccgcgcctccagcaccgccttgatcgcgtcgatcacgtccatcccccggatcccgatgttcgccggagattccttctccggctgcctgttcatctcgctcttctccagaagcacggaggcgtcacacccctgcacgcgacgaagcaagcaactccattaatcatcaaacccgccattgctgcctagcgagcgagcgagcgagctctacgtgcattgcattgcatgcacgcatggcgttcggtcaaatgactagttcgatcgatccttaccctgacgaagcagtcgtggaagaggaggcggacgaggccagcgcccttgccgcggttgtccttgatggagttgacgacgatggagttcacgatcttctccacgtccttgcacgtcttctcgtagtacccaaccttcagctcgcgatcggctccggccatcgccgccgccgccgccatgaacaccaccacaacaaagcacacaagcttcaccatctccgatgatgatgatgatgatgatgtgtgcaaccaatcaagaagaagatccgagtgtgagagatcaatcgatggagggatggatgaactccaacgttgatgggtgcatgtatatatactgataatttgggaattttttagcatgtagtggttaattataatttgtgaacaactgatcatgcatgcatatacatgcaatatggtgatcatgcaacatctgattagttgaggagaacatggagatgagcgcagagatgcagtgttctcaactggaatgtcgatggaaaaaataactaaacaaaatagcagcagcaggttgaccttacccagttggagagtttcttatgtctgacagcagcagagagggaatttaattgcattgtctcttcaaaatagcccaaattcattggccatgacagtggaatttgctcaattaattgcagatagaccaagagtttgttactgtcgaaacaagatttcggcaatactaaaaaggggtggctatcaagcttgaaaagtggatgggtttggagacaaacgatttatataggttcaggccttcttattcaagaagtaataccctactcctgtccggggtggaaaccgccgagtgtattattgaatgtatgatctcaaagagaattggtgtcccaggaaggactcggacccctccttatataggggaaggagtccgtattacaaggtataactcatatccttatcagaatacgagaatacaaataaaatacaatcgtaaccgactaaatctcaggatatttccttgacgtacaagttaagaaacaaacccgagatacaaataaagatattctatctatattcggtatcctatattcagtctaaatataaccgccgtgtagatatggggtatccataatctccacagtagcccccgactatatgattagttaacaaactaaacatgtagtcaagaataaaataattgcataatcatgcatcatatgacaaaagcatatgcggcgtccaacaagacattcagccgactgctttccagccatagtaaaaaaatccgagtgaataacactctaaaaggttcacaaatgaacacatttaacaaacatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatcttaaatcaacccagacagcttttgcagcctaaaaaagcttacaaaaatagtataacacttttctgtcgggtacctttcaatttgcattgcaataattccaaagaattatataaccgcattaaaaaggattttatcagcattgggccacaccattgcgagcataaattgccaaagcaaaaatgcctaagtccctaaggagcacaacgggccacgctgttaataatattgggctgaagtactgttcaggcctaggcccattagcacccccgaaacccttaacaaaaaatcccgaagtctaagcggcgcttcgtcttccccgccggaactctcgccatttcccccattccttgctatagtacaaagctgcgccggcgaaactagggttcaccattccgctccaatccacctccaaaagttcaccaaaatcctccacgcaactcattgcttcaattccacatctctccccagccatccctcgaatcaaatcaactcattcggatcaaatcgatggcggaagaaaaagaaagctttgaaagccaatgggcgtcgtccgacgtgacggaggagaacttgaaggagatggtggcgcacggcgttctcccagcaaaggagatcatcggatggtggccagcatttggtgaagctttcccaacccccgatacacatgaggttgtgggtttttctcacttcttctatggcggatttgccctttcaacctcgaagtttttccgtgggatattgaacttctatggtatcaatttacatcatttgaatccaaactccatagtccatattgcaaattccgtccatgtctgtgaagcttttttgggcattaggcctcattttgctctgttccgccgaatattcttcctcaagccccaaccgaacaaaagcaaaccatgcgtagttggaggggctggatttcaactgagagggaccttgagccaaaagtatttttctatgcccttcaagacctcaaacaaaggatggcatgccaactggttttatgtccaaaatcccgagcccgctcttcccgagtactcctgtcttcccctagtataccaagatacttggaactcacttcccatgggagatgaagctgcccaagccttagaactgatggagcgcatgttgaagctcaaggagcaaggcttacagggagagcaaatcactcggcatttcattaagtgccgattagctccaatcaaagaaagatcccgcacagctttcgagtttgatggtaaacatgatccaaaccgtgaagacccagattctctggactttaagatcatgaaggagaggatgtacaagatattctcaaacgccatcgttgtcagttattcgcatctgctgccagtcgtgccatataatgcattcaacccacctccgctggtatgtatcagaactcttcaaaccgtgaccaaaacataattttgtcttcttgttgaattaactgaccatggaggcatttcattcaggaatttgctttgatgaagtctgaccccccgattgctcaacgccgatctcctcgtcatcagaccattcaggggagtggaggaccaaaaatcaggtcagactcccaatccaaaactcccaatccgactgggcaatcagattctcgcaagagaaagcttgtgccgagcgacgacgaaggcgacgacaataataaatttggggataagggatcacccaaaaaattaccaaagcacactgctccgaagaagaaattgtctagccgccccatgccaaagttcagaaaatcctccaggtataaaccattcggtaccatttcacttcgacatgcctctctcatgaagataatattgaaaactggaagaaaacttgcaggaaaccgtctgacatagatccatccgggaaggactctgatccagctaagacagagacaggttcatccaaagaagctgggccgactactgaggaccacccgactggcgctcagacctcaactgataatatcaacccaagcgactagcccccgactggaaaccagtcagcagaagcggaaattgcaacaagccaagagcccccgactggtaatcagtcggaagtatgtccagatcaagaaattcctgaagttgaagttcaggctacgacttcccaaggactggacgctggtaacgacccaacgcctgggtccccagataaagggcaaggatcacctcacgctcaaccggaaactgcttcaggtaacctatcttctcaagtaatgctaatctgaataactccgatttgcttgcctaatgtctggaaatacatcaggaccactggccggtgacagagaagaaatctctcgcataaaggcaactgctgattctcgtccccccatcttaatcaattggtgggacgacaacttgcaacctgcaggcatcgtcataaatcgacagaaagaagacgaagaggtgcgccagctgaagaaagcactcggagaagctacccgcattgtaaatgtaagtcttccaggtggctgcctttggcgaccttgtttccttctcagcaagactaaaccgtgaatcattgcgcagagaatccatctccgtaatgaggccaaaaccacaactttagaaaagctggttcctcatttagggacccttgaagcggttagggatcagctacacgaagccaaagagcttgctaaaaagacagagcatgatctaagggaccgtgacggagctggtggctcctcaccgggagaccgcgcaggcccccctttgccggttcggccgggggcttagggtgagatctcaagctctctctgtgtgtgggaagattgcgtgccaggaagaaacgcgagacacggacgatgtatacaggttcgggccgctgggaagcgtaataccctactcctgtgtttttggtggatctgtgtaagagcaagttacaaaaacatcaactagccctctcctctcccgggaaaatccagcccccgctctttgtgggcatggtcctccttttatatcttaaggggataccacatgtacccttccctttccaaactggacttttcttctctttatggacggagattggtatggttgccgtccgaatgacacttcgatgggacagcccacacctacctccactcccggcggagacaggcgcaacgcgggatcgtggttgtctgatgctgacgcgaccagtgtcagaccggtcacagatcggtcattcttgtcctctatgcgtcagttcagcgatctgcatgatcacccttctttttgtagcatcctgcctgtaatggttgggatgaagcctggtattcatctaaccagggctaacgtgccatctctaagaggtaacacgctagctccggctggagacgtgtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctatcgtgttcacccaacctatgtacatagtgcaaaccccacagggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatacccccggtcccatatcaccgacagaccggattacccaactccaggattcaaactttgaactgagtggctcatcaaaaggtaacctcaagatctgccccattaatttgtgctgttataattgtaccctcaactatctggaatcaaaacagtacaagctgccaagatagctcaactggagaaacgaatttaggccttagaaagtaacaaggcagaattggctgcacaaagggactcggctttgaaggaggttgaaggtattgtcagccaacaacctgagtttctctctttgatgcagcagatcattgacatgaatttgttattgtagaccgcaagattaagtcccaagcccagttcgacgtcctggttggcaagatcaaaagacttgaaggagccagggatgaggttgccaatgccgctaccccgcttgtccaggcaatgttctataataacaatggtccgagtagattcgatgcttccgaagtgtttgacaagctgagaatcgctccggacacctatttcaagaacattaaagaagccggaagcatgggagtaggtttagcactagcaatgaccaaatccctgtacccgaagatcgatattgatgccgttgatggttttgcggacgggacaagcgaagaggctgcccttgatcttatcaacgacgctcaaaaagcagccgacaagattgcaggtgctgtcgtagatcggtttcaggataccgaccttcggccgactggtaacaataactctgatgatgagaagactgatactgattgaatgtaaatgtattggatgacgaatgatggaggcacaatttgtacaataccggtgtatttatgctgtgcttggtgtttcttgcttagctgttgatttcttaaaaacctttatcaagctttgttgagcctaaaacccgcaaaagctattaaaaacttttagtcctcgtaaactaagtagaaaaatcaaacaaggcaatgatagaccaagtaagcaaattgaattgataaaaaatcacactccattattattatggtagcccccgactgacaacctcaagaagaaggcttgatgttgacagtcaagatagggaaatacatagataaacttaagcgtagaaacgacgaagatgttcgatattccaagaattgtcaacaagtgtaccatcttcgtgcttgagtcggtaggaacctggccgggtgacttcagagattataaatggcccttcccatagaggagataacttgtgccgatctcgtgtagtttgaattttcctcaaaaccaggtcgccgactagaaaagctcgtgatcgaacgttgcgattatgatagcgtcgcaacccttgtaaatatcgggccgactgaattaaagctgcttcacggacttcttccaatcggtgcagatcatccactcggtcctcttcgtagcgttcttcgcgaaaattgtgaaagcgcaaagattcgaatttaacttcactaggcaacattgcttctgccctgtagacaaggaaaaaaggtgactggcctgtggcccgactgggtgtagtacgcaaagaacaaagtactgatggcagctgttccacccattttccagcatagggttttagccggtcaaaaactcatgcttttatcccttgaagtatcatgccgttggctcgttcgacctgtccgttgctcatggggtgcgctactgaggcatagaaaattttaattccgaagtcgtcgcaaaagtccttaaaaactccgctagtgaattgtgtgccattatcggtgataatccgattaggcactccaaacctatgcacaatgttgatgaagaaatctcgagctttatctgctgtgatggtgacaaccggtttagcttcaatccacttggagaatttgtcaatggccacaaagagatgcgtgtaaccgccgactgcctttttgaacgggccaaccatgtcgagcccccaaaccgcaaacggccaagacagtgggattgtttgcaactcttgagctggtagatggatttgtctggtgaaaaattggcaaccttcgcacgtgcgcacaatcttgtcggcgtcggacactgcagtaggccagaaaaaaccctgccggtaagccttgccgacaatggtgcgtgcggcggcatggtttccgcatattccagaatgtatgtctttcaacaattgtctcccttcctctagagatacgcagcgttgcagaattcctgaagggcttttcttgtataactcggcttcatgaataacataaagccggcttcgccttgaaatccgctcggcttcatctttatcttgagggagttcttgagaagttaaaaatcgtatgaggggctctctccagtcggcttcaatcatggctatgtcttgagtgtccgcaacttgaattgtttctttctgaggtacggtcggctcataaaggtgttcgacgaatacatcggagggggccacctcgcgcttggatccaaagttggcaagtctatcggcggcttcgttgttgtgtcggagaacgtgactaagctcgagtccatcgaacttgtcttccaatttgcgtacctcttgtcgatatgccgtcatgttgtcgtcaaggcaggaccactctttcataacttggttaacgactagctgtgaatcccctcgaactattagacgcttgatccctagggaaatcgcgatccgtggtccatggaggagcgcctcatactctgcgacgttgtgggatgcggaaaaatgtatccaaagcacataacttaatctttctccagttggggaaattagaaccactcccgctccagtgcccgaaagcctttttgatccgtcaaaatgcatggtccagtgctccatcttttctcctggaatatcctcttggcactcggtccattcggcgacgaagtctgctaatgcttgggacttgattgaggttcggggcttgaaggatatgtccaaagacattagctccaaagcctatttagcaatccgtccgtttgcttcgcggttgtgcagtatatcaccgagcggaaacgatgtaaccaccgttaccgagtgaccttggaagtagtgggataatttcctagtagtaatcagaatactgtataacagcttctgaacctgaggatatcttgttttggagtcggctaggacctcgctgacaaagtagatcggtcgttggactttctggatgtggccttcttcctcacgctcaacgaccaagactgtgctcacaacctgggaggtggctgatacatatagtagcaacggctcctgcaggtgtggtgaggctaagactggtggctcggtgaggagtttcttgaagtcttcgaaggtcttctgtgcttcgggtccccactggaaattgtctgttttctttaatagcttgaagaagggcatcccccgctcgccaagtcgtgaaacgaatcggctgagcgccgccatgcatccagtcagcttctggacgtctttctgggagcttggcggtttcatgttgaggatagcggtgactttctccgggttggcttgtatgcctctatgagacaccataaaaccaagcagcttccctgacggtactccgaaggtgcacttttcagggtttagtttcatcctgaaagcgcggatgcttgcaaaggtttcttctaggtccgagattaaatcatccttctgcttagtcttgacgactacatcatccacgtaagcttcgacattgcggccaatttgcgtcgagaagcatctctgaatcatgcgttgataagttgctcctgcattttttagtccgaatggcatggtgatgtagcaattggccccaaagggcgtgataaatgaagtcttcaagcagtcggattccttcagtcggatctgatgataccccgagtagcaatccaaaaaactgagtagctcgcagccagcggtcgaatcgactacctggtcaatgcgaggcaacccaaaaggatctttagggcaagacttgttgaggtcggtataatcgacacacatacgccattgcccagttttcttccgaactaggaccgggttagccagccagtcgggatgaaggacttctttaatgaagcctgctgctaacagcttggttaattcctccttgatcgcatacttcctgtcttgtgcgaagcggcggagtcgttgtttaataggtttagcgtcttctttgacgtgcaaggagtgctcaatcacctctctaggaattccaggcatatcagatggtttccacgcaaagatatctttattattttgaagaaaggtgacgagcgcgctttcctatttacaatctaactcggtgcctattacagcagtcttagtgggatcagaaggatctaggggaatctttttagtcttggcttcgctttctccgctcttcgagaccttggtcgcgggcacttctccttcacttgccgtggtcgcagccagtcggatatcttctcgggcagacgccatctcgcgagtttgggccatctcgcaactttccttgtcgcatgtgacggcttgcttgatgtcgctccgtagggataggactcctcggggaccgggcatcttcatcattatgtaagtgtagtgtgggacggccatgaacttggctaacgccgggcgtccgagtatggcgtggtacgctgtctcgaaatcggtgacttcgaagcagatattctctgtgcggaagttttcccgagtgccaaaggtgaccggaagggtgatctggccgagtggagttgcagataaccctgggatggctccgtgaaaaggcgcattgcttggtcttaactcggagcgaggaatctgcatatcatccagggttttggcgaagaggatatttagtgcactgccaccgtcgatgagggttctgcgaagcttgacattacggaccactgggtctagtaccagggggtaccgccccgggtggaccactcggtcgggatgatccgagcggtcaaacttaattgctgtctctgaccatcgaagatattggggtgtgtcgggctgaacagcgttaatctcccgttcagtcaacttttgctttcttttagattcataagccaaggggccgccgaagatgtggttaagctccttgcggtggtcttggaaacctgccggggggtcgccatcgtccttcttcttcgacgtgctttgttcttcgtcggagttcttccgtgtagtcttggtgtattgttccgcgaaatgcttgtagacgaaacaatctttggccgcgtggttggagttagggtgatgcgggcattgggagttcatgatcttgtcgaacgtgttgacgagcgagcgctgtcgagaagagtgagtagtggttgcaacaagttcctcaggcttacgcttgcggtccttatggttgttacttccaccccctcccgtagccggcgtatccttttttggcttccaactggagcccgactgttttgatgcgatgacggcgtcttcagctttggcgtactcgttggctttttcaaacataagtttgactgttttgggaggcttacgcccgaacttgccgaccaattcttcgtggtgaattcctttggtgaatgcggcgatgataacatcgtcagtgatgtcagagatcttgttgcgttgttcagaaaatcgccggatgtaatctcgaagagattctccggacttctgaataacattgtaaagatcgaattgtgtgccggggcgctcgaaagtgccttggaagttggcgatgaagtggtcgcgtaattcggcccaagatccgattgtaccacggggcaatccatggagccaggaccgggcggaatctgctaaagccactgataaatagttcgccatagctttgctatctcctcctgctgcgcggattgcgagaccgtagacggtaagccataattccgggttggtggtaccgtcatacttctctattccagccggcttaaagccggctggccaatccactcgacgcaggtcgttggtgaaagcggcaactacgtctaggtcgtcgtcgtggcgatccggcgaatgatgatggcctcgggctgcccggcgctgtatgatcgtatcgcgaagatcgacggggcgacgacgaggtggcgaacgaggtcgttccactcggcgctccctatgatggtcgggaggcgagtggacagatcgctcgtcgtgacccctgctcctgcgattagatcctgcgccagtgatgctgaggcttggctggtggtagtcgtgagatcgaagatgggggactcggctgccacttggcgtgcggacgcttccggagttaactgggaccgaagacgcaatcatggtcttggtctggttcaagatgttgacgacgtggtcagactgattgagctcgttctccttgaggagggtgtcgaggagggtgatcgcggcaacagcattctgttgtggggtgcggaaaaccggtgtcccctcaacgtcttgttggccgataagatctcgcgctcggcgccctgcttccaaggctcgtagccgccggtcttcagcctcctttgcggcccgctcacgctcctgttgctcacgccgtagccgttcttgttcttgtgcttgacgctcctcctccagtcggcgtcgttcggcctcgcgtcgtgcttcggtttcccgggcttggcgttgctcttccgtctcgttatcggccataaagacgccgaaatagagaggggtgtagttgtcttctaggctttcatcgaagtcgtcgagatccgggtcgttgttgcgaaagccgaactcattgtactccatgatctcggtcggacgcgagtcgatgccgggagagctccagtagccatccagctggtccgtcgaaactgagccgagtggctggaggatgacgccaacttccctggagctaggcgagatcggtgttgaagccgacctccgcctaggcctacgggatggggatgtcgtggtggtgaagacggccgccaaatcgtcggggagcttcattaggatcggtgggtaagccccatcatctcgatctgatgacgttggagaagatgcgatctcgtccgagtggtttgaagccgactcgattgagatggacttgaagtagatttcagccgcgtttggaactccaaacgggaccgagatccggctctctcccgactggtccgattccgagtcgaggagagagatcttgccgaagtcattggtgatgaagtcgaggctgccgaaccgaaacgcctgcccgggtgggaagacgaggtcgtcgatgctggagacggaacccattgcactggtcggcgaaaagcttgacgcaccccctacctggcgcgccaactgtcgaaacaagatttcggcaatactaaaaaggggtggctatcaagcttgaaaagtggatgggtttggagacaaatgatttatacaggttcaggccttcttattcaagaagtaataccctactcctgtccggggtggaaaccgccgagtgtattattgaatgtatgatctcaaagagaattggtgtcccaggaaggactcggacccctccttatataggggaaggagtctgtattacaaggtataactcatatccttatcagaatacgagaatacaaataaaatacaatcgtaaccgactaaatctcaggatatttccttgacgtacaagttaagaaacaaacccgagatacaaataaagatattctatctatattcggtatcctatatccagtctaaatataaccgccgtatagatatggggtatccataatctccacagttactttattaatccaacacacaatcgatggtacattctgctttggatataatactggcctttgaaatgtttttttagtatacatacatgtatctctgtttttttcttggaaaagtctcttctgttcgatcgaacccataagggcatgtgcctttactccccaaatgtcaatcaagtagttaaaaaaaattcaaatataatgtggtaacagcccagtatgataatctctatcactttgaagtctcaaaattcaaaaaattgaagtctcaactggatatatatacacattaaagggaaaaaagaagacattgatgaacaaaaggcttgtatataattattcatggcagaatctgtgttagctaagctcatgtgtttaaatattaaattgtttgcgaagtgagcgtagctcaactggtttgatatcttgtggtggaaccagggttcaagttccagatttgacacgaatattcgcatttacggctaattattctttcagtggtatactacgtacctgtcgacaataaagggcctgtggtgacttcattaatcttaagatatattggccctatcttctggaggtgctcatagaggtagagttgtgcgtgtgtattcataaaggtgatgagcgtgtgtgtatgtttatagagttaagtgtgcacgcattatgaacgaatatgtttgtaccatgtttctaaaaaaaattgtttgcaaacaattgtcagaaatttttacaactaattctatatatagcatttgaggaatcagcacaggttccttaatccaatcttcagtttttttctttctcattaacctaaatgataaaacaaaaagtcatgtttttgacggatgaagatcaacttctggatttgggagtgttgaatccaacttaattaggaacatagttaattaaggcatcttatatattgtagtactatcaataatactaatttagaagagggacagacgtgtggactgctggctagcagtactgtgccttatatttgaagtttgacatgaaataccaaacacgatggaagcacatggcaaatgggacaatcatagtagcttgtatccatgtttcagcggttgggtttgcaattattttgtcccaatattccatgcatatcaaattatcaatgcatgcatgcaacgaccaatgaaggaaatagcagcacttaataataatattaaggatcaatttatacatattattgattcgtagtgaaattattatcaacatgatcatagatataaattcaataattaaacttaacatatagttttaaacaagaaagctaagctaacaattaatacattaaaaatttttagaaaacatatatttaaaaacgtggagcaaataatctgtggtgaagtattacttatttagatacatgagaggtgcggtagtacactcatactaccaaaaagtagtgtcattctccttccatctcctctcaccacgcacgtagcacgtccgtacgttttgtataagtaaccactgatccaatgttttatcctcagttactcttttagtcatccctaattatacggacctaaaataatcaccggatccaatattttatcctcattcaccctcttagtcttctttgattatatgaacctgttacaatattgggtatgtgacatgttactagtataccagaaaatgtgtaaatacaagttaatttaatgggtatatatataagtatccaagaggttaatcctcgattcctccaataatttgtcatagtgtaaataaaggctcacacatgaacaagtgtatgtttgtgtaagtgtagccagggtctggtttagttctcaactttttctttaaactttcaactttttcatcacatcaaaattttcctacacacaaacttctaacttttccatcacatcattctaatttcaattaaactctcaattttggcatgaactaaacacaccccaggttatattttgcgagtgtacgtgccggcctgcaagccattttttggcccaacccgtaggccctctttgtttaggcttataagccaacttataagtcgaaaagtctaagcctaaacaaacaagcagcttttccatttggcttttttgaagccataagccactctaacactattaagccaaaagctaggttggagaagcttttttggtttatgtgaggtagatgtatgactcaactactaaacttaggacattaaatccaccggcttataaatcatataagccaataagctgacttaaaagtctaggccaataagcctaagcctaaacaaagagggccgtaatctggcccacaaaactggcatatatgactgttcgtggcccaagccatttccatccaaccatgtgacgtttataattatagaatgctagaaatgaattgcattataagcccttattatacattagctacaaaattaatcaaagacttaagattaacgatgcagtagtaataattttaaaccaaggtgatattacagtaggtacgtacaagtagtcgtattaatgtacgtacactacgcgtatactagtataataccgtcgtatttttttccgctgactcgatcgttgactagttactactactactagtagtagttctggttggtgcatctgcaagtcttcctgatctcgaagtgggtgccctcggcggggagcttgctgagcttggccatggcggcggcgaagtccacgtcccacttggtggcgttgtccctgtactcggcgaggtcggcggcggcgtcgccgtcggtgcgcagcacccagtccgacttgaacagcacccggttctgcaggttgttgtggtagtagctgttgtccagcgcccccaccgccgccgtgtccacgccggcggcgtcgtacccggcggcgctctggaacgccgcgcccatgtcgcggatgttgttcttctccgccgggttgtccgtgcgctggacacccttctgccgttcgacgtcggcggcgagcgccgacgcgtacgtggcgtctatgggcgtggcggtggcggcggcgaggcggtcgtggaaggaggagaggtgggcgacgccgatggagtgggcgccggagaggatgacgagctccccctgggtgagccccttgctggcgaagttgtccttgagctgggcgaagtcgaaggtggactccgggaggacggcgtcgcccgcggcggcgaaggaaacgacgccgtccttcggcccgtgccgacgtcgtaggtgatcctgccgccgctgaggatggcggaggcgtctcggccggcgagcaccacgatgtcggcgcaggagacggcggcgcccagcttggatttgatggcgtcgatgacgtcgaagccgtccaggccgatgttgttcgccgccgccttctccgtgctgctgctgtacggcgtcttgtccaagagcaccgatccatcacaaccctgcatttttcaagaaaaaattctttattagttatgcgctccatcttaacaatttaaaaatgtattcaaatcaaatttatagttaaaaattgttatattttaagatcaagctagctatttgcccaaattaactcagtaagtgaatcacttttgaaacaccatatcaacatcatctcacaatttaaaaaggtatcacagccctgctttttttttgttattatatatccattcatgttatagtattgttcatgcatgtggttatttctccaaactcattacaagtcacttttcaagcaccacatcaacatcatccaacaatttaaaaggtatctaattatcattttcaggtgaaaaaaaaaaagaaaagttattactacttactatcaacttagaccccccccccccaaaaaaaaaaaaaaagctaatgcagacaagcatgacaagttctcttacatgatccccaattcaaaagaaaaaaaagccaaactaaaaatgccatataggcctatctagctccaccgaaatttgcattatattgcaagctaagctgcatacatattggacttcaggtttacttatgcatttagcagatccaaatctttttgagagtgtgttaattaaagacaatatatttaaagcacatatgtacgtgcaaatgtaatatgtgtaacatattacgtgtgggattgagatcctcttcaatcaaaatacacggtatatttgtcactgacatgtgggtccagggatcattggatccacatgccagtgacagagacacgtgacttcgactgcagaggatcctgatctatgtgtatgtgtctgtatgtcattcatgtactcggaaaaaaaaaagtaaatggtggttagtatacttacgttgacccagcagtcatggaacaccaaacggacaagggcggcacccacgccgggattgtgcttgatggccttctccacctccttcctcaccgtctcctcgatgctcttcttgccgtaccaatcgccgccggcgtcggccgccgccggatgcacggcgaccaccaccaacagagacagcacaacggcggcggcggccaccgccgcgttaagcttcaccatcaccatctccgatcctccaaatccttagctgaattagtaagtgtgtgtgtgcttagctagcttactagctactgcttaagtaggatggattgatggattagcagctgtgcatccagggggtatatatactgctgatcacctctcaccatcaccatgagcatcaaataattaattagctactagctgctatagttgaacactatgactatgccattgtatgggttgagttaggctagcttagctagcttgcatgcacacaccggataatatgcgtcactattttatatgagcaatatatatgcatgatgctttgcttgcttaatttgcatgcttgcagttggtagataaacgttgatgccgatcatgtgttgaccaaaaatgaaggaaggtcgacgaacgacaacgtgcatgcatggcaattatatgacgactatgaacgatgatgcgttttagtcttgggcgtctattcaatatttatattattatcttaaaaaaaatccaatctttgtattgtcagtttggcgccgctgtcgcctgataagcctagtttaattagttgcgctagtcaaatggaacgtttatatatataaatattacaagttgggacgaagttcaattcgttgccaacttccttctcttccaatccatttcgttaattcggatgatatatacgatgatcgattatcatcatctcttgctggtcagcttgacaactgtacgcgtttgtttgtcactgattaattaaatttgtagttttaattagagcaaaaattaaaggacccaacacgtttacttttgtggtttaaaattaagttaccatgcttattcggagaaaaagaaaaatatatacacaccctttgattatgatgatggatccaaaactctatatgaccgtgtaaatagaccaattaatatctacactattctaaaagaagagcaatgaatttttgccaaaaaaaatgtttatatttttactaactactctttcatatgattttaatattacaaaatagagcacataattttaatcttagagtaaatttcacaaaactacaggtactttgcacaatctatcacaaaactacagatttaagaaattgtctcataaaactatagatttagggaccccgttatcacaaaactacaggttttagctctccccgttaaatctaccgtgacctgacaggggtggcccacttgcagtctcaggaaccttcaagatggttgccacatcagaaatcccatgtcaaatgcgtgcgtggtggaacggttgtacgaagaagttgcaggatgtgtttctatccctctcgtggacccagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgtgcacagttttttttttaaaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattatgaaataatttaaaggtaaatccacacttgcaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtaacaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaagggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactctgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggtgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaaaatgcacacttgagaacaaagagagcacttaaaacacttgagagcacaagatgaggagtg

SEQ ID NO: 31121 - DNA, 6597 bp, Oryza sativa
ccgtgccgtgccggcccgctacagtagccgggccgtgccgtgccggcccgcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctacgtggacccattcggtggccaattcctcactttccacgcgtgcatcgtcgtctcgcgtcttcgcctggtcaccgcatcgttcctctttggcctgaagaaaccctagccatagagatggcatcggcgaatagcgcgagcaagaagcgaagcataggtgcaccatcccagcaacagggtagcgtgagctgtgcattgggcaaggtatgcaatgtatatactagtggatttgagtgtgcgattggttttgattttgatttttcgaaattgggtttgatttggtgagttgggatcgaatgaaatctttggggtcgtaggaggtaagtctggatgcagtgcccttatatttggaagaaacagaatggcatggtgaggagaaaggaactcgattgcgctgcaagcatggattgtgtctagcacggagggtggcttgggaaggagaagacacaggcaggaggttcttgggctgtccattagaggtttgtttttttgttttctttgattttgttttttttttaattttcccccacaattttgacctgattttgttgggcttattcaggaagacgaggaccaatgcaagttcgttcaatgggtggatcctgaatgggactcgagggtgaagaagacactagctggcatgtgggatatggtggaccgtggagtgaaacgtgaagcaattattcaagctgacatgtttaaggcttttgccctgaaagaccgtttggagaaagagaagaatgatgagttagcccacaagaatgctctgcttgacatgagggaagcacaattgaaagaactgctctacaaatctgcctccgaagcaaacgagctatgttctccctcctcctaggttccccccttcatccccattattttgctcgttcccgcgtttcctctcttttgccgcccagggcgcaggaggactggcgtggttccttccaggagaaggaaaagtgcgtgcgtggactgacgattcaaccggaggaggagtgacatgggatttctgatgtggcaaccatcttgaaggttcctgagactgcaagtgggccacccctgtcaggtcacggtagatttaactgggagagctaagacctgtagttttgtgataacgaggtccctaaatctgtagttttatgagacaattttttaaatatgtagttttgtgatagattgtgcaaagtacctgtagttttgtgaaatttactcttaatcttattacatctctcaactacaaatttatcctgaaaagacgtctacacgtacacagatgaattgtactctatctataaaaaaaacatcacaatcgattctttccaaacatgcataattcatatttatttgtagcaaaacataggtattttgtttagtagctatattcaaataaaaacacatttatagaaataggagaaataattatatattgactctaattctgctttctaaatctaggtccgtggaattgtagaaaaattctatagttttttaggctttcccttgaaatggaggattttcaaaaggaatttcaccgaaactaaactaacttatgtaaaattcctgtaattttttctcacatagatcgtccttaaagtgagctgagcttacaacaataatatatgaattacaactttttccacatttgataacatacgactgattgtcaaaatattttcgctaggtaatggactaatagtggatatcgacgcagcaccctattgctacccgcgctaactaaattatactattaattaattagttcagtcattccatctttcacggagaaaaacctgctcttgatcgacaagaagtcatctcagaagtcagagttaatctgccagtctccaacttcttctgttcatcaggccaactgcaactaattgggtaggagtagcaaatatatgttaattaatttggataaaaaaaattggttggtagttccataggcactatagctgaattagcgccttaactcttcctcaacctgatagtaggaaaaaaagtccgagcatatatagatataaattcgaaagtggattccatgtagatagcatatccaatcaaagtggtagaatgatcggctggaatgctggatgcatgtgcaagggttagttgcaactagctgatgaactaatctgtactagattaaattcatcaacttgtctattgtgttcttaattatgtatcttggagttgttttattagaatctgcatatagttgtctgattgtctccaaaatgacatgctcaattaattactccctccgtattttaatttatgacgccgttgactttttaaccaacgtttgaccactcgtcttattcaaaatttttatacaaatataaaaatacttatgtcatgcttaaagaacatttgatgataaatcaagtcacaataaaataaattataattacataaattttttgaataagacgaaaggtcaaacgcttgtcaaaaagtcaacggcgtcatgcattaaaatatggagggagtatatattaacatatgatttaagtattccattagatcgagcacatgtacaataaccggctattagccttccacatcagctgttgcagtaagctagaggagagagttgagacgcgagagtgcaaagccgcaggcgactaaatagtctcaagaattaactccaactaagaaagagtgaaaattaagcaaaattttagaataagcagctgactgattattaggcttgctcagtaatatcagttaacctaatgtacattgaaccggaaattaatcacctagaaaacaagagaccgatggagggctcccggagaagaagaatggtttttacaattcaaataattaatgcatgtgcaacaatattctaaggcattaatcgatgttttattgagaatggtatatttgtactgataagaggatataatatatattagtattatgcttttcttgaagtatgtatatgatgatagtggatgtaggtaaacatgcacttgggttgtactaatgaaattgactaatttctcctctcatttttgataatattttatagttagtacctttcgttccatttcatcctccctgtaatatattcaagaaccggatctttcggcacgttctctcaacaatacagaaggaatcgttctattccatctttgtcttgccttcgtcgttatccccaatatgtcctaaccatagttaatactcctaccatttgttttcaaagttgctgttaagtggcctacgtgcaaattaaaatggacaagacaagtcatttcaattcgttggtacttgagcaatatactccctacgtttcaaaatatttgacaccgttaacttttcagtatgtgtttgacaatttgtcttattcaaaaaaatttaagtaattatttattctttttatatcatttgattcgttgttaaatatacttttatgtacacatatagttttatatatttcacaattttttttaataagacgaacagtctaacatgtactaaaaagtcaacggtgtcaagtattttaaaacggagggagtactatatagttagagccctggagctgaaatgtgctagctccataatatctatctcgatcgatcgtctgatcagttgtcgaacggaaaaggatcgatgggcgttcctgtagtgtcggcaaggtagatgcattattgaatcttagggccgttttaaattgaagctgaaatgtttttaccgatagtttcaatactagatagggtgattttagtccgaagccaaatcattggcattgccgatatccaatttgacactttctaaattcttatcaaaattttactagcttctaattatatgttggcctgctcagatttttaaggtgctcgtaggggtatggtgtgtgcgtgtgtttacaaggggtgagtgtacgtgcgttataagcatttaagtttgtaccgtgtttctaaaaaaatatattagcatctaaccaaataccactttacactactgtatctatatttcctaaacagttcaactgttgttggttgctctattaaaccacaataaaaattgaagtccacggtgagtagctgatagacaacgaaaaaactcaactaagcaacgaattgaaggttaaacttttatattcgtgttttaacgatttaaaaaccaatgcttaaaagataaattataatgagaaaaaacacaaaatcaactgtaaaatcaaataataaatttaaattttagttgtgaccgattagataataaccaggcaatgagagagaaaatatagccacgatggatttgttttaacagagaaaaaaaaagcttgtgtacatgtgcaatatatagtcgaaattgtgaataagttgagagaaaactaatgcgagatggattgtgcgtggatggggagattaattgctcgatcggtcgcgagccatctagtagttagatcgggaggcaagtcgcattgcaagtaagcgaagtctgaactctgaatttaacatggaaaattctcagacatgctcatcagatttcgcggcaagcaagcaaagctatgtaggctatggcgacgagttggatggtggtcagatcatcaccaattcccatcttctctgaaactggagctggtccacttgccgggaagcacgcacataccccacgtgctgaaactaatcgggatatagtggtggtgttcctcctcttccaacccttcttctacttgccggcgctccttgttctgatatacttcctccgtttcataatataagtctttctagtattgcccacatttatagagatgttaatgaatctagacatatatgtgtatctatattcattaacatctatatgaatatgagcaatactagaaagtcttacattatgaaacggagggagtagcaccactgcaattcttctttccagcgattggtcactgcatctccggatttctactcctagccgccggcagggatacctccggatatgggaaagaaaaaggttgcgtctctccggatttctactcctatagtcgccggctgggatacctccggatatgggaaaggaaaggttgtgccagcctagtaaaaaaaccggaccggcccagcggttgaatcgtaaaaccagaaccatgcctctcaccggttcggtttagtagaacggacggctcatgcatttgacccggtaagaaccgagtgaaccggatggtttttagtgaaaaccggcgaaccgggctaataagaaccggcggttcattgtaagttgggctaacgcttgggctagccttgtaaggcccatcatcctacaccacggcccatttatattttatgcaaaatataagagaaagcatgtgtgggaagtgatttgaacccgtgacttgcggattgagacattgggcctgttcactttgatgccattttcaaccttaccaaattttggtaaagttgcaaaaaaagtggctacgggcctgttcactttgatgccatttttaaccttaccaaatttttggtaaagttatcaaaaaagtggctacatttagtttgctgccaaattttggtaactatataagaaatcctgccaaaattttggcaagttgtcaaaattttggtaactatgctaaaatttggtaaggtttttttttggcatcaaagtaaacaggccctacatttagtttgctattaaattttgataactatataagaaatcctgtcaaaattttgacaagtttaccaaaattttggcaactataccaaaatgctaaaatttggtaaggtttttttttttttcatcaaagtgaacagacccattatcaagtttaccatattgctagcaaactcattttttttaatagaaaatatatagtagccatatacctccgttcagcattgaaccggctgactcgacggtccgatcggtgaacagtaaaccaacgagatcactaggtcgatcaccgtggtcttcttcgatttctccggcgagttctgacttctatccagtggcggaccaggtcctgggccacttaaggctatggcctgagacctgggtacgagagcccacattttcaccattctcttggaccgaataggtagtgggctggtcaggggctggcccaaacctgggtccgctggttcgctggcctcgggaataagatcactttgactccctcaactgaccacctaatctaaatcgtatccctcaaccgcaataacagaaatctcgaccccccaaacttgcaaaaccggtgcaatttgactccctcggtggtttgggggggtggtttcgctgacgtggcgcctatgtggtgatattgaccgagtctacggtccacgtggcgttaacgtggcacttacgtggcagtagaattaaaaaatatttgtgggacccattagtcattaaaaaaaaagtgggcccactaacatgtggggcccacatgtcagtcctt

SEQ ID NO: 31122 - DNA, 15522 bp, Oryza sativa
  unsure (1)..(15522): unsure at all n locations
ccgaatgggaagaaggggatagaaagagagagaaggaagagagggaggaggaagaagaaagggctgacatgtgggccccacatgtcagtgggcccacagtttttttgtgtgaatgactaatgggtcccacgtatattttttaattctactgccacgtaagtgccacgtcaacgccacgtggaccgaagactaggtcaatatctacatgtaggcgccacatggtgccatgtcagcgaaaccgcccccaaaaccgccgagggagtcaaattgcaccggtttcgcaagttcggggggtcgagatttctggtattacggttgagggatacgatttagattcggtggtcagttgagggagtcaaagtgatcttattccctggcctcgtcgatgtgtgttggagtccagcttgattagcgaaatgggctgtgatcccgctggactgcacatatgggccatgtgtctcaagcatggcaatttgggcccacaattgggtctagatgattaatgggccggtctaaatttcatgaatggaagtcacatttgagcccaacacgtttctcatggtccaaatggccctaggcttgcactctagatgacagcaattatatttgggcccatggaatcttcctgtggatgggcccaaatataattgctgccatctagagttactgtgataataattcaagaattaacattgtgccattgaaatcactagtatgtttaacatgaaggagtagcataattttgtgcttcttttcttttcatttcatgtttcctttttgctagaagcaaattgacatccattaaaaacagaggatctggactagcaatgacagtagggcttgctcatcacagttaaaactggaaatggaacataattgaagtggccagtgccatatatcgatctttctgtaatccctccttattacatgaaaatggagaaagttttggatggatgaatacaaatccaatccaaaccataccaaaaaaaaaaacaacaactaattaactttctttctttttgacaccaatagacagagaatgcaacaacacaaaagctactatacaccatgaattctcgctgtactggtgttctcacatacacatgcgcgtagaattcaacacaaaattaaaccaattcaacacgagatcgacgagcaccaacaaatcaaaaaaaagaacaagatacacaaaattaaacgacgatgatgaaccaaccatgcgaataatgaaacaaagaattattgaaaatgaggatgcagatgagagctcaagatggaaggcttgatgttgggatgatgaggatgaagaatcagtagtggtgggtgttgacgcggcggcaatggcggcggatctcgcccttggccttgggcggcaatggcagcttgctgagcttgacgagcgcgtcggagaaatcctcgtcccagagcgtgccattgtcggcgtactcgtggacatggccgcgcgccttcttctccgtgagcagctgccaatcggagttgaaggtgacgatcctcgcgaggttgttgtggtagtagctgttgtccaagaactcgaacttcctcagcttcgggaggaaggacgggatggtggcggcgacggcggcggggtcctcgtcgcggacgttgttgggcacgatcgggtcctcgccggcggcgcacttgccggcgaggaggctgcggtatcccgggaggatctgctcgggtggcgcggtgaggcgggcgccgagggaggaccagtggccgacgccgacggcgtgggcgccggagaggatgacgagctcctcgatggtgaagttcttgcggcggaagttgcggatgagctcggagatggtgaaggtggagtccgggaggtcgcgctgggcgtcggcggcgcgggagacgcggccgtcgaggcggccggcgaggacgtcgaagtggacgtggccgttgctgaggaggatggaggcgtcgcgggcggcgtagatgacgatgtcggcgcaggagaccacgcccgggcaccgctcctccaccgccgccttgatctcgtcgatgagctcgaacgcggcgaggccgatgttgatcggcgccgtcttctccgtgtgcgggttctccgccgtcgggtccagcagcaccgacgcgtcgcacccctgcaccacccattccaattcaaatcgatcattaacattcgcgcgtttttttaaaaaaaaaattactataatcagcaaccaattgagaattcaaatttgtcgtgcattttttacattgtaattaatcaatggcgccaaacaattcaaatacaaaaagttttcataaacttgaccaaacttaaaattgtttgcgtggtaaaaaaaggtcaaatcgttatactaaaatttgttcgaattttgaatttttttaggcagaaatatttcagaatttctgcattgtacaagtagaaccatagtaggataagcaggaatgatccataaatttgactggtaacaattagatgttttgggattagtgaatatcggggtaagatttaaatgtatgtcataattatgttagctaacggtaattatcacatgattagacaatacaattgataaaaaattaagcacgcgcaatgtagtcaactaataatgccttaaacactctgcatatgttgaagttctctatataccccaatttaggtagttagtcaattaacaatcttccacaccatattataagacgttttttttgacctatgtcaaactatatcaagtttgaccaagcttgttaaaaacttagcaacatataaaacaccgaattagttttattaaatccataattaaaaatatcattatattaaatttgttttgtattaaaatgctacttattctatagttgtttcatccttctttattctctcaaccaatgagcctaacactactaggccgaatcataccgtcctttggaccaaacatctccacggaatcgttcaattaattccacacatcatcgatctcatacctcctactcttgttccaccgtccaaaacactagtagttaatactaatactgttaactatatgtgtgcttggcaagtcatcctatctgtacttaagcacagttaggatctgtttgatagagctccaactcttaaatttagttttaagagttggatttggagtggagttgtggaacagtctaaatctagctccacctctctaatttattttgtgagaatgcttcaaccagatctactcttattttagatggagctgaaactgtttcgttgagctccaacttttaaaagatggagctgaagctatggcaaataaacctttaattatattagagccccttgagaaaaatgtgtgatagatcgatcgattgatcatcgtcagctgagttgttggaaaacgatatgcacatataattgcatatgtagtgtcggtgagagggcaaatgcattattggttcttaattacttgaacagttctattgctgctgatgcttaaaccacacaacgaaaagtccatgcatgctgcaacttgtatatatgtacatcatcttcttttattattttcttaaaaagaggagaacaaaaagaaagactaccgatgctaccgaccatttcgtctataatgtgctcattcaattccgtagccactaatgacctatgttgtattcttgcatgtctaaataaaatagtttcactctatatttttagtctaataacatgaacacaaattggctcgcacaaaccaatcaaaatatgtaatttaatcagaacaaatgcaactccaagaacttttagagccaagtaagctaggatgcttgcttggatgagagtgctgaaactctgtcagaacatgcactaattacttgttaatcaaaagggtaagtaaaaaaaagttcaattaattacttttactctcttttctattcatgactgaggagctagtggtaccaattattggtcatgactctggagagatataggtatgctttctctttctcaacacagtgtccccttttctctcccatatgtgtccttttcctctctctctctctctctctctctctctctcctagacaatcagcacaagaaaacaatttgccccataggaagcaaagaagctctggccccaagcacaatccaaacataatcatatcccactaattgagcttacctagaaatcgaacaccaataaaatcatgtttaactactactactactaatatgatatacatgagagtctaattaattaattatttgtgtgtatgcaaaacgtactgatgatgcatgaaccaattgaataggtagttacatgttgcttgccaatcacagcaacatcagcagcagctgcatctggctggcacccatgcagagaaaagaaaggagagggaataaactgacgacaagggcatagtgtttctgggaccctagagctaattaagctaagctaatgcagcttaattatgtgtttagctaagcagccagaagggaaaaaaaaaggtgtagcatgcattgacagtccaaatgatggacacaaggaaagtatcacattcgattccagcatgcatgttgcagatgctgaattgctggctaccaatctctctctctctctctatctatctatctttctctctctaatctacctttagtttctctctcttgccatgttggattagtagtgaactagtagaagtcaagtagctcacgaaactagcttagcttagcttagctaggtctccattgaacttttcttttcttttgtgcatggaaagaaaggaagagaaagaagaagaaactgtctctggatggagtgatgacagtgtgtcaaatgcagtggcgtgtggctgctaacttgctgataactatctgtgttgatcttgacaacaaccaaccaagtggggttcagagacttaactaagaagctgtgttatgtatattagcttaagatttgatcatttctcatacacgcttatgcggcgacgacgacgttggtgtaagataagatgctgattgagtagttgcttagttagtttgtgtaaatgttgctgttatttccatcaagagtaaagttgttttccttattaattaatcaactaacctagctagaatgtgataagtttcctcgatggatcgatcacctgatgagtgattctgaagaatgaaaccaactgtaacacaactaaactctgcaaagccaagttgtactatgtacacacacaactaactaacagttaagctagctagtaaaccttagctagtacgtactgcaaatgtagattgatatatatggatggatcaatcatgagccgctacaataattgatatgcaagaaagttaattatctgattgagataattaccctgacgaagcagtcgtggaagatgaggcggacgagggcggcgccttccttgcgattcgccttgagcgccttggcgacatggtacctcaccacgttctccactccgggacaactcttcttgtagtaatccacgctcagctccgcctccaccgacatcgccgccgccgccaccaccaccatcaccaccaccgccgccgccaacctcatcgtcatcctcctcctctccggcaacttaatttctcgctatcgatgggtacgtcgccttttctcgctctccggccacgcgccgcctcgtgtgtagcggtggttggttggcgaggcagtgtggagggaagcaaagaggggggtggagaggagaagaaggggtggcaggtggtatatatatcgttgcacgatcgatgggaaattgcgttttaacggtcagctttgctaagtgatgatgtgagcggggtcatcatgtgtgacagtgaagtgccaccgcgcaaaaacgcttgtaatttaactttaattcgcagatcagtttagtttacagagttttcagagagaaagggagagagtgatgggctctgatgcttcagtaagacagtaatcactgtactgcttcttcttcttcttctagtaggagtatatcttaagaattaagaagaatgaggagattagaagaaaaaggagagaaataaaagtacctaaaagggttcgatttatgcttgttactatcgcgccacctaactgcagttggggcgttgacggatcgatccgtgcgtgccatactgccatggcgtgtcactgatctctgatgtaattcatgatcgatatcaaatatggaggtagtacgtacgtcttgccgcttcgagaaatgcgcgcagcccacgccacagtcgccggccggaaccccttgccgtcgttacgccggcgtgtcgagggggccagcatatgtcgagattacgaagttacacacaacgcaatcgcccagaccgacttatgttaggagaagggagaaaaagcaaaagaaacttagagaaactacggcggctaaaaacagactccaagcggcggaaggcaccgagccatgctacactcccaacaaatccccagaaacagcgacgccagctaaatgccacatatggctctatgaatggatggactccagaaccactgagactaaagagagagtggatcaaggaagcacccgtgtcaaatatattgacgtgcaatccttttgcgcattcgtgaaaaaaatattatgaagttatcaaggaagcacccgtgttaaatttataatttaaatccaagtagattgattccaccacaaggaatctaaccagttgagatacgctcacttcattaaaaaaaaactgtacaatttacaagacaagtgtaaatattaagaacaaagggagtatgatttatttatgtacaacaataattatcgaattacttgtatacatgtgcgccgactggtttcgatataatcctaccatctccaacataaatatttaatgtttatgataatgtttggtcaagcttttaatattttgatcattaaaaattttatgttggaataagtttgtaaaacacattaagtttatgatatcttgcttcctaattaagtcaaatatagacatataattacttttgtatttttttaataaactaatcaatttgagaaatcgtcgatggtttgagttttaaaaatcaaatattgtactaaacatcaaatatttttatgagtatgaaacatgttatgttcatacaaaagtacaagtgaatttaccaatcgtcgccactcatgaatagcttgatatttgctcattagcctctccttctccttgaactccggtcggttgttggcgaggcgctgtcggtggcacaagaaaaccgtgcacacatcacgcattgatcgatacatctatcggcatttctaactggagctagcataaggttaaatttcgatccaacctcaattacgaattcagatggatggatggatgcaatcgtgttgagcatatttcgaatcatatcctggtggttgcagagttccattccatcccatcgtttttcctttttgttgagatcattaaacaacttaatttctcgtttctttgacacgcacacatagattaatgctctatgtatatgtacgaacagtagtgactccatgatccgtccatgccaacgtccctccctgctggccctttgccttctcaatttttagtcgctttcgtgcaacctccttgtactgccatactacatatgcattctctttgtctcggtcgtctctctgattaactagacgacacctcgcacgttacacgggaaattatatgaaacaaatatcaattttaactaaatacctataatatgtatgatatataaaagtgatatttttttttaggaaggggcaggtgctctgccaatttcattatagaaggagagaaaaagcgaaggttcaccgacaaatggtgtcacatagtaggaacatgagggggtacaagaattttgaaaaaaatacaaagcaactttctactggtctattggtttagcttctggcttctcgatgtgtggcctcacgtacgcataggcttctttacaagagtaaatgatgttagtgggttgtaactatataatacaggattttcaaaagtattccgtgtttatgtatactccctccttcatgttacgaataagttatgtattttgtaaaatgcacaattaatgtgtctgtaaattcttatcatcaatatctttgcaatacttcgattcaattttgaaaacggtatggctagatctgttttggggtacattttaaaatatattttgcattttgtactagcaattaaaaataaactagtgcataggtgatcattcatatcactgtagtacaaactaaacgccactatttataactgaatttagtagtaccatatacacactcttccaatcaatctactcctacccatccattttttcttgtctgtatacatatcctgtcatgcatggcagattgattgcacagaaagtaagcaacagcagctgaattaaggccatccagaatgatgaacagtattatacaatgtggtaattagcctttatttggaggccagtacacaaacacaataatattcaggctcatcaatgaccagcaagtgtctgcaaatggttaggcacattacatttggccgtgtcttcttgctgtatgcataaactagtttagatctactaatataaactgttcatgatgccatgcacttgcaggtagtagctgcaggtgacatgtcaatctcatacaagtaggaatatatagcatcatggaaatattaaaacttaacgatttctctcaagtcaatattataaatatagatggaactgatctgtcatctctcttcctcctccatctttaatcattntctcccgttttcttagaccgaccttttgattaatcttttcttgagttctgcaatgccgatgcagacacgcaacttgtttaattcgtgcctgaattgaagcctagtggctagcaggcagctgcaagcaagcttccaattcagcacaagtcttcaattcagaacaagtcttcagaacttaacaaccatccttggcaagctagcaagctagtagatgcatataaccttaattggccatgaaaaaagtctaatcaaaggtggtccatgaataataattccaaagtttatcaagcacgcaggctgctctccatgctagctcggattattccaactttgccttgatattgaatagactgtgcacttgcttttgctttctttgcaatttgccatactgctagctccagctatatttgctcatttttaattgaagcctttgatacatgctggagtattaatgaattaaactagctagcattggggggctacaacttagttaattagtagttacatgtgatccctactttatatgtagatacttagatgatcagtgttagatactaatattactcatgctgtgtacttgagtaccactttgtttgattagtgttggagtacagacagaatattcatcatggaaagtaggtaggaggagtacatgggagaaaataaattcaagggttgtcaggcccaacagagattgcatatttagtagaggacttaattagttttttttaagtaagagcacttaactatagataatttgaccatgccaaaaaagcttgcactaataattaatgtacttccctaaaaaagtttgccccagtaatattagtagtagtattagtatttgatagagatgctccaactatgtagcagatcaaaatagcagttttaatttatagatcatgtgcatcaattcatatagccatcattctttatgggtattatactccaacttgtaagtgtgatacttaccttaatctgcagtaatgatggtgccgtgtgtatatacacatctcctcctatattagtcaaagatttgtgtctatgcaatgtatttgtacatctctggaatggttggggcaggatcatcttgacactgatcaatgtccccttgttcgtttgtttatttggatgcaatgtttctttctttccaactcttttgtgcgtgtttggacatgatttagtaaaagctgatgatgcaatatggaccattcaaatcaatcaaggaatttggattatgagagagatgatcatagaagccggggttggtccattcctctagctttcgccatttttccttttcgtaagctagaacatcactgttaggaccatcttgggttactatgataatgtaagagcaaatagtagctaccagactaagatccaatttttcaattaattattaattaattaaccaaaatattaatggggatagacctagtgtaatgacataattaattgtactggtgaatgaggagatgacaagctatataggtagatagagaggttgttgacagcagtaggaagtactgaagtggcagcttgttagaaagaaaccgatgatttaattttgtaattagggcttcggccgacacacggcgctcaggtaattggatgaattaattagttttaatttatacccatccatctatataagtttgtattctgtttcgacccgtgtatatgtgctggtttcgatttaggcacattaattaaactcaagtgctcgtttggtgaccttatatatgaaaagactatacaggtttacaccagcttatttcagccattgcacatttcagattaacccttttatataaaacaagaaataacttgtaattaaggtcagtgattacaatttcggttcgaaatctcggttatctcagccaaattttttggtttttctcaaaaaaaatttacaaatttgatcaaaatatagtcaaattatcaattaaattatgttaaaatttttaaaaaaattcggtccaataagtgccgaaaatacaccctccaggttgataatacttatcattttgaacaagagcacagtctccaaaaattaaccattatttttcattataatatgtataaaagtgttaacaaatatatgattttattaaagtactttttagagaaaattccctacatacccctgaaaagtttcgcgatctcttctatacccctgagttttgcctcatcccctacatgcccttgagttttcattttgatctcctctatccctattccgttagttgaccgtgagttgactgttaaatttttctaaaatgaccatatcgcccatttcccattcttacagtacatgttatatactctacttcataattcacaatgtgaaaaattgtaactcatgataaaatcaaataggacataattatttattgaaaagaaaatttaaactattgaacaaatttattttttttgacaaaatccatataagagctttagctagaaattgtgaaccaaaattatttatttgttgggttcaaattttgatgaaaacaatgtacggatatcataaaagttaatttaaaatttatttttttttaaaaaatgttgtcaaataattatattccctttgtttatttacaaacagatcttttttcatataataattgtgtttttgtcattaaactagcacataagtataagagaggggtaatatagtcaattttaataacatttaacggtcaactcacggtcaactaacggaattaatgggcatagaggagatcaaaataaaaactcagaggtatataagggatgaggcaaaatttaggagtacataagggagtggatgaattctcaaggatatacagggggttttctctactttttaagactaatctatacatatagtcaccattagtcactatatgtgaaagataaatattttaaaaatgattcataatcaaagattataaagtttgacctcacccttatttaaaacgataagtattattagcccggagaaagtactgaaatttcggccaaaatcgaaattgaaaaccctgaatcagatattatgtgtagtgagcccactcctacagaagagcagagagctaggttttgtggatttggaggctaattgtcttacacgtatgctagcttaattaactggtgatatgaaatgtattgtcggtcacagtgttgatacctagttttggtggtgattaaatgatgaacatgtgtacctgagatgagcttaactgtttttgggtaagtacaaatagagacaaaatgtgcgtgagacacgcgtgtcatatatatctacaatgtaacaaggtgaggtgttgctggctagtgtggtagcagcatgtggttgtacatctccatttcttgattggcctggcccacccaccattggttgctctcatcggcaaaacactattttgcactttcctgtgataagaggggatccatcagttggttagatcagcatatgcgaaatgctctcgacttccaaatatagggagggttcagcaagccggctgcaacggctaaggctacggctgcacacggtgagtgtgacactgttcataccggttacggtgcaaccatgaaagtagcagccaaatagaccataatgtaatgacttctaaatgtatcaacatttaacactctgagtgtataactgtaatgacttttaaacattacatttgatcatctgtcttataaaaaaactatataaatatattatttattttgttatgagatttatcgttaaatggactttatttctttttttttgcatattttaatattttaaataagacatattatcaaatattatgtttaaaagccaactattacagattcaaaaagaaaatgatatattaaagtacaagtgaattatccctctccattcattaacagatgcaatctgatatgatattaacgtcgtatcaggttgcacggaatatagtcatattttctttttctgaatactgacacatcagtggaaccagccatcataataccattgaatctaatttaacccgattttatgtatccggtatcgcgtttagggatacgatttaaactcgacggaaatacaacgaatgtaaagtggacttatcctgcccgaatttacaaggcccaagcccaaaaggcccatccaactcacatcgggctacgtgggccgcccggcccacacacaacccagaaaaccgccttactaccgacaatgttagctccctctctcttcctcttcgtctcgactctgaactaaaaactcaactcctcccaaaatccctcgccgccgccgccgccgccgccgacgacgacgacatgggccccaccacggccaccgacaccggcgcgaggatgaagcccacgaccgtcgcgtcggcggtgcaccgcgtccagatggcgctctacgacggcgccgcggcgtcgagggagccgctgctccgcgcggcggcctcgctgctctcggggccggactacgccgacgtcgtcacggagcgctccatcgccgacgcctgcgggtacccggcgtgccccaacccgctcccctcggaggacgcccgcggcaaggcggcgccgcggttccgcatctcgctccgggagcaccgcgtgtacgacctcgaggaggcccgcaagttctgctccgagcgctgcctcgtcgcctccgccgccttcggggcgtcgctcccgcccgaccgccccttcggcgtctcgcccgaccggctcgacgccctcgtcgcgctcttcgagggcggtggtggtggtggtgatgacggtgggttggcgctagggtttggggcgagcggcgatgggaaggaggtggaagaggggaggaaggtggagatcatggagaaggaggcggctgggacgggggaggtgacgctgcaggagtggattgggccgtcggacgccatcgagggctatgtgcctcgccgtgatcgcgtcgttggaggtgaatcgccttttgctgacctcttctatttctatttgcattgagcattgattggtttttctgttcaaattatttactcgtttggtttgattgtgctgccataggttagtagtacgatgagtgaggtttatggcggtggcattctctgttatcctttgtgctcaaattaggtagagaaaaaactttggaagatagaaaatggaggaatttgtagtgttcgtagtaaattactttgagtatcaacaattgttgttgctagtagcagttaggaaaattctctgtaacatgtacaactacaacattttggtgaactagttataaactccttgtgtaaaatctccctacctgattagcaaattagtagcatttgtgtatgactagaaacaatcaactaggtaataattgagagctatcaaatatggtaagggacagctgaagaatagacataaccgtggtgccatattttttggttgcagtcattcaaattacaagaggacaactaggcaattcactcattttgtttagacctacatattgttgttgataagggacgctagaacgaagataggagattgagagagtaattaatttttggaagtacgttacagattttaatgggaggtagtgacttcttttttgagagattagaggggtgagagatgagctgcttactttgtcaatgaaaagcgctcaggttttgttcaatatttccccgaagaaatacaaaaatcatgtctttgtaagcatcatgtgttgttcctcttttctcactgctcacggaggtgcctaaactgcctaacaaggtggcaaactggtccctagtgcctaaacaccaagccaccaaggcagtggtggtttggtgggagtgtggtggtacttagctcctacctcctaggcactgtttgtttttcttatattcaaataatgttctagaactagatgtgacaatgttacaagagtaacaatagttttacttgcaggcacatttatatatatgaaaaggatatgctcattcttgctctttgttcgacctgtcttagtttcgaacaattgaagaaacaatgagcttgtgttctgtatttcagggccaaaaaaagaggctaaacagaacgatgcttgtagtgctgagcagtccagtaatattaatgtggattctaggaatgcttcttctggtgaatccggcatggttcttactgagaatacaaaagcaaagaaaaaggaagcaaccaaaaccccattgaagatgttcaagcaggatgaagataatgatatgttgtcgtcttgcatatcggattccattgtgaagcagctggaggatgtagttctcgaagagaaaaaggataagaagaaaaataaagcagctaaaggaacatcgagggtaggtaagagtaagcctgcaaaaagaccagttgggcgtgatggacatgaagtggactttacaagtacaattattatgggtgatcgtggttcagaaatgatggatcatggtgctctgggtcaatataatttctcaagttctatattagcaaatgagcagccttcatcatctcaatatgcagcgatagattcagtgcaagcttacactgaagaactagatgaattatttagtaatgcagttaacattgcaaaagacgagacaagtgatgatagtggtagatgtacactaagatcttcattgaaggctgttggatccaagaatgcagggcattctgtgaaatgggcagacgagaatggaagtgtgttagagacaagcagagcatttgtaagtcactccagtaaatctcaagaaagcatggacagttcagtaggcgtgaatctgcagaagcttgtgcagctgcgcttattgaagcagcag

SEQ ID NO: 31123 - DNA, 9575 bp, Oryza sativa
tcatttttgatatgtattaacctgtgccttttggtaacagtttcaaaggcaggaatcatcatactgccggacatggttaaccagcaacagtacaataatgattatgacaatgacaaagatgcaggggaaaatgaaatatttgaaattgataggggtgttgtgaagtggccgaagaagactgtgcttctagacacagatatgtttgatgtcgatgattcttggcatgatacaccaccagaaggctttagtctaactgtaagaattcttgagaaaaaataaagtagcacttcttcttttttttccttctggttgaatttggcatgtcatgccttttttccttttcagctgtcctccttcgcaacgatgtgggctgcattatttggatgggtatcccggtcctcattggcctatgtgtatgggcttgatgaaagttctatggaagatttgttgattgcaggtggaagagaatgtcctcagaagagagttttaaatgatggccactcatctgaaattagaagagctttggatacttgtgtgtgtaatgccctgccagttcttgtatcaaacttgaggatgcaaattccagtctcaaagttggagattactctggtatggataaagctagttgaacaaactaattaaaaagttaaaacattttttaaaagaaaagaataaggactccgcaattggttagtgacctagttgaacctggatatgtatttactggctagtacatatagtttttcagcagcggctgtgaagaggcttttcgttgcattttgttctggtatctagacacctttgactgagatcaatcaagctactaatatcttggtcagtttaacaataatttcttagtcatttggggttctctctcattcataagtgtgggtgatgagctgcgcatatctggaaatagataagacgaagtggaggctgtacgttacagttattctgaattagggccagtctcttttttgttgattctattgaagacagcttaactgctagatgttgccaccaagaattttatttgttagtttgattacagtttcagtaattaacatttagagctataattagtgtgcatctaatgtgtttttcccctccccactagggatacttgttggacacgatgtcatttgttgatgcactgccttctctgagatcaaggcagtggcaattgatggttctcgtgctgcttgatgcgctctcactccatcggcttcctgctcttgctccaataatgtcagattcgaagcttttgcagaaggtgatgatgcctttccctgcctttctgctatgcaagtagacggatgcacatattctttttaagaaatctgatctttcttcccttttgtgtgctgcagcttttgaactcggctcaggttagccgagaggagtatgactccatgattgatctcctcctcccttttggaagatccacgcagagccaggcatccctgccaagttaaacctcaagcaacacaagtatctaaatacatgtttacacagcggagtaaatagagagaggttctacatatcagcgtcagcttggcagtctattcggatatactatcataatggtgcctcttgcgtctggttgtttaggtttcggaacacgtcttgcaaaatatcggttgctcccagttgcttcaactatcccctttgcattggcgtcagacgtacaagcggagcgggcactgattcctgtcattctcaggaattgttagctttagtgaggagagcaaaagataactgcctccagaacaatttggtccactatggacttttatctctcattgctagcgcagttcagaattgtagtgcatctttgggttttttttttacctcttttaccggtgtgcagtttgtcaagttagtacagcctgatttgaccagcatacaacccattgtgagtccttataggtgagtgctagatatcaagtggtatagtaaacccagtgttagcatctataaaattctgaattttatgcctgtcaatctcgcatttatggtcaatcggagacttgcagtggctgtaactttctacaagttggcatctcattgcagagagagaagaacaagagcaaaaaggttggcggctgatggctgaagtgcgaatacattgaaaacccaggtgctgccttatcgcaagagacttaaaagggaggagcccaaaaggagaggttagaccattattagcttggtgtgaagtgtgaacagagctgcctgagcttgaggattagcagcaaacttagtagcgtgtgtgcctcttttttccatgtgaaatcgtcgctaatttggattcatgtcctgattggctccttgtctcgataggaatttgacaatcctttaggtatttcgtctgaccggttgcctagattatccactctataaatgatagcagtatcagccccaacgcccaacaactagcctaaacgctttaacactacctaggtttttgttttggtgagctggagatatgtgtatgcatctaacactgatattccatctattccaaaataaatataactacgcctagtacttaaaaaatatatttattaaaatataagcggttctagcactatttaatgcaagttacctttcatctaaacttctcatcttacccaaagactcccatcctcagaaatatccatattttgaaagtaaaaattcaacggaacgtattttctgcttagctcatttcattgattcttctacaattagcaaggaaatagtattttcctgcttagctaatttcattgattcttgaactgcttggttcacaaaccaggaagagcctgttttgctctccatagtcttacgtggtgtttggattagtccatgtatttagaaactaatttaatttaaagtactaaatatagactacttacaaaactaattatataaatgaaagctaattcgcgaaataaattttttaaagcttaattaatccataattagtaaacattatataaatgaaagctaattcgcgaaataaattttttaaagcttaattaatccataattagataatgtttactgcagcatcacatagactaattatgggttaattaggcttaatagattcatcttgcgaattagtccaagattatagataggttttattaatagtctatgtttaatatttataattaatgtcaaatattcgatgtgataaggacttaaaagttttagtcccatctaaaaaaggtctaaatctatctcaacgaattggtctttcaagaatgggacaatcaagaatctcacagcaacttggtaaaagagcatttcacagagagagagagagagagagagagagagagagtattgctcaagggaagctagtccatccatacatgaactcaacagagatatgtacaacagcaatggtgtgaacaatagcagtaacatgtcaacaaaacgcagaaaaataataacgaggaaaaaaaatggcctacaaaactgccggctgctcaccctccctgctccacctcagcagcctctcaacaaatcagaagaacaaaaaacaactaatgtcagcatatgtacacaagtgtgaagtggccacaaccaaacaccggcgcctcgccctagcgatcagtctccagccagctcctcaggttgcacagggcctccgcagagaggctcttgcaactcctcggcctcgccacccccgcctgcccccccacctgctcctgccgcggcgacccaagctccgagacgaagcagacgacgatcaccgtcaggttgtcggcggtctcgagcctcttggcctccatgacaagctccctcgcgcacctctcggggtcgtcgtgctgccggagcccccgtcggacgatgctcaccgcgtgctggctggtcatcacgtcccagatcccgtcgcaccccatgatgaggaactcgtcgtcctccgtgagcatggtctgtcggaactctggctcggcgatgagaggggatatcgagccgtcgggcattttcatgtcccagtcccctagggcccgtgtcacggataggactccgttgaggtagccatcctcgatgtatcctccggatgcagcaacccgttcacactcctcggcatagtttgctctgtgatctcgagacatctccatcgctacgcctctccggcaaaggaccgcacggcaatcccccgcatttgcaaccagcaattgcctgcaagacagttcagcagaacctcgagtgagcatccacactgaagcatgagatgtgcaactatagatactggatatgtttttttttaccttccgaagactaatgcggtgagtgctgtagttccggaagagcggctgatatctaaatcatcagctaaggcaagatctgcttgcaagaacgctctgcgcacagagttctcaactgactgaacatatgtttcatctacttgcgatgcttgtgggaactcactgtcctcaaacaggaacctcattgcatgccttttcatgtaggctgcagcatccaggcctccatggccatcgaagacctaaaattgcaaagggaagaagcacgggcaataagttcaaccattgttgctgaggaagtagcattcacaaatcacaaatcagggtaggcattcacatagaagattacacttaccccatagaaggcactaggcaacggacacaccaagagcgatccaagatgggcagagagatcatctatccggatgtgctcatcttccatgtacctcctaggtccaatatcagcaaagctaccagatcgaatactgggaacaaactgtagtgcatcaactgatatgctcggtgcaccagcagcactctccaacccctattaataatgaacagaaacacaaaaattactaatcttatttctcagacacaaaacaaacataaacaaccaattcttccttaatctgctaaattatatacccagcactgccactgacctacttgcgtagttatgtttcaaacataatcctatcctgccgctcacgcagcactatgatttaccccactaccccactctacactgaaataagatactgaacaagagctgaaaagtttcagctacagctatagaaacaggacaacacttttaggctagataaacaatcatctgcgcaaattcgtatgataagttgaacttgcgcgaaagcgcataaatacatactacaactcaactaccactagcactatctacacaatggatccaataatatcagcacccaccttctcaaccttctggcctacaaccaccaccctataccccctaaaaagggactacttttttttttcttacaaactgtgtcagtcttttgcatccacgaacagaaaacaatctcgtgtaataaacagaaaggcagtaaactccataataaacctaaaatccaataacaagatgacagcaataatttacatagagatatctaaaaatcagagctgattacaacaactgaaagcacctttttcacatgagtagtattaacaaacaatcctaaaattactgaaaaacagctgctaaactgctagtaatccttgctagattccatgttatttcccacgaaattcttcgatctcccaactgaaatactactgaaaacgtagaactacagaacacaaagttgagcaactcaccatgtgaggcacctggacggcaacctcgacctcgaccaccggcggcggcgcgaccgccgccgcggcggccacctcctcgacacccttgcgacgcaccggtggtacggcacctccaacaccggcacgggctgatgcatcacctccgcctccgccaccatctctcccctcccgatccaaacaccaccgcctctccggtcaccggagaaaaaaaaataaaaaaaaaatcaagaaaccgagcagcgatcgatccgcgcgagaggccgcgatccgaggggggagagggcgatctcgatggtttctaggacacggtttcttgatctgaggaggaggaaggagaagaggaagggggaagaaatgggggaagaggaggaggggtggttggtatttatccggtggcggtgaccggcggcgaccggcgacgatgcggacgggtgaccgggtggtgccggtggcctcaccggacacgtggcggtctcacgcccgtgtgattgcgctgccgacctcgcctccctctttcttctagattggatggaggccaagggagagtgataaaagatgtgttttttttactaatctagagttctaatcaaatgatttactacttacagtgttaattactggattagttagaggcttgggagtgatgaagaatgtgtcttttttttttgagtggtaatcaaatgatttattgaaatgtttgtgttagaaggaagaacaagctaaaaaaggatgtaatttttttgcaagaatgatttggattggaggtggtgagatgcactttggtttgaaaaagaatgtgtctatttggagtgctaatcaaatgaaatggtctatggaaatgtttgtgacacaaggaagaacaagctaaaaaaatgtaattttgcaagaaatatttggattagagggagtggttcttttgcatatgggtgatggtggtggtgtttatatatgcacttgtttggtttgatcagctttgattttcgggaggtgtggtcaatttgagtgttttttgtgctggtttacagtttttgttgcatacgttgtttttgggtggttaatttgaggttaggggtgttacaaacttacagtacattgattaattagctggtgttttaaagtgtttaattactaactcgtggtaaatgcatagcaggtttgctcttttcctgtttttaaccaggcagttttggttgggaacaaaaggcaggttattcttacttttttgaagggaatataatgagaatcacacatgctaacggtacaaagattactactttttttaaggggaaaaaatggcaatcacttgcaggtgggagtgactgtttcttgcacgtcatcaactgaatctctgtccacgtgttcgaacttgctgttaatcactgaacagcagagcagcttaagtagcaagaaggaatctttgtaaccctttgtcatcttatctcttgggcaagaataagatggcaaattagattgttgtctactgcctgtcagtggaatcacaatggaagatatcaagataagtacatgattaagaacaattagagatttagaggatctgagaggcatcaatcaaatcttattatgaaaatttagccactattatcttcctgaatatgacatgacaaagagagacggtggatcaaatcaaaacggatataagaaaatcgagtttttttagtagggtatgttttatccggcctctacatgcaaccagatatatatagcctttttaaattagaaacttagcttctcaaataacacaatctgaaatcgagttaggaagttgatgctttatgggcatgattagttactagtttattttatactacagttcctgcaacagggtgcgatcatttaaaaaagaaggtggccaatccaataaatagattgtactagaaatattagtgaataaattacatttcaatgtagttagaggcctagaggacgatcatgtctgcaaaatttaagtaaacatattccaacagaaattttgcaagaaaagtatttttcataacactataatgttatgaaacatacttttcaagacaattcttctcatatggttttcacacgttaaatctgaatatttaaactaaattggcgaagagaagttgttcttccttcatacacccaattaagttataagattgactgtgatagtgtgatatctatccccattggtgtctacagtacatatagcttatgattatttttttagaaaaaaaggagtgaagtaaatgaaaaaattgctttccaaataacagacacaaacggtgcaagatttatatataatgttgacaaagcagtggcacaccggacagcctgacgtaattgtgatccaaatcactgttctaacacaggatgagctaatccgatccacttcaagttcataaatgacacaagattgcttcatttggggataaactaaataatccaaatatataatttataattgcaatgctattgcttgcagttccctttccttttcgtatcactttcttcctacaagaagcgaactcttgtggcttcatttgttcctgacgcatcttcactttgtacaagttgaccaaaagaaatagacaacataagaagatcttttacaattgaatggtggataatttaaggaattgtgaagtaatatttttttagtcagagattgtgctccatttcttttgacaaatttaattgggaatttgggattgctctttattttttatcgaaaatattacttgtttcttcagtcacaagataaacaaaaacttatgacaaatgatttggaatagtaaaaaaacccaaatatcagacaacttcactaacaccacatatatagtactgaaagaaaatgttggaatctcacgcaggcctcaattgaaacaactttatattttttgtcgaaactattacttgtttcttccaatcacaagatagtaaaaaaaaaaactagtgagaaatgatttggaatagtaaaaaaccacatacacaaagtatcaaacaatttcattaacagcatttatagtactgaaacaaaaatgttggaatctaaagtgaaactctaccagctctcaggtttaagttagttaattcatttttcttgaagtttcttgtgctggagccaatgggagggcaacaggtcatctcctaagaatagtggtgacaaagaaagttggcccctttcttccactcctgtcctctggagctccctttcttgtctgtagttggttgagaaaattggcaagcaagactgtcttcttgttttttggggcctcatcatcaccatcactaccattcattttaaggtcacctttgcaagaactgaaaaaaaaagccaggtggcagtggcactaatcacactccagctagtttgtggattgtaagaaaaagagggagagaaatgcagcatatatgtattctggatttttttgggggcccctttcttcttgttgttcagccacaaattcaggaagcttctagatgtttggtctgatggaagacaaccaaaatggcctgatgagtttctggtcaggaaatcaaatcaattttgttattttccagtgcatgcatgattgagtagttggttagggatgagcaagcttatgaaatatgtggttgttttatcttgttcagcattatactaattgtgtatatatatgtaattaacttattgtcatatgcacaagaatacgtaacagttagacaggataagatttcttcttcccactgccttaatattattgtttttggttcactaataaaagtttttttttctagtcttcctttggtttctttccaattttaatgttttatgttgggtgtaggtatgcattcctcattgtatcctacaagccacacctgaaagcaataggtgcaaaatctgaaaacgttacaggagtacatcatatgacaacgcaatctaactaccattgtgaaaaagataatgcaatgcaatgggattagcaataa

SEQ ID NO: 31124 - DNA, 8729 bp, Oryza sativa
aatgcaatgggattagcaataaatgaatactatgcaaaacacatgagtatgtcaacatatcaagaatgataagtaccagtcagtaggccaggcccagcccacagcccagcccaaaaataaattcataacttgccctaaacaagatttaagtctatctcacattgtgcaccactggagtacaatagcataagctcaggcataatctgcaaatttcttttatatcattgtctttttagaggataataacattgatcaacttattatctaatggcataataatatttcatagtattaaacaggaggaaacaaagtccaatctcacttttacatcatactagcttcttgctagtagtaactccttagcaacctaatccatttaattgactactttgagaaaaacacacaaaaagtctatgagcgtgtttccttttgtcaagtttcgtgtatttttgatattaagagtctaaccaccaaagtgtacttgaataaaaagtcgtccaattaagctgctatattcaactaatccattcaaattttggagtttgaatcagaccgactcacactggcccatatatgcataccgcataaatttctcaccaatcaaatgtcagaaatacttcaataggttttgaaagtttgaaacaacaaaccgtgtatacatttcatccccacacacattgattgcacgcagctgacaaattcattgagcattgcaccaacgagttgaaaatttcaaatccaaggaactgatcagttcgtccgtagtaagtactagagctactgctaattaattactacatgatgcagactttatcaaattaatattgactgtatgctcacatgaacatgtgagtactatacatggccaatcatatagagacaaccatggtaaagatagcttttgtatttttagccaaaccttcaatatttttagaactgcatgatttggtctgaaatttgaccgatttaaggtgctacaccaaataaaaaatgacacaaaatgtggattagactgagtaattaaattaagatggtttggtttgatcgggtcggttggacctgttgagccgtagcgtcctgccggccgtccaacagcctgtcatgtcggccattgcttccgattaatttgtcttaggctacatcattaccagcttaatgcttagctacttctcattttcagtgaacatgattttcgacggatgcataaacgagtacgtattttatactccctccattccaaaatataaggcacaaccaattttcttagatgttcctgtaaaatcaaatgtgtttttgattattattctgtgatgaacaattgagcattggagattagtggttttggagatgattggattcacaggtgatcgcaggattcattatttcatgtgaccggtcagaccgggctctggtagccggtcggaccggcggtatgcgcgtggtcaggtggtctgaccggccgacactgtgtcggtttcggtttcgggttgtttgtttggatatccatgattatttcataattatgacttctagatggatactatactatgtaatactgttgtttgctactaatgagtcaagttggagatagcttggtctcggaatatggtttctttgtttgttccatgtgtaggtgactcgatgtctcgggagagtatttgcggtgatggaccaggagtcggcttggggataaggcgacgtccgtggtggtcagagatcatgcgggatacttaggctagagttgatgcacgtggttgatagagattccatatggcatatgatggagttattgtgtgcgtatgggatgcggagtcaaatttggaaggagtccaaatttggtacgattggttatgtaaagtttctttcttgtactagagggtttcctaatgtgtttaggactcttagtatgagtttggttcgtggctttaggctgcctacctcatgtataaatagagggggagcgtgaggcttcccggtatcgcttttgagagcaattgagttgagttttgagttagggtttcgagtttagtcgaaatttttataaggagtgctgttggtgtactttgtaaacacagagagaaacaataaagttgtcatctactgtaagagttcttcgatttgtgtttcaccgggtttcggcagtctaaccggtggcacaccgacggtcagaccggtggcatcacggtggtcagaccggcggggtacacgacggtcagaccggtgtcggtgacaggcgtcaggagcagatctcggaggtcagaccggagattcaacaccggtcagaccggctaatctactccggtcagaccgatctcatcgaaattaagggtaacttttatttccgctaaaagttttcggtttttgggtatatcaaccattcacccccccctctggttggcttagttctttcgattcgatcctacagttccataatataaagcatacatacaagcatgcaattaactatgacatcttttctattaaattattactttttttaaatcctccaccctcatgttatctaatcctattggatgcacgcattagtatttattaggatgatccaaactacaagataataataattatttcttggtctttggattaagggtggttgtgccttatattttggaatggatggagtataaaccttttatatataacttttctaaaaaataaataaatctattttcaagcatgtaatagttaatgtttaattaatcatgtttatctcggttgcgcgctattaaaaagttcacacaacttctcattcgaacgcagcctgacgcccagcttcagttagatcatgtcaggttaattagtatactttgattaattgattaattgttggttggttaggctgcatgcatatcaggattccatgggtttatcgagatgattaaaagagtcaatatattttagtcaattactgacagatcgaagacgacgtacggtttactcaaatatacaggtgtattatgtatgtgtgtataggcctgacgtatattattcgttgtacaaaaaacaatgtgtatatactccgtattcgtgaggagtgacaaacaacacggcacgcaaggctcttaattatacaaagttcattaattatgaatagaatccttgcgttccaactccttgctataggttatgattaagacatgtttattacggcaattttttttaaaaaaaataatatgatactactatatgttacataggaagttcttgtcataactcaaactttatagttgtgtgcattctaaatgcaaagatggggatgtaatcatctcccttatctagaaaaaaaattagatgtgacaactgaccaattaaaacttaaactagaatgtgtctgcaacagggaggtatgtctaacttcaaatcttgattatggttgtcataagtattatggtagatttgtaaattggatgagaatgcagctggaaacagaatgctatataattcattgatatctttgcaaattgaattaaaattagggtcaagttagacaactttttcttgtaaagatgccatgaaagtgtatagtgatctatagtgctaagtgtatagtgatctatagtgctacatcttctttctcagacagtcatgatcggccagcatcatcataggtaggacggctacctttacaagatagatacataaaatacatttttacaaatataataaaattgcaggaaagggggagactcataatgatatgagctagctcaaaagatgtccttggattctagagtagcatgcataccaatcactgaaccctccctttacagttttttttttttcaaaatgtaaattgtgcctgtgaaatttgattactggttccctctttactcctgatttataatcacagctcttgttgatttatatgagcataaactcatgtttcacaaagatgtatatcgaagatacttgtcagtttaaaattcgattaaactattttttaaaacataacagtgtagcacaaacgtgctcggtagatttataagtaaaaatactttactaataccctacatttggaggtgcatgcttttgtgctgattaaaagcaacaatcaaaattagattaatcatagtcaatatgctaactgggggagtacatatcatggttgttttctttgatcaacgaaccatccccttaatttcatagtctctgtgatcccgaccaaatttcgacttaagaaatggaggtagcagcagcagtagtagatggccacctagagctaattaagctccaatagtgatctaattaggcggatggttatcatatattaattaggcaggaggtgtatttgtttttgttgcctgctggcagtgaggcagagtgggttccatgctccgaccatgacagtctgtcccagacccccaatcatttgctttcattttgttttgttttgctttcttcaaggtcatcaatattctcaacagttttagagatttttgtatgctcaactttgtggatcatgcatacacgcaatttttgttaccaaaccaccagatatgtatgatttgattctgtgatggagtatttgtgtagatttggcttttggagtgcatccaatcaaatacaatgtggtttggcactagttcatggatttgggacatgtggttaaccttgcatattttttaattaagatatctatttgcaacttaaatatgacaaatgatcatattattgcacacaatgatataacaaacttggcttttattgggaaataaaatagcaatgaaaaagtgcaaaggagagagttgccaatttttaatatgatggacattacgttacgaacaaccatacctattttcacattagtatgataacatgctgcattattctgctacgccaacatgaaagatcatccttaaataagagaaaaataacatggaagatttgtcttgactatatgcttttatttacttaatgaaatatctatatcttgaaaactatctgccaagttcttttttaaggtttagctcctatcaaaggtttcatctcgccgatagcctatcttaggaaccagttttaatgacactgcaatattcagggcacattctatttcataccggttgaactctatgtcaacatgtaacaactatattcatatatcatacagacgtgaaagaattacacgttattatattagagaaaataaagttttagttatataacacaacggtcagaaaggccattgtcgaaggacatgggaaataaactgctaagttaaaaactacgaaaaagaagttgctcccagagtttcatatatcatacagtgatacaataacactatttcaacatcaagaactcacagtatgacataatccagggtatattcatatttcacaattctacttactgtcaccacacaaataaattttacagccaaccacagcaaatttatttacaagaccaaaaatttccccaccacaaaattcagtaatacactactactagtacaaaggtaaaaatgaccatgaaatgaaaaaaaaaacaaaaatcagagagatgggccccacacgagatgagattggcgccacgggaccggaacctttcaacggtcaaacagacaagttaattacttaaaacaattaataatcaattaattaattaattaattaattaatactaagagtaaacataaaaatttcccttttttttattttttctgtgtcgcaatctcttcttcctcctgtgtattatagaaggcagcgaagctcctccttcctctctccctccgaatcctcccccgcattccgcgccggagctgaggagggacagcgagccagcgagggaggtggggcaatccagcgagcgccagatcgtgccgccagccccgctccgtcctctctccggcgaccctccgccccgcctgatcccgtggtaaatccctctcgcctctgtttcttggatcccgtggttcttctctctgcttgttcttgcccgattcgacggttgacgcggccgtggttgctcttggatcgtggcttggttggatttttctttttcaaggggtggaagggaaagctggttctttttttttccttctttttcttttttttttttggtgtgtgtgttcgtttgttcttgtgattttcttgggggtggggaagatggtggcggtttccgaggtcggatcggatacttgttcgtcctgctgattttgcattttgatcggtgattctggtggctttcttctatttggatgatgcgtgtgattggagggagatgagttgatgggggaaagatggtttagtttggttgatgcaaaatttggtggtctctggatcggtgaaatgttcccttctcttggctgttatggatagcaagcatgggtggatgaactggttgattcttgaaagctaccgcctcgggataatctcccaatgatcgtggttgaaaatatcatgataaacggggggtaattggtacagattagcattctaatatcttcagattctgtgtttcgattgagctagaaaagtaacactccagttttgataacaactcggcatccatcatggattcccaaagtttcatttcttctttttttttcttttcctgtaccttcaagcctacctgccaattgccaacacaaactgtctgtgaatgtgcttctggcacctaatctcatcacatctttcttaagtaaaaacactgttgtgactttgacttaccattattatgctgttgtttgcaggtggatcaactacaactcatctttaggaaagcctcttgaacattagccttgtgtgcctttcaacagtatggcctcggtaggtgtggtgcgttcttctttggggtttcagaacgaaacaagtacaagtggcgatgccgaccgacttccgaatgagatgagcaatatgagtataagggatgataataaggtattatgcctaagagtggtggatcatagttgccttttgctgtattgtcagttgctgatttgattcacaaacgtcgcaggacattgacgacatagttgtcaatggcaatgggacagaacctggtcatgttattgtgacaagcattgatggaagaaatggacaggctaaacaggtactgttcacaaaacaagcacaagtgatattatgctgatccttttgtgtccatttagtgttgcctgggaacacaataagtttttgttcactgaattatctatctacattgcagaccattagctacatggccgagcgtgtcgtaggtcatggatcctttggaactgttttccaggtttgtctttagacagatcgatttatgttgcacttgttcagtgtgttaatttgtgtgttctggtggcgattgatgaacccttcatttcttgaatgatcttgtataggccaagtgcctggaaaccggtgagactgtggctataaagaaggttcttcaagacaagagatataagaaccgtgagctgcaaacaatgcgagttcttgaccacccaaatgtggtgtcactaaagcattgttttttctcaaagactgagaaggaggagctttacctcaatttggtgcttgagtatgtgccagagactgctcaccgtgtaattaaacattacaacaagatgaaccaacgcatgccattgatatatgcaaaactatacatgtatcaggtaacgttacacacctagatcttctaatctatcctagcacaattatgcattgagtataacatggaaaacctattataattgacagatatgcagagctttggcgtacattcacaacaccattggcgtgtgtcacagggatatcaagccacaaaatcttctggtatgttacatacttgcatttagttataatctgttttccacttattgaagctttgtggagttagtcaagtactaagttttgtttagtcagatggttgctaaaagattattacttccaggtgaacccacatactcatcagctgaaattatgtgacttcggcagcgcgaaagtcttggtatgatcactcattaccagatactcacacgaacattgccattgtctgttgtacctaatcttttgttctattattataggtaaaaggagaaccaaatatttcttacatctgttcaaggtactacagagctccagagctcatatttggtgctactgaatacacaacagcgattgatgtttggtctgccggttgtgtgcttgctgaactcctcctggggcaggtaagagatcacattatttacatgaggcttttggaccatccagctcattgcaactgtctgcctaagctttatcctttttttgttttaaaagcctctattccctggcgacagtggcgttgatcagcttgttgaaatcatcaaggtaaattatatcttgcttccatcgaaatcactccctttttgttgtttacctcctacttaactgactattctctcaggttctgggtacccctacacgagaggagattaagtgcatgaacccaaattacaccgagtttaaatttccgcaaatcaaagctcacccatggcacaaggtagaagaaaataatcttatgttggactgtttattttttattttagggttgaaacctaatgtagctttcctttttttttaccaccagatcttccataaaagaatgcctgctgaagcagtcgatctcgtctccaggcttttgcagtattcaccatacctccggtccactgctgtgagtgttgtcgttgcactatttgagccaacaccattttttagagaaagttttagttcttggcatca

SEQ ID NO: 31125 - DNA, 883 bp, Oryza sativa
ttacacgagattgttttctgttcgtggatgcaaaagactgacacagtttgtaagaaaaaaaaaagtagtccctttttagggggtatagggtggtggttgtaggccagaaggttaagaaggtgggtgctgatattattggatccattgtgtagatagtgctagtggtagttgagttgtagtatgtatttatgcgctttcgcgcaagttcaacttatcatacgaatttgcgcagatgattgtttatctagcctaaaagtgttgtcctgtttctatagctgtagctgaaacttttcagctcttgttcagtatcttatttcagtgtagagtggggtagtggggtaaatcatagtgctgcgtgagcggcaggataggattatgtttgaaacataactacgcaagtaggtcagtggcagtgctgggtatataatttagcagattaaggaagaattggttgtttatgtttgttttgtgtctgagaaataagattagtaatttttgtgtttctgttcattattaataggggttggagagtgctgctggtgcaccgagcatatcagttgatgcactacagtttgttcccagtattcgatctggtagctttgctgatattggacctaggaggtacatggaagatgagcacatccggatagatgatctctctgcccatcttggatcgctcttggtgtgtccgttgcctagtgccttctatggggtaagtgtaatcttctatgtgaatgcctaccctgatttgtgatttgtgaatgctacttctcagcaacaatggttgaacttattgcccgtgcttcttccctttgcaattttaggtcttcgatggccatggaggcctggatgctgccgcctacatgaaaaggcatgcaatgag

SEQ ID NO: 31126 - DNA, 1084 bp, Oryza sativa
ccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagc

SEQ ID NO: 31127 - DNA, 404 bp, Oryza sativa
  unsure (1)..(404): unsure at all n locations
nnnnnnnnnnnnnnnnnnnnnnnnnnnnnnnnnnnnnnnnnnnnnnnnnnnnnnnnnnggaaggcaaatcatgcgctctggagaaaattgacatttagccattgtcaaaacggggtttcgctggaatgccactcccaaaaatggtttcgttaaaatgccaccctcaaacaggggcaacttgttgcaatgccattccatccatttcttctcagtttaatgttttttgtaatgtttttcttgttgagatgaccaaaatacccttatcctatctcatctctcctctctgtcttcctcctctccgttcggctcggcggcgcagctagagacggagacggcggcagcgtggccggagacggggaaggctgcagcgcgcttggggatggggaaggcggcggtgcggacgg

SEQ ID NO: 31128 - DNA, 26712 bp, Oryza sativa
caccggcaccgcccacctgatcgacgaccccatctgcatcctcctcgacgacctcgtcctcgagtgcctcgccggcgtcccctatgcctccctcccgcaactccccaccacttcaccacgcttgtcgcctccgtcgcgcgcacggcgagctccgctcctctctcctcgccctctccgtcacgcccacggcgagccgacggatgttggcgtggtggtggtgatgaggacgaggagccggcggccaccgactcgcagctacgccccgtcgccgccgctacgctccaccgccggcgactggatggggatcccctttcttctttcccctgcaaagtcaacaaaatgactaggggcaaatatgccagagaatgatggaaaacatttggaaatcagttaaaatggttgaaatggcattatagtaagttggcttcatttgacaatggtattataacgaagccatattcggaagtggcattccagcgaaaccccatcctgaagatggctaaatgtcaattttctctgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacaggcgacaccgcggctgaagtgtggagcgccatcgagcagatgtactccgcccacacacgagcaagagcgattaacactcggtttgctctcaccaatacaaagaaaggtaacatgtcaactcctgagtattttgcaaaaatgaaatccttaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcgacggcggcggccatggtcgcggcaacggaggaggtggccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacagcataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttgtcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagaggagacagcagaagactcagtgtcgcaggcggtgcaggagcaggagtcgcaggtggtgcaggagcaggagcagtcctcaccagcgcaggaacatgcacaggctgtcacagatgagactaatacattacagcatgcagatgtgactgacacaggttcagaggcaccggcaggaccgcgcaccaggttgcaaagtggagttcacaaagaaaaggtatatactgatggtactattaaatataagcattcttggtttactgcttcaggtgaacctacaaatgatttagaagccttaaaggataaaaattggaaactagcaatggattcagcgtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagtttatatgctacagccaccaggttttgaggatcctactaagccacatcatgtgtgtaaacttgataaagctctgtatgagttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccggctcttcagagagggccactgcagctttacttcaggatctaaaaggggaatttgcactcaaagatcttggtgagctgcattattttctcggaatagaggtaagcaaggttcagaatggcattgtactgaatcaagacaagtatgccaatgatttattgaagaaagtgggcatgatagattgtaaacctgctaatacacctctttcagtaagtgagaaactctctcttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttagttagtggcttctctgatgcagactgggcaggctgtttagatgacagaagatcaacaggaggatttgcaatatttctgggttcaaatctggtctcctggaatgctagaaaacaagccactgtgtctagatctagcacagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacacatagatctaagctaagcagttttaggtgagagcactatctattgtttatggtattggtaacatatgtacatgatcattaataagagaactagtaagagaactaggaaggtagcccgcgcatatgcgcgggcacttatttaatgttgcttaattttttattgttataaatgtttatatgtagattatattttcaaaatagatcttcactctatttaaaacatgttttagttattatctagttatgacatattacataaaaccatacagccttgaatttatgataatgacatgaatttataagaacaacatgtgtcacgataataaaacaataatagaataatggagttgtttcatatctatttgtactatatgtgatttttttacctaaataaagtgtttttttaattaccaccacggtaaaatctccaaaggaccatattgttggttatattttgataaatatctataattttgcgtctcgtgtttttcaacgcctattcttcataatcattcataatcacagaagacaccttgaccaattaatttggagaatgaatctattttcccaaacttatttataataactaattgattaaagtatacttctttgtcacatcaatagagtgcatgacatacattcatcgaattatgcctgatatgctggaattcctcaactataagaaaatatagagtgaacttcactgtgggctagtaatttttacccaagtttcattttggactaggggtggacaaatcttttcactttggaccaggtgattttacaaaaatttcaaactggactggccttcttctccatctctcttatggtttttttcttcatcgagatactgccatggattaaccggagcaagcacataactaggatttcttctctcggatccgttcctgagctcgaactcacgaaattaagtcactgggcagcttgttgctgcaactgtttcctgtgagatcacaatcatgtgattttttttcagctcacatgattttggtgggagaaaaagagcaaaaaaagaaaatcaaggtgctggttttttctttattgagatgctgccatggatcaacccaagcaatcacatgactagcattccttctctccgatccgttcctgagctcgaactcacaaaatcaagccatagggctgcttgctgctgcagctgtagcctgtaaactcacaatcaagtgattttttttttcagcccacatgattttggcgggagaaaaagagccaaaaagaaaatcaaggtgctaagtgatcaggatacattactggcgtgtttagttgtttgtgagctaaagaaatcaaggagtgagtggcagcacagtaggtcagaggcaaggaacaacaagaatggtccaatgtgcaatataaggtagcaaatcccggtccaaagtgaaaacatcaaacatagcctagtccaaagtgaaactttggcaataataagtggcctaaagtgcaattcactcgaaaatatatcgtgagtagtttattgcgtatgttacttgattgttcatttgttatcaaaactatttgacaaagagaaagacatacatatgggacaataaatctcatgatggactaaatggttgttttatagcaagatcactggcttgaaatatttttcataattattttttagatttatgtaatatttatgttgcccaattatcatatagttctgaaaattcaaaaaaaatgaaaatattaatctcaagaagtattctattaaatcatatctacttaaaaatacacaactaaattgtgttgttttcaattattttacatatgtagctttaaattagcattatatagtcatcaagtgttatttgacacctggaatatgatgtaaaattatttaaaataggaaaagcctagagccaagtcattatatagtttctcttgtagagaaactcatcacagctttagagccatccactccctggcagcttagagccaatcctaagcaaacactgaccttggcaggcagctccatcttggctggccggctgagatcaatcatcgatggaggtggccgttggtgcggcgagctggctcgtcggcaaggtggtgacgcagctgtccgatagcttggtggaggcctacgtggccagcaccgagcttggcctcaacatggagcagatcaagagcgatctcatgttcacgcaagggctgctccacgaggctcagatgaggagggacgtgagcaaccctggcctgcctgggcttttggagattctcagcaagaaggctgacgaggctgaggacacgctggatgagctccagtacttcatcatccaggaccaaattcatggcacccatgaggccaccccggtggtagacagcagcatacgtggccaggcactccatggccaccatgttcttcaccgtaccgttggtaactgcctttcatgcttttcttcttcttctacacgagatggtgccggtgaccatgttggcaagttgacattcaatcgagtagatatgtcaaagaaaatcaaatcaataatagaaggcatagatgccgcatgtaaccatgtatccaatttgctcaaaattatccatcctacagtaggaagggttctatcactgaagcgacctcccagcagctcaacaattacacagaatgaattatatgggcgggaagacatctttaaccagactcttgatgacatgtgcaccattcgtagtgaaacactatcagttcttcccatagttggccctggtggaatcggaaagactacctttgcccaacacctatacaaccacaaaaaaacagtggcgcacttctctaaaaacaaggcctgggtttgtgtgtctactaattttgatgtggttaggctcacccaggaaatcttgaggtggcatatgtcaaaatggaaatgagggaagtagtgaagcacataaaacatccaacttggatcagctccaaaaatccattgaagaaagactggatcctaaaagatttttacttgtcttggatgatatgtggaaatgcaacagtgaggctgaatggggaagtctactagctccattcaaaacaggagaagccaaaggaagtgtggttatcgtcacaactcgctttccatctatagcacaaatgataaaaacaaccaagccaatagaactgcaaggtctagaggatgatgaattcttgacattctttgaagaatgtatatttggtcaatacggcggtcggccttagagattggacaaaaggcatctgctcagaggctaaattgcaattccatatggcactcaatgtcatccaaagactcgacgtggcacaagagcacagagaactctcccccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaacgatgttgcgactttcgcgaacatcctacatcgttttggcacagccacaggactcgtcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggttggcggaataacggacattgccccctatgtcgttgtgacaccgagacagccttgcacctcgtcgccatgtgtagatacacgaagagaatctggcgcctcgttgctacatgggtgggatatcagcagttggaaccggcccaatgggaggaagcctggtcagtccatcagtggtgggagagcctagctaacacacccggcattccaaagaagggccttcggtcccttatcctgctagtagtttgggaaatttggaaggagcgaaatcggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttatccctaggggttgtattttctccttctatattcaatgaaaaagcactgctgtgctgttttttccgttcaaaaaaaatatatatatttggtcaagacaagcctgcatgttatgaagatgacttcattgatattgcaagaaaaatttccaagaaattgaagggttttccactagcagccaaaagcgttggtcgattattgaagaataacctttctcaggaaagttggatggaagttcttgaaagaaatgagtggaaaaatcggcaaggtgacgatgacataatgccagcactacatagtagctatgattatcttccattttatctaaaaaaaatgtttttcttgttgttccctttaccctaaggaccactggtttaataaattagagattactcattttttggaagcattaggcatcctatgttatggatgtcaaaataacaaagatgctgatataggattaaagtatttggatgaactggtaggtaatggttttctcatgaaggaaggtgatgatagtaggccatattatgtaatgcatgacttattacatgatctagcacaaaatatttcgtcacaagagtgcatcaacataagttcatatagttttaggtctaatagcatcccgcaatctattagacatgtatccatcaccttacaagataagtatgaggaaagttttgagagagaaatagaaaaattcaagaaaaaaatagacataggaaatttacagacattgatgctttttggagaaagcaatgcaagcatggcctttttcaaagacttattaaaacaaacaaaatgtcttcgtgttctgtttatgcatgcagactcactcgaatcattcccacacaacttctcgaaactgatccaccttcgatatctaaagttgaaaatacgctataacgtaaaattgtctctaccaaacgcagtaagtagattttatcacttgaaacttttggacctagggaatagaaattgtattttgccaaaagacattaatcatctagtcaatttatgcctctttcttgcttcgaaagaactttgttccaacattcctgggattggcaagatgaagtatttgcggaggttggaagagtaccatgttaagaaagagggtattgggtttgagctgagtgagctaggggatttgacagagcttggaggtgaactgaaaatatttaatcttgagaacgtgacaacaagggaagaagctaatgaagccaagttgatgatcaaaacaaatctgaaaacattgaagctagtttggagtgtggtgcaacggacaacacgatctgatgttcttgacggtctccaaccacctcctaatcttaaaacacttgtcataataaaccatggtggttcggttggtcctagttggttgtgcagttatatttgtgtaaaatacttgaaatcattccatctagagggtgtctgttggggcaatctcccactttttggtcaactggtgcagctagaggaacttactttgaagagtatttcaggcatacatcagttcggacctgattttggtggtgtaacacaaaaaagtatctcgcacttgaagaaagttgaacttattaatatgccagaccttgtggagtgggttgggggagctcattgccatttgttttcgaagattacaagcatcaagtgtgaaaatctatctatcttctatctatctatctatctattatctattatatactaaaagtccattaaacttactataaacgctcccaagccgccacttggcgctctaataaattagagaaatctaagaaattctaagaaaaaagcaaaacatctgatcctcgattttcacttaatacagcgggcccattattttacaccattagatccatattaaacaaaataaaccccatctcccaaaaatcctctcccgctcccctcatgggcctccactcctcacataaacagtacgtacatgtactaacgttcctccctcgcatcctctcttttctccattccattcatcttctatttttttagataataaatttattatataaaaataattagataactaaataattatatttatttgcaacatattatatttatctatattagccatgtgttttgatatatgagaaatacatcatttgacaaaaactcctacaaatagcaaaaattaataacatatactatcatgtgatcgcaaataatttcatgtcctctttgcttgctcaccttggcctccttaatttctagctagcaaataataaatatccattaaattaaacatcgtgtatcataatatatctatctattatatactaaaagtccactaaacttcctacaaacgctctcaagccgtcatgtggcactcctacatacactctaagccgccacatgtcatatctctaaagattctacaaattttgaatacaaagaaaatatccgaccgtcaattttcacttaaatcagtgacccattattgccaaaaaaaaggctgaacgctattcatcgggaaaaaagccaaaaagaacgaacatatatgtacgctcacctcaagtaatgaaaaaacacagaaaaatagcataccatccctcgcctgatcttataaaaacattagactattacaattaaatttaagagatgtaaaacaactaaaactgatatttaaaaatcatcgacggttacgaaattatgatatgttactataaatttaccattagatttataacaaaactacaagaaaaactaattccatttatttatttcatcataaaaattataacaaaactaataatatcgattatatcatcatatataacttcataaacatggataacaaaaattatatctatgattattcgaagtaaatatttcattcattatgaaactgtgataagttacaataacattagagtcatgataaaattatcagattgtcatataaactactttcatgtattcatatttttaagtttattgtgaatatactaatttcatgtattcatatttttaatttttattgtgaatatattgcaagaaagaccagatacaaagctcttactatggtacaacctacacagtttatacgtggataacttaaaggtatcaagcatatgtcccgttaatcttgaatgtgtccgacccacttacaaattcttatccaccaaacatcgagctacaattgctaacaaggtatttgtgcatcatatcatatcaaatatctaatatatgatgaacatgtgtaccattagacgcatatagagataaaggacattttataagggacatttgctcatttaacccttttctaaagcttaactaccaatttgatccttttttaaaacaaggtttgctcatttgaccatgtttttcaacatcgaagttgtcgtctgaccctactttcactacatcctgagtttttcatttagaagaaaagaaaaacatgtatttacaagcccaaatgactaaaatgacactgaatacatcaaccttatcctcaagcactcatttgctcattccttatccccccgtctctctctctctctctctctctctcttcaaagcgcgaagggcaggaggagcggtggcggcagcacgacagcagctgcggagtgcccccggctgcttcgcggagggtaggatcggtggcagagaggcaacattgactcgccgacgaggagggccgctggcagtggtcgaagagacggtgacaactcggcagaggggaggcagcagctccatgaagggtaggaggggtggcgtcggctcagtgacgaggaggactgccgacgatggcgaatgggaggcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattatagattatatcattttgtatcattttataaacatacaaagccaaagacacgggtgatttacttaatctatctaaaaaaacatgtctacggtaataagaatcatagatactgaaaagacagaaaaactcaagagcatataccctaataatacctaatagtaaataaaaattatcaatggctaatccctaggacatataaaattataaagtattattttactagtttattaaatgccctaaagaaccctcctacaacgtctattaaagcctttaacaaataagaggaaactttaaatttcttctgtaatagataaagcatctaaaccttattcctcattaatttaatgctcccattaattttggccattgggccatttcaatgggtatatgtatacacacattatttaataaaaaaacattcatccaagcatgttttctaacaaaaaattatttgagatgtcaggtgaggttgtaatgacctgttgcatggtttagagggttgttgtcaggatgactagcattgagttttactaggttgccagccatccaatgcatcacaaaaagagcccatataggagatatttgtgttttgttgatcgagccaccatcaagagaagccaacatgggaaccccagtacaaatattttttatgactaaatcttctcttaactcaagtatctatgtaatattatttaagtcgtgttggcttgaagcatgcataatttgataacatggtatatctagaaggctacatgttagaacattcaattaacccatcttggaaataataatacttagcaagaaatcaaacaggtaacaaatttctatctttaattttgatatttaattttaatcattggaaagggggagatagagtgaatggttcaaacagttatgttaatattgtccaatttgcaagctaaatgtttttttaaaaaaaagagatatagcgggttgattctgaagtattatcgtactattcaagagtagaggaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaacaccacatggtttcccaacttgtgtgatcttgacattcggagttgccccaagttgtccctgccccccatgcctcatacttccacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccattcagttcagtcgctctatctcgatgattgtcatcttactggaaaatcattgacaatggtattaagcatttttccggctcttacctacttcaatttgagaatgtttggtgaaaatcatgacatagaggaaatagtgctgcaggccccaataacctgctcattgtgccatatgtcgatatcctccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaacacaatagcacatgcgggccaaaggatcgatcggttcttccctctgcaacaatctggaaggttcttgaaaaaccaactttttttaattttatgtggtcgggaatttatgatctcctttttttagtgcatgcaagcgaccactctgttattcgcccatgtagttcattgcttccttcacctaaccaatgttatattaactgtcagacagttttggtaaccttggctagagactcagcatggtgataatgcatgcagcaggctgatagctatgcggtaaatttgagacgcgccttgccctggtctgacctctacaacatcagttacacctaggtggtcagtaacctctcctcaactcatctcgtctctctctctctctcttgatctctccaaaatagggaagttagaggatatgtcctttaaaactactccctcagtcccgaaataagttaatataatatggcatgtaatattttcaagtaaagtatgctaaaaaaaacaagtatgctaaaaatgactctaaagtatgtatagggtaaaagtattctaggcaatttttaaaatgcctctaaaaggtgtctacacttttgaactcccgaatttagagacaatttgaaattctcttctacaaaagtgtctcaacataaggtttttgttgtagtgtgagcttggcattgagtgtgtattctttctgtggaaacctatcaatccaaaagcttgtccagaactcatcagtttgacatggtacagtaaagttcagacctgcctgccagttcatgtaatcatttgctctttagcttattagccttagcgaaaatttgaatttcagaacttaattttagggttgattttattaattgttttccatcatagtttgttttctggcattgtgtcacgcccacgcctaccatctttcattggcagcttacaacggacaaatgaagaacaatagaacatcattgcttaaaataaagacagatgatgatcaaaagatcaccacagttgacatgagttctgtggagcatcgattccatttcatcatctggtatgttcatctatgtaagcagttttagatgacagcatcaggcccaaatacgaattatacccttacatactcttttgtccttgctctaagtagaaatttaacaaatagtatattatgattgaaacaaatgagtttatatgttttacagcccatctaaacttttcattgagactggtcccaccaactccaaacaacatagaccacacagctctactagactactaataaactggcaatggattctggtgttggtaacagaggcatatatggtctttcttctttttttttaattgaagaggtgcatatggtcatcgataggagaatcattttgagcttattagtttgttaagtcccatttaatcattcattatggaatgctaaaccgattgcacataatactgatataactggaatgacataatatttcttgactactagataataccccgcgcgttgctgcggacataataaataactttcaaacatgcaatatgtgcataacatttgagaagaaaaaagaaaaaactacttattaccatataattgatggagtatatacagtggtaattataactaaatattacatgatggagtatctccccaggtagcagtggttggccaatgcaactaacagaattacaactcaaatatatggctgttgaccggatagagcaagtattaataaacaaaattgaaggccactaaacattactggaaaatgaaaaatatacaccaataaaattacccaaaattatgtactatgtgtttatgaacatagcatgtatgaaaaataacagtagaaaagcaagtaaggtgtcatactgttgtcctcgttaacttgatagcctttattcagcatgacatttttcctagtaccgcttccctcgctgacccattgatctcagttttggaaattctgtagttaatcttgcaaatgaatgccaattgattcatgaataaggtgctagaatatcataaataattgtggtaagaaatgtttatttaactggaagtagcaattattatgcatatcttatcgtataaatatgcgatgaacattaggagcgcatttgtagttgcatagctgatcaggaatgtagtcaaggcatgtagcaaacctaggtgatgagtgatgactactttacaattacaaaactgataataaccataactgaaacatcaatattttatatgtttaaacatctacaaatatagtccaattatcactgatagcaaggaaatcataactaaggtgtcaaactattatataataatggtagaaaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggttgtcgacggttttcattaatcatggcaacctaaaggggcgaacaacctttagacatgggagaggaagggggaagcagcgcacgagccgccatgggggcgacgggaggggaagcgccacaccctcatcctgcctccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggttgatgcgcgtggggccggtgaagcagcgagatgtgggagaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgacctttttttttttgcatgcccctgttgctgcatggtttatatatatatatatatatataaaccatgcatatatatgtttcaatacatatatatgcatacatatatatatgtatatatatatatatatatatatatataatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctaaaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagtgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaattgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctagttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattatgataaatgcgaagtaacatatatatatatatatatatacatgtatatatatatatatatat

SEQ ID NO: 31129 - DNA, 8907 bp, Oryza sativa
  unsure (1)..(8907): unsure at all n locations
tacccctaggatccacaaaatcaaggccgcaaatctgtctcacaaatttcgtgaccaaacctgaaaacccttcacacaaattttgcacagcgatcacaattctgtccttttcctgtataaaaagaaaaaacagagaagttacatatgcagatttcacaaagttacttttgcagtttgttgatgttacatttaccaagggtacaaaaagtaaaacagagaagtggggaaaaaatataaacctgctgctgcatagtattgggcacatttgaatttatgaaggttgaaaaatctacattgctcccaaacaaattggtcccttcatgctgaaaactgctcctaagctatattttcaattataaaatccgtaagttacgaacaaacaaaaaactaaaaatgatgcaagtatgccaactataaaaaaaactcactggtaaagctccaaaggagccgtctgctgatgtgtcagctaatattgcttgatttatcatttcattcgtccaaacagtagctcgataaccctccactggaacattgagatttttaaacgaaagcgagtccaaataaagaatctacaaaagaaattagagcatttagattaaattaaaaaaagtacataacttgtttgatttaaaacctacaaaatatgttaacttccagatgtaatttaaatttaaaaaacaaatggaaaaaaagatgtggcagggcatatatgaagaagaacttaatgcacagtgagaagtggcttaatgcacaatangaagtagcttaatgcacagtgagaagtacttaatgcacagagagaatttacttgacagaaaattatttataacaatttaacagaaagaagttacttcctaggaacatgttagttacttcctggacagcttaacttacttctaaaaaacataaaagttacattgggacagtgatcaaataaaaaaaggcgagcattgttaccatcatatacaggagacatgctgagttggtattcttcccagctttagcagctttttgcaaaatagatatgataaacttgcaccaattaagattcttgacatttccagcatcaacaacagaaggatagcatcttgggctgactgttgttgccgtcgttggtgctaaaacagaagaaatggcgtagatgatccacatgcgcaggtacttgtcatctgctaacttcaacttctccaattgaatcccaagagaagtcagtgatggtgagataccatcattgattccaagcaaattcagcacaaattctgtagcttcagattccatctcatatgagacatccttgtcgcccattgggataccaagtacagacttcactgactcctcgttcacatctatggctccacgtccagggaatacaagctgattggttgctggattgaaatgctccatcaaccagctgcacaaatcaggtctgagcttcgagcacttgagatctacgaggccatggaagccagccccctctattagtcgcttttgttcgccactcatatggggatacaactttataagtttcataggtgaagccctgctactttcttgctgcaaatgtataaaacaacaaaaagaaaaataaaaaaacatcagcatttgtttattttttaaaaaacatatataaaacagttgaaaaaagggtaactgaaccaagaagtaacttgccattaagttagttctagaaaataacttgccctcaagcagcagcatcaaaaatattttaggcacggtgagaagtaacttaatgcacatagagaagtaacttaatgcaaagagagaagtaacttcaggcacatcgagaagtaacttcttacttgttaacagaaaatctcaaagtaattttgacaggaagttacttctaacaaaacagtaagttacttcctaggaacatgcaacttacttccagataaacttgaatttacattccctagttacacagcatgatacattccatctagttgcctctcagagcaatttgaacagaaagttactcgttataaaactcaaaaagttacttcctagaaacatgcaagttacttccaaaaataaacttgaatttgcattccctagttacatagccatgagtactggtgttggaaatctcataggaattttaaaataagtaacttaatgcatagtgagaagtaacttaattcacagtgagaagtaacttaatgcatcataagaaaatatagtgcattggaaaaagcgaaacactgcttgagggcaaaaaatgcataaaaaaaggtggatgcttaatacctttgatctgctcctttttggaggaggttcctctatgtcatctgcatgatcatctccaatacttcttttcttagcacgttgcgaacccccccttgttttttcacttggctctggtttgcctaacatgcctttctgtacaatggtttttctttttcccattcctggaaatacattttggatgttagtaatcaacttgcaactaaccatcgatcaactaataatcaacttgcaactaacaatgttagtaatcattttggaaattcattttggatgttagtaatcaacttgcaactaaccatcgatcaactaataatcaacttgcaactaacaatgttagtaataattttggaaattcattttggatgttagtaatcaacttgcaactaaccatcgatcaactaataatcaacttgcaactaataatgttagtaataattttagaaattcattttggatgatagtaatcactagtaatcaacttgcaaccggaaaaatcaacataagccagagagagagaaatttaaataccttcaaatggaacccgagatccacaagccgacgcttgagggggcgaattccaccgcaaccttgcgctcgccgagaggatgaactagcacctgatgaatgagggagagagagaggggaaatgagggaataggggagaacaaaccgggaggtttgagaagcaatttgcgcagtgaaaaactgcccaaacctctccacctccccggcacaaaaaacgcagggaaaaacagccccatcactccacctctttggctcaaaaaaaccgcaatgaaaccgccacaacttaccgaaaaaaatggccgccggatttggaggagagaaaactacctccgccgcagcctacgcttcccaccgcaactgccggcgcgatgagaggaaaccgtcggctccgccgactctgccgacgccggcgcgatgggaggaaacaacagcaactccccgcaccccccccttcgccacggatttcgccggagattcacgccgcctccgccacagatttcgccggagattcacgccgcctccgccacggatttcgtcggagattcacgccgcctccgccacggatttcgccagagattcacgccacctccgcctctctcactctccgcctctctctctctctctctcgtcgagcgccacccaaaaaatttgaacagtacccttcgctcgttcggtcggaaaaggcgacgcgtgagctcgctcggtcggccggtcgggacgcgcggcgcgcgccgtgatggacgccacgtcaccacggctgccacgcgcgtcgcacgatagcgctaaatggagaggcctctccgtttagattttacgagcttagaatgaggtcaataacatagccaactatcggctgcaatagatgggcacatcatctggagttggattcagcttatctgacttcaaccctcacgatggcaaagagcagtagaggtcatccagctgtccatgttcgatcgaaccgtctgcccaggaagcgcatcaaatacaggtcagccgcatcgtgagtctgggccaaggccggcccaacaagcctcgtcccccagccgtgctcgtactcctcgtctggccaccgccatcgccgtcattcttgtcctcctcgccgccctcgctctcaccgtcgtgctcgtcctcctcaccgccctcgctctcgccgtcaggctgcggtactcggctgagaagatggggaccggaaggcgcgcaagatgcagcgcccggtcacggccacggcgcatcggtgccacgagctcgatgtgcgcgcgcggagctcgagcaggccatgcgccgcgacaggcagcgcgcggcgaatggaggaggggagtgcgcgcgccgcgtggctccatttcgccgatcagaggaagaccgaagctgtggtgcctgagctgctcgttgatctgaattacctgcgtcgggcctcggcaggcagggagaggaggaactcctcatcgccatctctcagcagtgagcgagtggaggaacacagcggcctcctcttcagctccttgatgctgcgtctaggagtgttgctttgttgcttgtctgaccaaaccgaatggcattctgaagatactgaatgttcagttataagaatgatagattgttctttacacgggcagcagaagcagaccacttgttctgaaaaatggggttgcatgtgttctgtaatttgtatagaaagcagaaaaactctataaattgtttgcaatgagaatgacttgtccaacagaatgatgaaatggccatttgtaacttatcactgcaatgaaattatgttccaattctgggcatatggcttgttcaagagaaccaacggttttttttttccaaaatgcacaaacatatatgcatgacccaacctttccatctgatttccttttgtttgagtacctttctctaacctcgaaacctttctgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagcttacagacctgttttcttccatctcaaatatgtagattttgctggaggcttctttgatgaattccaacagtctaatggaggaggtggaagacaatcaaataatttgctaaaaaaaaggaagagaagaggccagaacttcacctgtgcttgatcaatggttgaatccgtggttcgctgtcccagcatgttgtcagatgatcgcctggggccatggcctcgtttggcgccaaaaaggcgagcgcgaccgccaaaacgcgtttgttcgcggtaaaaaagataggagcgatggcgctgggacgaggcttgttgggccagccttggcccagactcacgacgcggctgacctgtatttctgggcggacggttcaatcgaacgtggacagttggatgacctcgactgctctccgccgtcatgaggggtgaagtcagatgagctgaatccctggagaaagcattatagctaagtgatacaatagatatatcatatacttactgtaacacaaatattctttttgtttttataggcccaccatccctctactctctttcttgccggaggaggagatgcgtgggaatgtgggatccttcacgtgctcaagtccaaggacgaacatcagtacatcatggccgccgcgttcatccggtccggcccgcgtgcacgtctggcgctgctgtactaggagacgacgactgtggtggacggggatggcggccgctgcaaaggcggacgagggtggtaggacgggtgtgtgtgaggacgacaggatggatgaggacgaggatggcgcggcgcagcggatgtgggcgaggacagcgggatggacgaggacgaggacagcggcccggcgcggtggatgtgggcgagaatgacaggatggacaccggtgacaacggcagccgctgaggatgaggacagcggcggccgcgcgggcgacgatggcagccacggcgtggctgatgcaggcggccgggctggacgagaaccacaacggcgacggccaccgccgccgtggacgaggtccgcagccgaggcggtcgcggtgggcaagggccactgccaaggcgagcagaggcgatggagacgacggccatggcggacgagggtggcgacaacggtagacgagggcgatggagacgccggccatggtgcacgaggtggcggcccggtggagcgcgacgacggcagatgagggcgacggagacgctggccatggtcgatgaggcggcggcccggtggagcgcgacgacggcagatgagcgtgacggcaacaacggggaacacaagcggagcgaacgcgctggtggtgataccggcggacgcgggccgagtggatggcgatgcagacgcgctggtgggccccgctgcctcgggcgagcgtgcagtcaagcgactaattaggccatccccaaccaataaactattagtttccatacttgtcatgtcatatagacactatatgtagacactatgtattcaatggatggtgtatctatctatcttctatctatctatcttctatctatctattatctattatatactaaaagtccattaaacttcctacaaacgctctaaagccgccacgtggcactcctacaaatattcctaagtcgccgcatggcactatctaatcttaccgttgattttcacttaaatttgtggacccgttattttacaccattagattagatctattattaaaaaaataataacttccacatgtttataacatacaaacgctagctgctactgtccgtatgtatgagattgtacgatacaaacgctactgatgttctttccgtaacatacaaacgtacatgattgaaaataaaatgatcaagctttcttaaccttcgctggaagaaaaaaaaaaccatacacttgtacataaaaaagacagaaacaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctatgtggctctcaaataaattagagaaatcctagaaatctattatatacttaaaagtctattaaacgtactgcaaatgcttctacattgtcacgtggcgctttaataaaattacagaaatcctagaaattcagaataaaaaaagaaaagcatccaaccttcagttttcacttaaattagtggacccattattttaaacaatggattagagctcttaaaaataccatgatgctaatctctatcctggaaaaaacataatgcgcttacgtcatacgatcgtctccctcccggaaaaaaaacaaaacttaaatacctacatcatatactataaaaaaaataaagccaaaaaagaacaagaaaatatgcataggtacatagtagaatcggaaacatatactaatcaggaaaaatcatcagtgtcggcactgatttgttgtcaacagcctttaatctacgattttattaaaaataatactacacatatatgcacaattaaacttaatataaacttattatagtgataaatatatcatgacaaatgacgctaacatgtaatagttaatgcgataataatgtttcaaataatttcatatcatattttacagtgtcaaatatcacttgacaaaaatatacaacgttaattttaatctacatgtgtaaaaattaaaaaaacaaaacctatcattgttttttaagtacatctgtttaggtttatttaattttaggagagattgagattctcaaattatttcgaagttttcaaaaattttcttatttgaggtgtgagaagcacaaataatagatagatgagaaaaattaaattaaattttagccagtgataataaaaatatataatttagctttggtttttaagtagacctttttaggtttattttgggtgagattgagattctaaaagtatctgaaagtttttcaaaccttttttattgctatttgaggagtgagaagcatacaagatggatagatgtgaaaaaataaataaataagattttagacagttattttactacaatacaacccgtaattcatcacgagaattatgtatgttctttgccaaatagtattggaaaaaatgaataatccaataaaatatgcataaaactacttatgttatatttttttaattgatagaaattctaatatagcgggtataattgatggacgaatgacatataccactgaaactcagcagtaagtgcactctagcgaattagatagtgtaaataagtttgtgaaaataagtacattattacaattagtaaatgagtctcatttagttataaacaatatatggttaaaaaaatctagcgctaaagtatgaatctttatcaaaatataaataatgatatggtgttttgtagattttcatggtggtacgtctctttagctatagctctttttttctaaatagtgccgaatgattaaccccactcatttgaaaaacataatactgtttgtattgcattaaactttgagaagcacttattactaacttcatatacacattgtctattctctaccaaaaatcgactcgaaacttttaaaaaaattgtttcaatcacctcctttctgtccctctttgtcctttaatgtaaggtgcagtacttgctatgctatcgtaaatattgcatgggcatgcacattgttgagttaaggtactgtccatgaaaggtcaccatagacaatgtaactaaagtgatagacttatcaatataatcatttgtgagtgtaacaatagtaaactaagtgttaaaatagtactctacgatggttttttaggggcatggctacatcgacgtggaacctatatgtttcaaggcattacatatgaaagccttggttggcagatacatttgacttcatccgttagagaggtattcatgtttatttttaaaga

SEQ ID NO: 31130 - DNA, 10508 bp, Oryza sativa
atcatttattttagtggtactaatatagtttcatttattaaaggtgcacctaactcttaaaacaatgatagtaagtaatgatgataaacaaccagtttatatatgactaggacaaaggaatttttatttaaattcgagggacattcttatcacattagtagtatattaaaatctatcgtctattttatggtaaatatatttatttttttactgtaggataatctaaattcccttacactatatatagtgatataatccattttagcatttttttaataaaaaataagatgcccatgcatctgtgagaaattccttaccgatttatattctggaaatgttttccaatttatattacgtcgttatagtgtttgaacacaacctatcatacatgcccgcgcgaatgtgcgggctaccttcctagtttaaattaaattctcatccagtcacatctcttctctctccttttatcagcatattctcttatttttattcttagttcttgtgtagagatggtttcttcatctttttacctctcttctcgttaactttcttgccacatactccctccgtttctaaatatttgacgccgttgaattttttacatatgtttgaccgtctgtcttatttaaaaaatttaagtaattattaatttttctcctatcatttgattcattgttaaatatacttatatgtatatatataatttcacatatttcacaaaagtttttgaataagacgaacgggtaaacatatgctaaaaagtcaacggtgtcaaatatttagaaatagagggagtatgatttttgcttatgtgatgtatttaatgctatggaaactagatggcatggagggttggggatggccttagttgtccgctgctactctctcctccatatcataaaaaaaatcttacatggaccttatatcgaccattattgtacccgctcttatggagaggaatcactagacatgatactgtctgacacgcgactgttgatcaaattagtgcataactaaaaacaatcttttccgtacttatgaattgctgcacgacaacaaaaccaatgttttctataattacgaacaaaattagttactactattccttttgcaggatgattatgatttctcgatttgtcatgtaattttttaaaaaaaaaacaaatcagcacaagattgtgtccactctattactagctacctccgcaaaagaaatatatttctacgaatttcagaaagataattataccacctataatcgtatccggttttgtcagaaatacaacataactagcttcagaaaaactaaccgacgatatcccgtatgggggaagtggggacgggatacataatgaacggtcatcgtccttatccgtctgcatccttttccgcccgactcgatccccaatctcctttgtcgctcttctcttgcacctacgcctcgcatccgccgccactcttctccttcctctcctcttcttccttgcctagctagaagcttgaaaatggctagagctcctttctcctgctacacctaccctcctgttccgtccccctcaccatcaacgagccaaggagagggctgccagcaccagatctggagatatctagggcctccccgtcattggatccgcctgagccatgtcagtgatgaggtgatgatcgcaccggcccctgtggcctccacctcgatgtcatgccatcgaggaggatgccgatcgatgtgaatcctcctcccacgcaactgttagtggtgatggagaggagacaaatgaaggtgctagatttggagtttcaattgacaatcgacgtggtgttgcagacatcgtgttgctcgtcgacgttgtgcgcaggtatgtcgtgcatgtggcgtatcaccatggcttagctggtacctacaggtattaggcatggtacgaatggtatcatgttgatacctacaggtttcagggctggtacctatggtatcatggttgatacctacgggtaccagacctagtattagtggtatcatggttgatacctacaagtttcagacatggtacctttggtatcatggttgatacctacaggtttcaaggctgatacctgtggtatcatggttgatactcacaagtttcagacctggtacctttggtagcatggttaatacctacaggttttagacttggtataggtaccaaccaatatcacataggtaccaagtacaaggtataacgtgcgtcactgccgcttgggcaggtggtgagctgtcgaccaccagcgttttgtctcgtcttctcccttctattcctttccaaatctccatgccttttcttctcaatctggtgttggtacaagggtcaccaggctgctacagcctgcagggaccaactttgccacctaagccactactggtactgtggccttctcctagcgcctcgcgcgtgctcctccgccagctagggcgtgagcgcgtagggcggcgctgagtggtggactcgtgagcggataaagtggtggcggagctaacgtcatcaatataaagtatctcgtttagacgggatgccgtaccctagctagcagccctctatagctttatatggaacgaaaataccatatacctagatttatatggaagggtatatatatattcgagtatgaaatttctattggcttaaaaaaataatatgggaattctacgaataacatgtaaatgccattcaatatgtcagaatccaatcgattcgtgtaatataaggtcttatatgctcctatcccacttgtagttttcaagttctaattgaacggtcatacccgtataaatacaaagacttccattgagacatagcatcaaattataaaccatagccataagccagatcgaacaccaactagccatgaggaaacctaaagctagccgccgaggcgccgactacaagtcatcggattagtcctcattgaagactacttaggcttagattagttagcttgcttctaattttataatcggtgtgaaacatcatcgaacgatacatataaattggattagggctatttacctatcaagaggtttgaacaagctagtataaacaatatatatttccgaaaactgaaccagtatatttcttgtctccgtgtcgacgggggatactagcacactggaagaatagggtatagggtatgttggtacgaggatctacacaatacgacatcaagcaaacccggagacaaggattatactgattcagacccctcgtaaggtaatagccataatccaatctatatgagattgatatgaaagaaccacggattacaatagagaaccaacgattccgagattaccagcgagatccttgtcgagatggtttcgacgagatcttctagcgagtaggcttcacgtcctccggattgtaggctatggtggtggtgttggtgctatgattcgatgatctggaccccttaaggggtgtgtcttttataacatgaatcaccttagtctccaagtaaaactcggtgactatggaccccacacgatatagtataacctaaccctttttgagtaggactctgttgttcacttgctcgtgaggataatttccataatctcttgttaatttcctcatcgtatacggaaatatatcgtacaaacgaaggtatgtcgtatccatatattccataaatcgtaggataggagatataccttatccgtaaccatgataggctagtagcattgttttgccacgccagccacggtggcgtggcaagaggctagcatgacaggacagcactgccatgccagctgcgcgtggcatgccaaagttatttggccaagccaggcgggctggagtggccaaaaggttcagattcggacatattttttcgaaaggtctatttataaaattaaaaaaaataaaaagtctaaaaaataaaaaaatttcgcaggtaactggagcctcttatttcttaacagaaaaactctcgaacctctattctagtgtgataggtatagcagttctttcactagatgctaccttgagacaatctcaccagaataagttgattgaacaggtttctgggtactgcaacagtgttttaggaaaacaaattcagccacactccatatattcattgaaatatctcaatacaaattccacccccgggaacttgggccagccagcaggttctaggttccatagattacatagaaccagtgttcacctagtcgctaaacgctagtcggacggtcacctactgactagcgactaggctgattaggcggcgactagatggattaggcgaattaggcgttttttatatttctttcacagaaaaatactgattcttgacattcggtactcagtaaatataggcatttagacaaatagcattgggtttagtacaaattcataggaatagcgaacatacattagtatatatatatagcatagcaggctaggggagtagcagtacagcatcaacaccaacaaatcacatacatacagatctaaggagctggagctaggagagaggaagaaaaatttatctggaactggaagaacagaagagatgaggtggtggaggggagcctgatcccctgatggcctgatctagggttggcgcaggctgcttgagtggttccgtgcttgactgcttcaattggtgtgtttgccaccttccattgacggtaaggatgaaggatgagagggagagcagtagtagcagaggaggagggggaagaacgtggagcagcagaggaggagatcgggaagaacgcagcggcacggtggaagatcgatgggcacggtggcggagccgtcgctcgtggcggcgtgaaaaaggggagtaggtaggggttgcgctctctctctaggctctcaaataaggtaacctaaatccccttctataccgagctggtcccgcgcggcgtttctaaatttaattgtgcccaaattttgatttctatcacctagtcgccgcctagacacactgtcccattgtccaattgcgcccaggcaccgtcctgtccaagctgtccaggccgcctaggaccgactaggaccgtctaggcggtaaaacgactaattcactgcctagggtataaactggacaaattgtcgccgactagcgattaatcaccgtctagacgggctaggcggctgtttaggcgaacactgcatagaacagaacttatcacacagcagagatcaaaaactcaggttgtcccatcaacatagcaacatgtttgagaattcaagcatggtaattcagagcattgttccagatccaacgcccagcagcaaagcaacacttcgtacatcttcttggtcctttattctcacaaaaaaatgtttcccatttcatcacccatattaccatataaaatgcctataaaatatgtcagacagccaaaaaaaatcgatactcatgtgagaagctccacaacaaccacctctgatgcagaacaaacatcggagcggaggtactcatgtgagaagctcccatccagcaggtaccatcgatactgtccggtatgaaatctgagccatccaatcagctcaatcggatggtggaaaatctgtggtacctccaggtacaaatttgcccatgaggtggtaccggaatatttggagtggtggaagggtaattttgtcttttcgcgtagaagtgtccaggggagggaaatagggtcttctaccaaatcggcggcgagcaaatatccccttcccatccgatccgatccgatccgtgagagtaggcggcgtcggcgacttgcttcgtcggcctggagttgctccgcgggaggcggcgggatccgtgggaggcggcggcgacttgcttcgtgggagatggcggcggcgtcggcgagttgcttccgtcggcgcctacttgctttgtgggaggaggcggcgtcggctgatccgtagccgccggcggcggctgatccgtttgaggcggcggcgaggtgctccgtgggaggcgaggcggcggcgggggaggcgaggcgacggcggcggctgatgtgtaggaggcggccggcggcgaagtgctccgtgggaggcggaggcggcggcggcagcgggttgttcgtggcagcgaggttgtggcgggcgcagtggtgcctggcgcggcgaagccctggtgctgcggtgctgctggtggcgggcgcggcggtggcctggtggcggccgcgttcacgaggtggcggcggcggctggtgcgtgggcagccttggctgcgaggtcgtggcgtgcgcgatggtgccggccgcggtgacgaggtggtcgtcgcaaccggtgttgtggcggcagcgggtttgggctttgcgcggctgcagtggcgaggtggtcgtgtagtcttcttagcccgcgacgaggcagtgtatgcatcgattttttttcatccaatctaaatcattagcttctgttggttgcaccggtagatactttcattttctgggctgcatatgctcttcttcttcattgcttataggatttgcattgtagaattaattggatgttttaatgagctcagtccgtgcttgttctatgtgaattttcaaatgttcaataacctcccctatcaatgagtgactgcaaaatgataataggatagaagaaagaaattgttgatagcataacgagtggtcctctgatgagttgcttgttttaacaaattgttttcccagcatacttctatggtttattcagggaacagaaactaacgtatcaggctatcacaggtggtagccagcgtaataaatcttctctgaatctagtatttcaaatccaaaagatataacacaagacatgtagaatctggaggtcgacatatcatttctgacaatgaaaataaaagatgaaccaccttatccacatcctatacacacactttagatagaaattctgtcatgggtatttcatcgaacaccttttatgcgaaataaatacctaatgcttatcagagacatactctgttacctatgtcaattgcaacatcacataatcacgcacagaagattcaaattttgtgaaaatcttactgacttttgctagataagaaatgccatcgaattcccttaacttggataaacaggagaatagcatatgcataaaaattctgtgatgttctctaaacaggagaaacattgcaagtagttacaatgatgtctatctgaatcttagcctagagctagttgccttcatttgcctcggtcactaggcgtttaatatcttgctgcacttcaatcacttcgttcatagtagaattaatgaggttggctgcaaccttatgtttgaaagtggtggttgtatcctgaaaagcaagttatgaaaaaaatatcaagtaatgtcattttatttacaaagagtactgattgcaatttaaaattaccatttcattgaactcaggggagagttcttttccattccaatgctgtatgaatttcaatgtgtgcaagccacatgaccagctgttgcaagcatgtcctttgttagtggtaattcgttatagataatttgcgacaaaaattaactgtttgtttgacctgtcactttgctgagggactttcattgggcagaatggccaattggtaatcttggtgttcttccatttgttttcaacttcatcttctagccttgcatactggataaacttttcaattccttttatctgagttatcaaatagagtattacatatctaatgtaacaagttagtaaggaatagtgatgaatctaaaggcacaatgtagcatactgtattattgaggtctttatctttgtcgtagtagctcttgtccatgcgcatcgagtctagtatttgaattttttctttagcaccattgagaacagccacgtaccaatgagttgagtttctattgagtggtaggaaaatctacatagaaaatgaaatgtaagtcatgcagttattattatgaaggatatttgaggacataatataccatatcatgttgcaaatattttgctgtaacttttgctctcttgtcttgatattgcttgttgcgggttccaatttgttcaccatttgttttccaggcctggcaatgtgctgtactttctagaaatgcagtaccattctctcttggactttcacattgcatgtctttaatcaacataatgtatgcatctatgacctgtgaaagaataaagaacaaaatttagatactgataatattatgttgtatggaaatggctgaccggctttcagacatggaattttcattcaagaagaagttgtccaagcagaaaaaagagactgatgacattagaaattggttcgtaggaacagtagttgtagctgtgttccttctcatgaagttatttgataatatgtactatgcttgccgttgttgattttctacatgtcagttagctatgttaaggtaacagactttttagtttgtcatctcatttgtaataaacgaatatcaggcccttgattgccctctaaattgattagctgtgcattgttcattttggttgataagtattggatggatggttgctgcaaaactggaaaactggaatgagatactgtgtaataaacgaatatcaggccctttattgccgtccaaaattttcagatgtgcattgttcattttggttgatgagtaatggaaggatggttgttgcaaaactggaatgagatactgaaagaagtgtactacaaaactgtaaaacttaggtgtactgaatcattttgtacatttttaaggtgtacttagccttgttgtgctactgaaatgacatgtattactggaataagtattactggaaaactggaatgagtgctctcttttgatcactccacagaatggcatgtatttcacaggagttcgagtaaaaacagcacaatggtgctagtagacaaacaataaacaatgtatgctctgttcacagctgacagtaattaagacaaaagctccattcaatgatatacatgctttgttctccagcaaaagcttgtgcttttcacacaaattcattacaagaaccatgacagattgaattgttcattaaaaaaaactagaccacacaatataatcctctgtccaacaatacaacttcccaaacaaggcagattcaacttccaccagtgcaaagaaacacttcaaactccagattcaacttccaccagtgcaaagaaacacttcatacttctcatacatcttcttctactttgctgaaaataaaatcacagatcaaattagtaatatatagagagagtttacataaattgacatattcaaaataatcatattatatttcaccttaggaaaattggacaggttcgaacagtgtgcccatggccacgacaataaccacaacgcctaacacgcttctccatgaatcctcgtagtcttttttgttggagctcctttaggcacaatttccataggatcatggaccttatcatgactctcaatgtctgtacgtgaactttgagctagcacatgaccacataaagtcaaatctgagttgtttgtctcacattcatcagtttctaagtctaatttttctagcatctccatcaccattaaagtagtttccttagacaccgaacacttgaaaaacacttctgtgcccatgctacgcagcctgcgatatctctccatctggtctgaccatgtatatacttcgccatacctatcagaaggaaacatgtgtttcgctttaattgtccacctacgcactatgcatgcttcaggaatggcatcgagcttcaaatgatgcataattgcaaccatatgctcacatgggaggcattcacgatccatttttctgcatgtgcaatttatgctcttcattgttgattccatatatgtacaattcaagatttgtagcatctcagaatcacctttcatggaaataacatacttaaccaagttgtcctcttctacacattctatcacttcccaatccatagacttagcaataaccaccttcaacttcttaaaaactgcaggtgcaaatatacgggcagcatctttctcagtaagcctagcatcattagaagtgaaagggattgattgtgaagctttacaatctagatcagccttcctatacctcatacgtgataagcaatgctcataatactctaccaaaaggacaaggctcattttacgatccaaatacctatgaagtttagaattcagactttcactacgttggttgcttttcatcccaagaaaaaacaaacctttagtgtacgcagtagcccatttcttcctcaaattgtacatcctcgcaagccattggttgtcttcacaacctttatgcttcaccttaaactcgacccactttctctcaaactcttcatgatcatatggtgcgtggacaagtgctcgaaaatctgaaagcatatcaggacgaagatgtcttgccatgttctgctcaatgtgccaagtgcacaaccgatgctcagaatccggcatcacagctgctattgctctatgcatggcattgtccccatctgtgatcaatcctctaggatgcttctgatacatgca

SEQ ID NO: 31131 - DNA, 8852 bp, Oryza sativa
tgctcaatttttcccataaccagaagaggagcccgtggataatgaaggctttggtgtccaggtcgtgccagccgtcaagcgcctgtggtcgtcgccttagtcttccgctgtttttcattgtctttgagtgtgttgggccatcgctgcccatgtaataattaactatttacgcttccgcttgttaaactctgaattgtatcaacttttggtgtaccttgcctccttggacaaggaataatacacgcacgtaaggaacgcccgttgggttatttccggtcgtgacaataattgtaccagctgagagattaactccgtgcagcattgtgatgaaatctttttcctctttcggtattgctctatgtgaccttaggaatttcttgagtgaaaactttctaaccagaggatgtgtgtgttcttcaacaaactgaattacttcccacctagctcctttcctcttcactgtcatccttgctttgcaggcagcctgtcttgttctacttcttttcattttctttggggggcacgcttcacccgttttttcttctggaccacatttgttgcaaacaaacattactttgtcacgttctccatctttggctgacttccttgaagtgttgattttgattgaaaatccaacgcgctttgcgtacctgttgtagtgagcccttgcttcctcctctgagttgaaagtcaaggtgaggtacggcacttgtgtgctgcacggaatatcctgtgatggcgctgactgtgcttctgaatcatctgttccagtgtcttcacttgaaattgtgttggcagtagcagttgttgcgccagttgcaacactagtatgcattgtgtctgcacgatctgacatttcttcaaatacttgcatctcatcatcgccttcaaatatttgcatctcatcattggcttcaaatacttgcatctcatcattggctacattgtgtgcttgtaaacttccagcatcaccagtagtatacatagtttcaaagtcaaaagtgtcgtccaaatttatagcaggaatctccatgctagtgtcagtcagatttatagggaagtatgtttcatttctgtcttcatcatcaactagtaaatggtgtactggaggttcattttcaccagaaactaattccgggatactgttgaggtcaaagtccatttttgctgcatgtgtttcaggctattagtaacaaagttagtttatacagagcattcattgaggtaattcagtaatttgggggggaggggggaagaagtaacttttagtttttgcagcatgtcttttttagatgctttctaggaagcaattttctcaaattaagaccagtggctatattaatgaatttttttttcacaatttgttttgatgcagtacaagatgaaattgagacgcaactaggtgatgcatcatgctgtatatagacacaaggtacaaaatgtgtaactaggaaatgtaaattcaagtttatagggaagtaacttccatgtttctaggaagtaactaattgaattgttacaagtaactttctgttaaaactgcactgagactgttaaaattgctatgagaacctaatgcacagtgagaagtaacttaatgcacggtgagaagtaacttaatgtttcttggaagtaactcattgaagtgttagaagtaacttttctgttaaaaatgcactgagacttctgttaaaattgctatgagatttccaacaccagcactcatgcctatgtaactagggaatgcaaattcaaatttattttgggaagtaaagtaacttttctgttcatattgcactgagaggtaactagatgggatgttttcatgctgtctaaactgtaaactagggattgtgaattcaagtttatctggaagtaagttgcatgttcctagaaattgctctgagttttttgaaacaccagtactcatgccttctctacaactttttttctcagcagcactagaaagtgaatttggggtataaaggaagacagaaatcaagagtagcactagaatgtgaatttggggtataaaggaagacagaaatcaagaaggaagacagaaaacaagactacagctcattactcacaaaattactcacaaaattacagcacagattcatatcaatttgtttgtcgaagaatacagagaagatctaaaagtttctaggttagtttttttttgtggatggatctcacagaagacagaatttgaacttcatgtgtactttacttggatattttttcttggatttgcttctcctccttctcctcttccaagatggcgatttttttctgatttttaccaccgtggcggctgtgtgtggattgatgtctccggatgggttggagtgagggagagaggcgcatcgcgctgttttaggtggggcccacgccagctagcgaggcgtgcatcgcacggcgcttgcgcgcgcaagcgcgtgctttccttttttagcgatggcacgcgcgggggcccgggaaaaaggtggttaccgtttttggcatggggcgcgcgcgcggtgcggaatcgccagatgcgcgcgtcgcgcgatagccctatcgtgataccggtctcggtatagtcgcgtccttctaagctaataagttaggctgtaatttccaagacaagaagaaatcagagccatttgatatactgtatatataatatgtactcgaagaaatttgttttcttttggcaacaaaacaaatttctccccctctttccattttccctctagatgtttcatctctccagtgtgccaccacccagagcagagcgccgtcgcccgccagccgaaccccacgcgcggaaactgctcgtctcccagcggaccaggttgacgagcattttccgccgcctccgcttgtctgccaccgccggccccgcattcaggccgcggctctcaatttccgccaccaccatcgccaccgccggctatctcttttgtgatcttcagtaggaacagcagggggaatgcccggaacgaagaagcagctctttgcctctttcaagatatggagacagatagtgcaggttgcgttacacgctgtcgttggatggaacaccaattttgtcctggaagtcacctggaaagaaaaaaaaaagtacgaggctaatgcatggtaaactccagatataacatttgcattgagttaggacgaaaaacatctgctagatcataagttccttcgtaggctagtactgagccatcaatccatcgtacatcagtattatctgcatatgcagtttgtactctcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagcaccaaccgagactaaagatcttaactttagccccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtctatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaatgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaattaacggtctagcgatggcttcagctccactcccacaggcagctcaactggggtataagccaaacgtcttctccttctggatcctttatcttcaactgaggtttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccaagtataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccctttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtaactcgcgaaccggtccttaattgtcatgagcacgactctcaaaaccatgtgctcacaacccaccattatcaagttttagttggcaagtaattaattaaccaatcacgattgaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaatagggtaatcaatgcaaactggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctcgaatacttccggcgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctagcggcggcacggcttcggtcgacggcggcgacggggctccggtgaccggcgacagcggggagagagcggccgggcttctccacacctcggcgcaccttacggcggtgacggcgaccggcggcgacgacggaggcgacggcgcgacgcggatggagctcggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttggaggtaaagatagaggaggataagaggaatatttcccctcaactaattttagaaaaacacaaggggaaaggtcagatttggaggggaaaaccgcggctatacaggtactgtgcggctggctcgggctctgtctccagccggctggagattgaagatgacactgtagcagggaggcaaactagactttttgctgggcttctacttcttggcccgattgaaaaagggacacaaagcagactttggaggagggataaggccagccgaaaggaagggagaatgggccgaggatagaagctgaacttttcctatttcggcccgaaaaggagaaggggattttaaatacttttccaattaaattaatcactgaaatgatctttgaattgtgaaaaatacttcctatgctcaaataattccaagaaaaatcttgaaaatacttggacactcaaagtacttaacaaaattataattagaccatttaatgattaatttaatatgtgggtaattactgaaatgctctttgtaagattaaaaattaggaattgagctccgaaaaatccgagaatattccagagagttgacttaatcatggagaatttaataaaaaattaaatccatccatgctttatatttaggaaattttatttcccacatttaacttcacatgtaaattaatgaacatttaatataaattctattattaatttattaaataatttataaatcctgaaacgaaaatcaggatgtgacagctaacaaagaagagaattcctgctaaggtgatgtggtatttccctataataccacggctaaggcgtttgttcaggaacaaggggaatgctagaatgttgcgatggcacgctgaagagcgtcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagtatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtggtataatctttagtcccggttcttaaccctaaccgggtttaaaaagaatttcgaaatagcgggaaaagatatttact

SEQ ID NO: 31132 - DNA, 282 bp, Oryza sativa
caaccgggagtaaagatccaggggtatatatattcggggtgcgccctcgtcttcttcaccaacacttaaacgttttcggccgatcgatctctctcggcctctctccttcgccgccactgcctagggcaaatccccgcgccgacgccgcgtatctcgccgtcgtctcgagctcgtcgtcctcgccgccgcctccgcctcctccgctgccgccgcatctctggggtgagagcctacgcatctcccttcatgcatcaagatctctccgatctcctctctctccgt

SEQ ID NO: 31133 - DNA, 19313 bp, Oryza sativa
aggcacatggtgacatgatgtggggttgtgtcttgtgggtacagtggtacacctctgatcagagtaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttgttaagccgttgtcttagatcgatgtgttagtttgcttgttttaagtttgcttgtgtgtgtgggtcttgcatgtgatttacatcagtggtgggatgtaagtgcatgcgtttgtttgcttttgagagttaggaagttggtgagtttagtggtgtgagagtctttagtttgtaataataaaactcagttaagatcaataaaagttaaagtaattctctatcttaagtagtttcccccggtttctcttcttgtgccctgcccatgccaaatggtgaacactcacagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaatcacatggagcagaagaaacgtcggattgctcacttcaaggcacaacagggaaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccagcacagcaacaacctgccaagagagagcaaggcagcaagcccgtggtgtgtttcaactgtggagacccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttccttgttaactcagttcctgcaacagtacttttcgattctggtgctacacattcattcttatctatgagttttgcgggaaatcatgggatggaagtagaagatcttagacgtcctttgatggttaataccccaagtgatcaagcactttctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaccagcaatgatggtcgagttgtgactgttcatgcattgtcatctgagtctttaaggtcaagactgaaccagataactttggaagagattcctatagttcgggagtattccgatgtgttcccagatgatttacctggtatgccgcctaaaagggatatagagtttagaatagatttggtacctggaacgactccgatccataagagaccttatcgaatggcagccaatgagttggcagaagttaagaggcaagtagatgatttgcttcagaagggatacatcagacctagttcatctccatggggagctccggttatttttgtggaaaagaaagaccatacccagagaatgtgtgtggactatcgtgcattaaacgatgtgactatcaagaataagtatccgctacccagaattgatgatttgtttgatcagcttaaaggtgccactgttttctccaagatagatcttcgatcaggatatcaccagttgagaattaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgccttgcattggagaagctacgagaacatcaactgtatgccaagtttagcaagtgtgaattttggttgtctgaagtgaaattccttggtcacgtcatctcagcaggaggagttgccgtcgatcctagtaatgtggaatccgtaaccaattggaagcaaccaaagacagtttcagagattcgcagtttcttaggcctcgcaggatattatcggaggtttatagagaatttttccaagattgctaagcccatgacacgattgcttcagaaacatgtgaagtacaagtggtcagaagaatgtgagcagagttttcaagagttgaagaatcgcttaatatcagctcctattttgattttgcctgatccaaagaagggtttccaagtgtattgtgatgcatccaaacttgggttaggttgtgttttgatgcaagaagggaaggtggttgcctatgcatctcgtcagttacgtccgcatgagaagaactaccctactcatgatcttgagttagctgcagtagttcatgcattgaagatttggcgtcattatcttttcggtactcgtacagaagtgtacaccgatcacaagagtttaaagtatatctttactcagccagatctgaacatgagacaacggagatggttggaattaattaaggattatgacatgggaattcattatcacccgggaaaggctaatgttgtagcagatgctcttagcaggaaaagttattgcaatgctacagaaggacgacagttgccattggaattatgcaaggaatttgaaagattaaatttgggaattgtcagtagaggtttcgttgcagccttagaagcgaagcccactctaattgatcaagtaagagaagcccaaattaatgatcctgatattcaagagatcaagaagaatatgagaagaggaaaagctatcggtttcttggaggatgagcaaggaactgtatggttaggtgaaagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaatcggtatggattttatcactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccttacgaagcgctgtatggtcggaagtgccgcactccgcttttgtgggatcaaacgggagaacgtcaggtttttgggacggatatcctaagggaagcagaagaaaaggtaaagatcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgatcagatagaagtccaagaggatctgacctatgttgagaaaccaatccgtatcttggaaacaaatgagagaagaaccaggaatcgagttatccgtttttgcaaagtccaatggagtaatcactcggaagaagagtccacttgggaacgagaagatgaattgaagtcagctcatccgcatctgttcgccagttcttccgaatctcgaggacgagattctgtttaaggggggtaggtttgtcacaccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcgtccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccaccttcactttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggctgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaggatccccctggatagggattggtgtagcggaccctttggttagccccctgttgattgaggaaattcgccaagtgacgcttgtgcgactccagttccttgtgcttggcttccaagcggatgctcttgtccaccagacgctggaaatccggataatccccggagaccagacgcacagatagctcagggtccattcctgccaagaacttctcctgcttttcctcatcttcccgaacatcctccggggcgtaccgggccaggttgttgaactcatgcaaatactccatcacagagcggttgccttgcttcaactcccggaattcccttttcttaagggccatgactctggcaggcacatgggtcctccggaaagcggcggtgaagcgggcccaggtaataggctgcccctcgggctgcgtagcctggaagtggtcccaccatagagatgcgggcccctgcagctggtgggtggcaaagatgactttctcctcatcgttgcactgcacggtgtctaacttcttccccacggcatgcaaccaatccaaggcatccacggggttattggagctagagaaggtaggcgggcggatgcgaaggaactcggcgagcttagaatgctgcgggggtggtggtggaggtggagcattatgctgtggtggattttggatgtggtggaggaaagcagccatcatgttggcctgctgggcgaggatttgagtgaggatggggttggtgtctggtggtggtggtggtggcgggggaggaggtagaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaacgagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtctccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacagctgcgcctccagcgcgtctaggtccttcttcagctgcagattctcctgacgcagctccaggatcttcatgttgttctcgaccatcccacggcgcaccatatgatggaagtcgatacgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcagcggagaaggaatctcctcccgtggtgactgccaacgaagtcctctcgggagagccagtgaggatcactgcagtgacctcccaagcagcatgcgactctgcatcgtcaccctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaattattacatgggcagcgacggcccaacacactcaaagacaacgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccagaacccccggacaggcaggcagaattgagcccctagcagcaggacaccagccctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaacaatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccattaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttcccttgctcgctttcccaaacgtcggcttcaacctccacgaagagcggatcttccgaagctgcagcgtctacacaaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgccggcggcggccataggcacggcggagcggcggccgagagaggggagggaaagggggaaacgaagcggcggtccacggctcaccccgggtcgacggtgacgacggaaacggcgaccggagcggaggaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacagcgcgagctcgattccggcggggagagagggcggtgagtggcggaaacggtggtggggagctcggggagggtttatatagggttggaagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggacggcgggaggcggcgggattcgcggcggcgtcggcgctaggcgcgggcgaggcggcggaggcggcgggaggaaggggatgacgggtgggccccacccgtcagcgagggaggcgggcgggcccgcccgtcagcggcgcgcgcgcggggaggaggccaagtgggccgcggggaggaggagagagggggagggagatgggccgagccggcccattagaggggagaggtgatttttagggtttttctctttataaaatcattttaactttgtttatttcttaataattattatttgtgctctgaaaattccactaaaatttatttacacattttaggcttttagaaaatatacaaaaatcctccaagcccaatttgacttttaactttgcacattttaatttttgaaggctttcacaagcattttaattattctaggcataatttagaggatgtattttagggtcgatttgggacgcgacaattatgcaattgatgtctgaattgtatggaggggctaggaatgtaccctacactagaaaagacataagcaatttcaagtcaaagttggggagcgagtataggagtataggtgtagagatattcctgaaacaattgctcacttcgaggaaatcaaaaaggatgacccaaatttcttctacaagattcaacttgatagggaagacagggtgcagaacatattttgggttgatggagcagcaagaaatgcctacaatgacttcaaagattgcatctcgtttgactgcacatatatgacaaacatgtataacatgccttgtgcaccattcattgggataaacagacatgggcaatcaatacaggtactccttttttttgcaaaaaagtaattctaaaaaatctgtaataactttggaaattatagtacatcataagttacttgttgcattcattgagttacatcaagtcctgataaaagttacttccagtagaatgtgaagttacatttttttaaaaaaaaaaggtaaaaaagtaactaagtttacaagttacatttttagtgtttgttctatagttcaaaattgtactgatttacttccagcaaacacaaactgtacaaactacgcaaaattgtagtaacttacttgcttcaaaactgtactgacttccttatgtgtattatttttgatattcagctgggttgtggatttctatggaatgaaaagacagaaacctttgtatggttgtttcaagcatttctagaggctatggaaggtgtagagcccacaaacataataactgatcaagacctagctatgaaggcagctatagcgctagttttcccacatgctaagcatcgcaactgctgctggcatataatgcagaatgctcagaagaagattggccatatattagatcatgacaaagcattgtgtgatgcattcaatgactgccttgacaacagctggacagagcaagagtttgatgctaaatgggatgcaatgttgacaacatatcatttacaagatagtgagcacttccgacacctttgggaaatgagacggtgttgggtcccagcatactttatgcactgtttcttccctttcctccagactacagcacggagtgagggatttaacgcagtgctgaagcgctatgtaaatcctcaaaacagcatatacaacttatttttgcagtacaagaagattcaagaaaaaatcactgttgcaacagatcagaatgagtttgaagcagaagaaacaatcccttctatgtgggctaactatcccatggaaacaaaagcattggaggtctacacaaggcctatattcaacagatttcaaaaagagcttattgcttcaacatcatataaattgacctgaacttctgaaaacatgtatctagtagaaccgaatggaggtcctgttaggaattatggatcaagggcattcattgtagctgcaaatgtgttggacaggatatacaactgtgaatgctgtaagttcgaaagggatggcattctttgctgtcatgttctgaaggtaacagtctgttattgcagtaagctacttctcactgtgcattaagctacttctcactgcacattaagttacttcttaatgtgcattaaattacttcttatgcattacgcacttttggcaggtaataaaacatatgtttttttccatgcaggtgatgacatttgattttgtgggccaagtgagtgacattccagaacactacatattgcctagatggacgatggttaaagagcctgaattgcctccagttacaagcattggtgaacaaatgcaattgccccctaaatctctgaagctaatcaggtataccaatctgtgcacaaaatttacacagattgcaaaagatgcatcaagcaacgagaaagcctaccgtatggctctacagtgtatgagctcaatgactgatgacttagcagctatgaagcagagtagaaagaaacagaaaaaagcacagccagccccatctgatcctgcaagaggaatttcagatatcccctcagcatcaactaacccaacactacagataaatgaccccccccccatcatacaaaagcaagggagaccagtttcaacgagacgcaagcctggggtccatgcaaaggcgtcaaagacatcagttaggaaaggcctagctagtactgagaagtgaattagagctacgagatgtaacttataatgttgtgacaagattgttgaaacttacttgcacagttgcattaagttacttttagcttccatagtagttacttcacagtgatatgtaagttctcaggaagaccatgctgagttctttgcagaaccaagatgctattttaatttgttacccaacctaatttatgtggctataacttatgtgctggttctggaaaaaaaatgcagtgtttcattactttaccttaagtgtaggatcaggctctttgccccataatacttgcatccattgcacacgatttccttgaaacgagagtatcttgtgtgtaagtagtttcttaatgttggggatgtcacttggttcaaatgctggcaactgtttgccatcccacaactccacaaatttcagcatataaaaaccacaatcccggctgtttttgtttgcaaaaacaaaatagggataagtttgactaaagacaataaatgaaaatcactaactaaaaaaaagcatgttacgtacgtgttatcttgctttgggccatcaatgaaaatcagtgggtaattctagatggttttcttcgaaaacctcatgtaaaacctatcccacatggtcttgatggatgcaacaacaagatgagatgctgaaatcagtgcttcgtcatcttctcccctcagcgaatcataaacctcgaatctttcagctttcagattaaggcacaccacgaaatagtgactagccttatcattcccattacccaattcttggagaatgggaaaaaatgcctgcattcaagtgaaaagagggaggggagtggaaagaaggtttttcagtaaatataatcatgatttagtaagtataaaaggataataaaaagtgattcaaaataacatttcctgtcaatataacagaaaaagttacttccacaaacatgctgagttaatttgcaaagacatttaagttacttctacaagcagacaggaaaaagtaactttacatatcattgacagctggaatatatattttcttactaattctttatggtcaagatggttcgctctcgtttgatcgaagtgtttcttgagctcattcctgtccaactgcgaatccaacaaatatccctgcaccatgtggaaaaaaaaacataaggtgttgcaatgatagtaatagtacattaaaaagagattttaatttgtaaattttatatactcactcctattctggcaggaaaaattctcttcgaattgtccttgatatcagtagacagaacaattaatgccaattcacatgtgttattgtccagtgagcccataggtttgacagagttcgcaagatcgctaagataaatataatattctcctgtatcaatgatcttttggctacatttaacaaaagcaaaaagaaaaaaaataaataagcaaattagtataccatgtacaactactgtagcatgttaaattaatttcaatgacatggtaagttactttcaatgacatgttaagttacattcagtgacatgttaagttactttcagtgacatgttaagttactttctatgacatgtaaagttactgcacaggggtgtgtagaaagtttgtctggaaaaaattgctcggtcgtgtgcagaaccaatatgcacacaacaaaaaatggaaggtatgaaccaaaatgcagttgcttcaatggcatgtgaagttacttatataattttacttctctgagaagtgaagttagttctacaaagatcattttactaaaaaagtaaaaaagtactgtgtacagcaaaaaatatgtgattgtacctattccttcttgacttggttctccctccattcttgcaaatgtcatcatatacctcgtttataactcgagaaaccatgaactgcttcttgttctcataatcaattaagggtgaccttttgaatttcgctggtttcaccacccttttattgtactcatggggcacaggtgtttcttcttctacttcacaagcaataggttccttggagattacttcagcgacaggtgattttgtggcagatttgctggcaatggcctcatctgcttctctcccaaccttttcatagtcttcagtagtaaaacttccatagtcctcatttgtgataattccaggaaattctttaccttgagatgttcctgctgcttcttg

SEQ ID NO: 31134 - DNA, 4432 bp, Oryza sativa
gaaggggatgacgggtgggccccacccgtcagcgagggaggcgggcgggcccgcccgtcagcagcgcgcgcacggggaggaggccgagtgggccgcggggaggaggagaaagggggagggagatgggccgagccggcccattagaggggagaggtgatttttagggtttttctttttataaaatcattttaactttgtttatttcttaataattattatttgtgctctgaaaattccactaaaatttatttacacattttaggcttttaggaaatatacaaaaatcctccaagccctatttgactttcaactttgcacattttaatttttgaaggcttttaattattctaggcataatttagaggatgtattttagggtcgatttgggacgcgacaaacctacccccttaaacggaatctcgaccccgagattcggaagaactggcgaagagatctggatgggctgccttcagctcgtcttcacgctcccaagtagcttcttcctcggcatggttgctccatcggaccttgcaaaaacggattacccgattcctggtcctgcgctccatggtgtccaggattttcactggtctttccacgtaggtcaagtcttcgcgaacttcaatctgctctgagtcggcctgctcggatggcactcgaagacatttcttgagttgcgacacatgaaacacatcatgcacgttgcccaaggaggcgggcagctccaactggtaagcaacttctccgcgtcgagcaatgatgcggaaaggactcacgaaccgaggggcgagcttccctttcgcttgaaacctgtgtacaccccgcaacggcgttacccggagatacacaaagttatccactgcgaattccaggtcacggcgtcggttgtctgcataactcttctgccgagactgtgccacctttaggttttcccgaatggtcctgaccttcgctttagcttctctcaagatatcggtcccgaacacttggctttccccaacttggtcccacaatagtggtgtcctgcatttgcggccatacaacgcttcgtatggtgccatctgtatgctggcttggtagctgttattgtaggagaactcggcgtaggggagactcttatcccatgtcttcccaaaatctaggacacatgcgcaaagcataacttcgaggatctggttcagacgctcggtctgcccatctgtctgcgggtggtacgcggtgctgaaatttaatcgggttcccaactcttcctggagtttcttccagaaatgagaggtgaactggcttccccgatcagagacaattttcttaggaatgccatggagacttacgatcctagcgaagtagagttcaactagtttgttccctccataggtggtctttacgagaatgaaccgtgctaccttggttagtcgatccacgactacccatatagaatcatatccgccttgggtttttggaagtccggtgataaaatccatcccaatttcatcccatttccattctggcacttgtagaggttggaggagtccggccggtcattggtgctcgactttgacacgctggcacacatcacaaagggccacgaactctgcaatttcccgcttcatactaacccaccaatatttctctttcaagtccaagtacatcttcgtgctgccaggatggatggaatagggactttcgtgagcttcctgaagtatcaactgtttaagttccctgacgtctggaacgtgtggacccccgtttttataacaggaatcaatcgtgtaaacagtaccatttccctggatcaagtagtttggtacccacgaattcatagctggaataccaagtgcacatacacgagtgtctaatacgaattattacatcataggcccgcaggcatagtcttaaatcatcggaccgagcggtccggaatacatccaaaaacagaaatagataaggtagcggaattcaggcagcggcatgccattgccacaggcaacgaccgtactaagacctactgggcaccatcgtcttcgtctccctcctggtagtaggcatagggatcctccgtagcttcatcgcccgcttctgattaattttatatttgcaagggtgagtaccaaccgtactcaacaagccaccacagcaacaatgcatatgaaagggggagagttcaaaggatggctatagttcttttgcgcaaagcaagttttgtaattcttttcacaagcctaagacctagcattgactgatcaaattttagtaccagagtttgtatttaaacaacgacggttctgtccaccatccagtgtgatcccaaggatagtttctcgccattgattcgtcatggttttcggaggacgtccaccttcctgcctctcaggaagtggctccaacggcatagaaatcatcatgcaatatcccatcccacacaggttaagaatttagagtctagccaagtgtaatacatgtcccggtgctcaataaccgcgagcacggctattcgaatagatttggtttacttacactgcagtggatgtacactttacccgcactccacgactgcccaacatatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggacagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatactcattcgagaagtacggttgtacgggggtcgtttcatgcttaacttcatggctcggtccttaattgaccggggacggtactagcctttcccagataccacccaaatcctccgtccgccccagtcgaaaacaattgtttaattttattttttctttcacaaatcatgtcatcaacatcatggcaatgtggcgctcatgtctccacatgccgcatctcaattaccttcccaaaggtaattgcccaagcatatagcatttgataattatgagtatgcatgattctagaatagcatttctaagcatttgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcgaggtcccgcgggtcttgtccttcacctggatccgcggctccctcggtctctatagttacgtgcgaaaattgatttgaattcggttagaattcaaataaaaatccaagtaaatccaaatggaagtcgaatgcgaaagtcgattcttttatattaactttactattcgcgaactagggcaaaccccatttcaatttaaactattttgcgagtataaatattttgttgtcatgagtttttaatttaacctacccgagcaacatatcaattaataggttagaaatttctatcgcgagctaaacatcggacgaaatcctagaatattatacgacttaatttagtctatgattaaatataatacacggctaacatcctagtaattaaatccgaatcgctaccgttaatcgattacttatagagattacccagaaataatccataataatttacgagaattcatacatttgtttaattattaattacatctaaattaataccgcgaattgattccttatggagagtaataaaataatctataatctataggaattcatccaattatattttcattaatcctatatttaaaagccagtgttttaggtatttaattagtaagatttcatctaactatattttcattaatcctataattaaattctaatatttgcaaatattttaaatttcccccaaaatttttcctttttcttttccctctctctctctctttatttttttcttctcttttctttcctttcctttttcctctcctctcttttcttttcctcttttcttttcttttcattctctcctctcttttcttttcctcttttcttttcttttctttcttttctttcttttctccccctctctctcttttcttttcttcttcctcctcctggctcctttctctcttcccttctcttctgtcggaactctctctctccctacccgtggcggcggtgacgacagcacgcacggaggaggggggggggggggcggcggcttaccgacggcggcgggggcga

SEQ ID NO: 31135 - DNA, 3430 bp, Oryza sativa
cgacagcgcggcagcgtcggcacggggcgcaaggcgacgcgacggacggcagcggcgacgcgacagcgggcggcacggcgcggggtgcgatgacgcgataacaacggcgacggcgacgcggcagcgacggcgatggcgcgcggcgggacgaggcgcgaggcgcgacggggacggccgagcggcgcgcggcgcggcaggcgacagcggcacggcggcaggcggcgacggcgacggctcggggcgcgaggcgcgcatggcagggaaggggaaggggctaggggacacggtcgagcacgtggcggccgatgaacagtgcactttcctatttttctcattttagtctattacttttataaatttgattccacaattcctaatttttgcataaatgaagtttactccatatttgtgttatcctaactaaaaaaattcaccctaatttaatatcactcatattttgtttatataatttatttaaatttttaattagggttaattctcatttcatcatactaaaatttaattattgctaatatggttgcgataatattttatttattttccaatcccacctaatctttattttaatttatattttaattatttatttagccaacttgatttttagggtttattcctagttagttattcattattcgcgattaataaattccgagatcaaaatccaatgaaacaggcgaataaaatcatgatgcaatttattacttaaaatgttttgaaactccgtatttttggtgttttgattttgttggtcgaattttcagggtgttacagaacgcatacccgattcccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcagggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgccgaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgctttctcacactgcggactccacacaaatttttcttctttcttcaacaactgtgtcatggtcgagcgattttggagaagttctcgatgaacctccgatagtacccggccaaacccaaaaagctgcggacttgagtgatcgtcttgggttgcttccaatcggtgacggcggtcaccgtttcggggtccacagcaactcctttagcagatatcacgtgccctaagaacttgacttcggacaaccagaactcacacttgctaagcttggcatacagttgatgttcccgcagctttcccaacaccagacggagatgctgctaatggtcttcctctgattgtgagtacaccaggatgtcgtcgatgaagaccacaacaaacttatccaagtattccatgaacactttgttcattaagttcatgaagaaggcaggagcattggtcagaccgaacgacatcaccgtgaattcatacagcccatatcgcgtggtgaatgcggtcttcgggatatcttcttcacgaatacgcaattggtgatatccggagcgaagatcgattttagaaaagatggtggcacctttgagctggtcgaacagatcatcgatccgaggaagagggtacttgttttcgatagtgacttcattgagagctctgtagtcaacacacatcctcttcgtcttatccttcttctccacaaaaatcacgggagcaccctagggggaagtgctcggccgtatataccccttttccttcagctcttccaattgcttcttgacttcggcaagttcatttgctgccatacggtagggccgtttgtacagaggagttgttcttggagcaagatctatccggaactcgatctcccgcttgggcggcataccgggtagttcttccggaaacacgtcaccgaactcactgacgatggggatttctgacaatcctatctgatgaagttctgaactgccaacagaggttgggggtgcaaagaacacaactggttgttccggccctcggtacagagtgacagtgcgccttgcgcaatccactaccccttggaattgagccaaccaattcatcccaaggatcacatccaagttcttggtgtccagaagaatcaaatccgaggggaaagggattccctggatttctataggaacggccgggctgtaatactttgctgtcatatcccctccaggggtggtgatgagcagagggttcctaagccgttctacccccagttgatttcttcccacgaaaggcacagatataaacgagtgggaagctccagagtcgaacaaaatggtagcaggaatggaatgaatgaggaacgtaccaacgatgacgtccggagttgtcagcacatcctcggcagtcacgtggttcacacgaccccgagcgacgtccttaccaccgttgttggggcggggaggcgcttggccttgctggcaccgcggcttcgggcatttgtccgcaaagtgtccgggctcgaagcagttgcagcacagacgctgctgtccttgagcgtctctgcggccttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggtttaaaaagtctcttttggctttgggccgaaagtcgg

SEQ ID NO: 31136 - DNA, 11001 bp, Oryza sativa
  unsure (1)..(11001): unsure at all n locations
nnnnnnnnnnnnnnnnnnnnnnnnnnnnnnnnnnnnnnatcattttattttcaatcatgtacgtttgtatgttacggaaagaacatcagtagcgtttgtatgttataaacatgtggaagttattatttttttaataatagatctaatctaatggtgtaaaataacgggtccaccaatttaagtgaaaatcaacggtaagattagatagtgccatgtggcgacttaggagtgtttgtaggagtgccacgtggcggctttagagcgtttgtagaaagtttaatggacttttagtatataactaggaaggtagcccgcgcattcgcgccggcatatatcgtaggttgcatttgagatactcgtaagtaataggccgattgtgttaaaatgtcgtatttgttatatagtaaactataggcatatgaatcttatatcattggtttgattataaacagagcaatagttagattagaaattagacgtgaaacttataattatagattatttatattttagttaaataggaacgtaagaggaatgaaaagtgtagagcttgagccagagaggggaaggagcgggtgtgtagtgatgggcgcgtgtggaggggattttttttgtaatttttctaagtgattaagtgaaagccaattattagatgtattttcctaagatttgcaagttttttttttaaaagatgtgacatgccacttattaagatatatttttctaaaagtagattatatagttgaaatatgtnntaataggttatcgatctaggtgaaaaccgttagctagatgttntatttttttcttttaatatataagattttactaattttttaaatgtgacacttggtaatttaacatgtctctaaaaggtcatacatggtgactttgtatttttctaatttttattatgtagaatgattaagatgacataatatatattgtcaattttttaatgtttcagtgttgtttgcttgttggtctatgttcaaattacgtattttaaatttttcatagtaaaatatgagtaacataaatcaacaattcaaataaattaaaaataggatgttatttgggttgtcaggtaaagaataggtggaaattcaaataacatattttattttttatagtgaaatattggtaatattgattttaaattatttagctgtctaattatgaaacaaccgttcaaacaaactaacctccgtttcatattataagtcattttgacttttttcagtgaatttttaagtttgaccaagtttatagaaaatatagtaaaattttcaaaaaaaaatatattatggatatatatggaacgttatatctaacaaaacaattttgtgtgatagatgttgttaaatatttttatatattcggtcaaatctaaagaaatttaattaagaaaaaagttaaaatggcttataatatgaaatagagggagtaactttttaaaattatgattattttgctatgtaactattatcttttttctaaattgttggttaaaaatagattattatttataaaagcatgcatcagatcattaatcatttatatatttaggcatgggacatgcaatcaagaatccacggccattctcgtgagatagaagtgaagcaattaattattaagtaataaaacaaaaatcttaactaccatagagaaaaaaaagaaagggatgaggagaaaggattgaggggaaggagatgagaacgtcggtagtagttgaggaatgatttttttatgagataaatccaattggcccaccagttcaagttatatattttttctaatttattggagtgccacgtggtggcttaggagtgtttataagagtctcatgtggcaacttaagagtgtttataggaagtttaatcgacttttagtatataataatagatagatagatatatagatatattatatgttgttaataagtatttaatttatttagatggcatgcaaacttgcaaaatgcacagtctataccacaataacatattgcttatatatagcaaaacattggatgtaaaattgtcaatttagttataaatagagcaatgttttaatagaatataaattagctatgtacatttaaattatggtcaacttaacttgtttttaatttgataatataaaataattaggataagaaagagatggagatataaaagaataggaagaggaagagacaggaagagcgtactactttcttatgtttttttctttttccggcccacggttatacgaagccacacgtaagtacggacgttttttttcataatttttttttctttttctggcccacagtagaggaagggattactttcttaaataataatagatctaatccaatggtctaaaatatcggatccaccaatttaagtgaaaatcgacggtgagattatatagtgccatgtggcggtctaggagtgtttgtaggagtgacacgtggcggattgagagcgtttgtaggaagtttaatggacttttagtatataactagcaaggaaacccgtgccgatgcatgggtaatttatttgttgtttataaaaaagaatataaaaaatcgtatctcaccatattcaactgtaataactataaattacattataatcataaaagaaagaaatacttacaccatgaaatagcaccatggaatttgtatatactcaatgacaatgtctattataatcaaacagagtcactttatactggttatacctacacgtcgatattaccattttttacagacatactagttaatatgaaggttgtttttttcttttactatacatttaagtcacctgcgcatgttcatgggtaatatacgaaggaataatccattgtcaaaattatttgtgctaattttgttaacactttttatatgagaatggcataattacataaggatataatatgtttccatgtgacatttttttattctaagtatgtatattttctttttgtgaatagtagtatgtgtattcataggatggtgtgcacacatttatatgagcgcttacgattgccttttacatggttagtaaaaaaaatactttcaaaaagtttggtgggatggcatgaagcggtgccacagcgacacgacttcttcgagaagattgcatgagtgtcattacatatatcatatatgcacaatttgagaaaaaaactttagtgcctcaaattaaagaaaaaaaaactatcagatagagcagatcgtatatgaactcttcttttttattcttttttacatatcttgtgtacatacgtacatacgaagggattaaatggtttttagttggaatagatctaatgtaatggttgaaaataatggagctacgtgtatatcaatggccaaatattttgttttcttataatttttcttattttttttctaatttattagagttgtcacgtggcatcttaagagtgcttgtaggagtgtagaaatgttattactcacactggcaacctactcactgtcaactattgtttgttgtggtttagtggcatactcttcttacctatcatttgttgaagttgcccacttagtatagtcctatcttcagtgcttgatgacacatgtgcttattggatatcagctaattattaggtgcactgtgcacgaatgcctcgtaagcaatattcccactaatacagaacttatatacttatgattagtgggaatatacgattgtattagactattttgtatttataaagtatattatatactacatattaagggttttaatatgtatgcaataagttgtaaagtacttatcggattggctactctcttatttattatgagcacgtttcctcgattgttctaggaatttttataaaagaaattaataccttttgataacaatatctaagtccatctaaaccattatattccttataaataaattgataatcatggactacattgtatatatttaagtgaaacgtgtgtattattagaaatatattctatataaaagctaaatctatttttggcttcataatatttaatatttaattaatcttgcactaatgacatgtgtcgtttcgtgtgtccaagataagctcagctattgagctagatcaaagtctaattaagttggagatagaagacatcgacatggtgtcaaaagaatatataagatctttaaatgttcaaatattatagaatagagaaaacatataatacctgaaaatacgttcatgataatttagtaatatcattttgacatattattatattttacctagggagtggaaaattttttagaattgttagtcacaattagagttgtttttattttagaaatgaaagcctaatttagctatcatataatctattttttattttatttatatttttcatggatgtttccatgaaatgcgcctaattagaaactctaaataacatatattttgcatagtaaatatagacagtttggttttccataataagtgagatagaaaaaaaagaatgatgtgggcccaacgtcgtacgtacgtatcaaaatatggacgtactttttgttttttttggaatacctatatgtgcacgtacaataagagtttttagataaatttaattgtatttttataatagatttaatggttagaactaacgggtccatcggattctaaaatttattagagcgccacgtggcgacttaagagtgtttttaggggtgctatgtggcgttttaggagcgtttataggaaatttaatagacttttagtatataatagatagatagatagatagatagatagatagatagatataacaataaaagaaaattaacgctgcaccaaccaccgctaagcaagatcagagagcgctaagcctagacatgaacccaccactgaacgacccacgccaacaccaccaatcacagctaaaacttatccgtcgaacaaagcgagaagggttgcagagcggagatagctcgagcctcgagagaagcaaaaacctatccctcgatcgaacaaacccgctgccatccaatgatctaaaagcgtatcatcccgcgccagatggagcgcgaggcgcctgagcagatgcatgcttctgcggatcgtgacggcggatggcatcggcgtcgacgcggcgtcccttgtgagatgcgtgcaggatgcgatcgttagttcgctactcatccggaggcgtcatgcgtggaggaagaagagacctcgcgcctctctgcttgcaatgcgtggtggagtagagagaggagaagcccaagagtctggctggcccctgggccaccccaaacacacacatgggctgatttgtttgagcgcattcggcccaggcaagccacagcccattggagagggcccccggcgccgtctctgtaaccttgctcgccatccggttgctgcaagcctgcaatgatgaacagatacagtgtaagtggttcatcgcaaaacaagcgcttctgagcttctataggagcagcaagggtagggtaatggactaatggagaatcaactgaccatgcaaatggtgcctaatctctggaggattttccttctcggctctgtcaagatataacgacagatggcggctgcattactcgtccgatggaacaccaatttgtcttggaaaccacctggaaaaaacaatgcattggactgtaataactgttctgcagaatctccaggttgaactcacggaaacaatttgatttgaggaagcaaatgcaaaagcaagtcccaaattaatttaacgttattttgaggagttatattatgtcgtcagacatttgccgtactacatggctgaaaaaggctcgccagggtgaatctagtacaaaaggaaccattcatttgtaaatgttacattaatgctcaacaaaacaagataattgtatcgctatcgcaagtgcattattgaaagtaggagtacgaaacacacataaaaatgtattcccgaaaaataaaacacatataaaatgagcaccatcagcatcaaaacacaatatctaaccacgagggttatttcattaaccatctaagaaaaagtagacatcccttttatatgataaattattttgacttttttcatagttaaactttttaaatttgataaaacttattaaaaaaaagcaatgtctaaaacatcaaatcggtttcgctaaatcttacttttttttgcggggtcgctaaatcttactttgaatatatgttgatgatatgtttgttttgtgttgaaaatgatactatgtttttctataaatttgatcaaactaaaagaagtttgactaagaaaaagtcaaaacgacttataatatgaaaatgagggagtacatttaatctttcaattcgctgccttgtattccctgacatataccaactatattgacactattatatactttgggtgggtgtgcggtgccacttgggcagttgggagggggggggggggcaatcaatcaagtcctcaggacagaaaattgtgattacaccgaagataaagtgaaatacttggaagaaattgaaagtaccttcggtttaaaggatctgatcaagataaagagtttatcttgggcttgctgacagttcggcttaggagttgagatcccactggtaatgcaaatcatgtatccacatggctctgacaacaggggagaagcaaatttacattgtgcccagtggaccatactgggtcaatgtgcctctgcccctgagacatcttgctctcacctttctgtttcaagaaaaaaaagtgtaatagcagaggaagtagtaaactaccataattgtacaactaatgtaacattggttagataacagataaaggaactctatggactataggggctgaaagccacagtggttgctagctagtacctactgcctagtgcagaaaaaatcacaaaaattgagggtaataagttggttttcgatgaactaacctcacgatataagtcactgatgtatcatgtacttttaaatgtgggtttgatgcttctaattttttgacttgatccattagattgatgctgcatgcctccatacttagatcttgcagtgaagcggngaagccctcctttggcaacattctttttgaggacatcgagagatgtctagtccatatagagaagaaaagcgatgcaaccctttagggagggactttaagcgaggacacccatagaattctaggtattggagggaggcaaggagctgaagtacctgctcctgcttttctgtgaagctttctgtaatcaagtcagacgtgaatctcaactcgatgagggtcgcagcgaggaggctacaaatggtttcaacaaacactgctgagatactgtccacatcaagtcgtaccagctgttggaaggagccacctgcaggcataactttggtccttgccacctctgagaacatatccgttgctatggagcagcgatgattattattgccgtaaaaattctctatttataagagtattggctgtatgtgatgaaaggattgaacccatccacggttaagttaacacagtgctttagtgttaaactggtgagggatgtgaggtttgagagtggagccatcgattgcatgcttgactctcccacaatactgagttccttgagggaagtagggaagggcttcctggtctgagctcctgcctctaccatggaccactgagaaaacatgttgccacatccatcgatctcgagtgtttcgagtgaggagagatgttggagacagcctccatccacatcctccactggaagaaccagattcctgtgatttgagattgaggcaacgtgcaatgagctgggcgataggaatcgcagtactacttcctcttcctcttcagattcaggaaacatgctcaagaagaaatgggtaagagctgggaaacaatttaataacttacccaatgatttttcggtaagatgacaatctctgagattgagttgctgaactgaacaaaagataaaaccattgtctacttcactggataacatgcttttgcatcctgtgacatcaaggcttgttaatgaattcagcttttggagatcagtcaatgaaatgtggaacatgttttcaattgtcatatcttttactttgtccaggttatggaaagccaaagcacccccataaccatctattctcagtgtctcttcttcaaaatgcagctttgcttgattatcttctttcacagtaacacgtgttagcatggtattgtgaggcatgggtggcaatgacaacttggagcaatttcgaatctcaagagaacacaggtttgggaaccatactgtgtttatgtcttgtgtgcaaatgacagagcacttagagaatggcaacagtagcaccgagaaattgggacaatcttcacatctgatgcttgcaagctttgaaaacaaatgccaatgagctcccccaacccactccacaagttctggcatgccaacaaatttaattttcttcaagtgtaaaaaactcttttgggtaacaccaccaaaatcaggtccaaacttacgtatgccagcaatattgatcaaagtaagttcctccagatgcattagttgcccgaaaggtgggaaagttccccaagataagccttctagatggagagatttcaagcctttgacacaaacatcaccacacaaccaagtaggtccagtggaaccaccatggtttcgtatgtcaagtgctctaagattaggatgtggttgcagaccatcaagaacgccagatcctatggagagttgctttgcactccaaactagtgtcaatgctttcagattccttttcgatatcaatttagcatcatttgcttcttctcttgttgccacattttcaaggttaaatatctttagctctcctccaagctctgtcaaattccccaactcactcagttcaaatccaatgtcctctttcttaacatggtactcttccagccactgtaaatacttcatctttccaatcccaggaatattggaacatagctccattttagaaattaaatggcgcaaattgactaggcaagaaatgtcttgtggcaaaatacacttactataccctaggtccaagaattttaagtgataaaatctgcacattgcacttggtaaagaaaattccgagtcatatggtaattcaagttttaagtagcgaaggtggagtaattttgagaagttgtatgggaatgattcaagggagtttgcaaacatatatagaacacgaatgcactttgtttctttgaatatatttttgaaaaatatagtcatatctttattgtattctccaaaatacatcaaagtccgtatatttcctatatctatttttctcttgaatttttccatttcaccctcaaaatcattgtcatatttatcttgtaaggtgatggatatatggcgaacagattgtgggacattatttgacctaaagctatatgaccgtatactgacacactcatgtgaggaaacattttgtgctaactcatgtaataaatcgtgcatgatataatattgcctcttatcatcactaaccttcactaaaaagccattacctactagttcgtccagataacttaatcctatatcctcagctttattatgatcactagaatttatgatgcctattgcttcccagaaaaaagtaatttctaaattattaaactggtagttctcagggtaaagggaacagtatgaaaaacacttttttagatagaaaggaaggtaatcatagctaatttttagtgcaggcatcatcccatcgccattttgcatatttttctactcattcctttcaagaacttctatccaacattcctgggaaaggttctttttcaatagccggccaactgttttcgctgctagtgggaaacccttcaatttcatagaaatttcttttgcaatatcaattaagtcgtcaacataaatctcaggtttgcaatcagcaaatatacatgcttcaaagaatgcgaagaactcattgtgttatagaccttgcagttctatcagattagttgtcttcaccatttgtgctatatatggaaaccgggttgtgacaagaaccacgctgcctctggcctccccctttgtgaatggtgatagtaggcatttccactcatcttcactgctgcatttccaaatatcatccaagacgagtaaaaatcttttggatttcagtctttgtgcaatacatttttgggagctggtccaagttggatgattcatgtattcgactgcttgagcgttgctcccatccagcaacttgtaccggtaggtactggtactgggaggtacagagataaatccatccgtccatgttagaagggtacgattggaaaacagagaaagtagtcgcgccccctcttctcctcttcgctctttctcgtttcctccctccgtgcggcgccgctttctcacctaatctcttttctttcctcccctcggcgagcgcagccccgcccgtgcgaagcccgcttgagccgcgcgcaggctcgccccaaatctgcccgccccgcatccacgcccccgcctgtgcgctcgcttgctcgccccgcatttgccgcccgcggcgggggaaccagcgctccttcaccagcggcttcattcacgcccccaccgctgccgatttcttatctcatccagtgcccatccatctgcgcaaggagcgacggtgccgtgggtattttttgcccctatccccctggacagctcaagcagcatatgccccctaccggtttagggtttcctctcaggtatgtgattttcttgtggtataatttttttttggttggaaccaagagataggtagcagtttgtttgttgattttagatgatttctgagtattatgtgttttctttttacagaacttgtatgggtgatgaaatgggagacaattttataagcttagaagaacaagaggagtacagaacaatgactgccatgagatttaagacagagaaacaaggtttcctcttctataacaggtatgccaaagaaaaagggtttagtgtaaggaagaattac

SEQ ID NO: 31137 - DNA, 43089 bp, Oryza sativa
  unsure (1)..(43089): unsure at all n locations
agagtcgacctgcaggcatgcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcaaggctgggagagaaggcgctacccttatttaagcttctcaaaagctccgggccgtttacttggacagaggaagctgaacgtgccctcactcagttgaaggcgtatctcagctctcccccagttctggtcgccccagagccaaatgaatccttgctactctacttagcggcgaccccgcaagtggttagtgcggcgttggttgtggagcgcgatgaggacaatcctcattccgcgcacccccaccctgtgctggcttggcccgggagagagcagcgaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctaaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacgggcccgaggccactgtgggaaggccgcccctgtcgtcctccgaccccgaggtcgtcggcacagaagacaagtgcaccccgcgaggccgcttggacaaagagcgccccaaggatgtggcccctagcgaagaggatcggccccaccgaaaggtgcagcggcccatctactttgttagtgaggccctccgggacgccaagacccgataccctcaggcccagaagatgctttacgctattctgatggcttcgaggaaactgcgccattatttccaagcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtttgtaaggagtaccggtgctctgacccgcagatggacgcttacgtgtgccaagtacggcgtatggagcgccattttgacgggatagagcttcggcacgtgcccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgatgcccgtcggagtccaggcctcgggacccgaggggagcgctcccagctcccttagattgattgcttggatcgctgagatctaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggttgacctggtccggcgatgcagagcgtgtcaattccacgccaagcaaatccatcagccggcccagaccctgcagatcataccactttcatggccatttgctgtctgggggctcgatatcctgggaccgtttaggcgggccccgggcgggtttgagtatctgtatgtcgcaatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacaccaagccgagcaaccggggaaacgcctttcttcctcgtctatggcgcggaagcggttctcccatccgagctcaccctgaggtcccctcgggccaccatgtactgtgaggctgattaagatcagcttcgcagagatgacctcgactacctggaggagcgaaggcggcgcgcggccctccgagccgcgcgctaccagcagagcctgcggcgctaccatcagcgccacgtccgggctcgatcactctgcgtcgacgacctcgtcctacgccgcgtccaaacgcgtgctggattgagcaagctctcaccaatgtgggagggtccgtatcgagtgatcggtgtcccccggccgggctccgttcggctggccacgagcgacggcacagagctgcctaacccgtggaacatcgaacaccttcgtcgcttctacccctaagggggatcgggtgtcaggtttcgggctcgggccaacctcgcacccccctcgggcgtgcagggttggccgggggctaccacacatgcatattcttatttctcttatatctgtatctcaataaaagcatttttcgatttcttaaaggctgtatctgttctgttatttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagtcaagacacaaaaggaccgcggcacagacatcctcgtctcatacacacaacaaatataattgacacaaaaaatttcctctttatttgattgcagattaaattagtctatacaagaagggggcccgaaggcctcggaagaagaaaagaaaaaactatttaaagattggcgggggcctgggggctcactccgatgcacccgggtcgccagcctcgtcgccactgtcgcccacaccgccgtcatcgccctcctcgtcggagctgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcctggccatctccgagaggcgctgggcgaggcccccctggttggcggcgtacttcacagtccgcccgccccagagacccgcctgccgcccagcgcggtctaaacgggacacggcgtcgcgaagcatgctgggccctatctcgcctgccaggcgaagggcctcgacctccccggtggacgaatccagcgcgccctgcagatccgcgatggtgtgttcggtagctgcgaggcgggcggctaagtcgctgtcgcccgtggccgccccgccgctacgcgcccttgcatccagctcccttgcctgcgcctcgagttcagcggcccgctggttcagtgcggccctctcggcgcgggcactttccagattgcgacgcgcttgttcctcttgcacagcctcgcggagggataggttgtccgccagccgttgcgccgcggcctcggcctcctcgagagcttgctcccgctcggtgagcgcgtcctcgcggaggcggagcgcggactcttcttcggcacaggcggcttcgtgcaccgcagcgtgacctcccgaatagcaatggcggcctcgcggtctgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccatattgaaggcggagggtgtcctgcgcctcgttcatcatggtgatggcgatgagggcagccccccgctcctcctccacctccttggcgatctcccccagcaccttccgacgggcttcgagctctgtgacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcagaagttgtcgccgcctcggcctggcgaagtctggcctcctcctgagcggcttcttcagcttggcgagctcgggcggccacctgggcggcctcctcggcttcccgtaggcgatccgcggcttctcgccggtcagattcccgcctccgagcctctgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccataagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccatggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaattccagaacatccatgaagaaagaagaaaatggcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgtccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcatgacgccgggggctactgtcggtgacatgggaccgggagtatcgtgacttagagacttgaggcagaaacgatcacccacgtggcctagcctcctcgggggggatcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgctaggcttcatcctaaccattacaggcaagatattgtatgaagaagggcgaacatgtagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcaaccatacaagtctccgtctgtttatgaataaaataggataagtccccacaaaaaagagagagatggtgcatgtggtatccccttgaggtataaaaggaggaccttgcccacttagaaaagggggatttgaaaaaagaaaggaaaaaacgatcccagaacgatcgggggctggctcgcactttgtagcttcttcatacacagatccaccaaaacacaggagtagggtattacgcttctcagtggcccgaacctatatacgtcgcccgtgtcttgtgtgtttccactcttgcgaactttccataggctaggagcttagaacctcacccagggcccccggccgaaccggcaaagggaggcctgcgcggtctcccggtgaggagccccaagctccgtcaaggcctatctcggaagtgtctccctccatctccacgaattagcacttaaccctagctttattttcctctataaatagctttgtacatcctcaaaaatatttgggttttgtttagttgaattttgccaagtgccattcaccttgtctctagtcctcgctcgattagtcggcgactattgattcagagcccccaatagttggtgtgttgatttgccgggtcgattagatctaccattttaatcgcaactattcctctgtgcttaatcacccattcgcaatatttagattgtatcttatcttgttcttgcagtgttctctcgtttgcattgcaggaatcatcaaccgcgcgtcacggttggtacgacatcgtttgtggagtagcgattgcatggcgtcctggacttgttctggttggtagccacgtcgcaaacgtcgcactcgatcaaagcgagagttattccctcaccagaagatcgggccacgagagagagcgtcatcagttggtatcagatcctcaattgcctggtgaggattttagttttatagatttatttttcctacctatccatctacaaacttgccgcaccacttttccctttaccaaactataggtttgtgctttgcaaatttctttcagctttgtgtcgttgaattctagtccgtggtcgctctgaatcaacacaaatcggagttggcatgaaggcgctagatccgtttgaagtcagtgctgtctccggaggctgaactagacttggacttggaattatcattggagcgtgtgaagttatgagcgtatccgacaaagtgatgtcctcatcacacagagagcaatacatcataagatgactgacaacatatatgcacgtacaactctgtcatatatatatatgcagtagaagacactgactgacgaatacagcacataactgaataatgaacctgcatgccaggctaatggaggactaaacacacgaatacaacactggctagatcagtgctttgcttatgttattgctaggacaaggcgagacacaagatctgtttctattcttttttgaacgagagtacatctgctactactgaactggagtatatatacacgatacgagcagcaataatacaatacgagtcactgaactagaacactcagacttgtagataaataagattaagagattagctcaaagctcaaagcttatagtgggattgcagcgtaccgtccaacctcgagcgagcaatacaccctcgatcgatcgatcgatccatcggtgttagttatatagactgaacctgagaaggggcttgtttgggtttgggtggttggcaagctgctcctccacgtctttcacaaagtcgtccctgtactgcctctgcctaccactcagcatgaattccctgagattttcgagctcttctagccccgacgaaaatccaacgcgtgagccaatgaaatgactaaactgcagcagctcaagcttgggggttgcgcctcctccaaactgcactgattcgaggcggtcatgactacatatcctacttacctccaacaccctcaggctcgggaacaatactactgcggtggcctcctgctgctcctggcggaagttgagacagaccacatgatcgttgaacgaatgctcccacaggcgcaggatggccagccttggcagtgtcccgaggactttgatggcggcatcggcatcctccagttcggtccacatcagtctcagcttcacgagattctggagctttccgatccactgtggcagtttgcctagcgcaccctgcagcttgaggctctgcaagttctccggaggaggcgaggttgacgacgacgacgacgtgccatgtaggccttgacaccaacctgcacacaccgacaatgactctagctggctgagcttggagatggctgaatagaaggatggaccattcttcttgttgatgcccaccacgcctaacttacgcagctgggtgagtctctctatctcttgtataacagtgtttccccacgccaagtgcacgtgtcggagtgtatgcaggctttttagtttcctgctccctcgtggtagcatagggaaatcattatctaagtccatcatgagaacacggggctggatgcagcaattgtagttgcaagcatcacgcctgttgaagtctcccacgagacgaggtacgtagcatgcgcagcatgctccagtacaaagctctagacttctctctgctatactttgctgacccacaattccgattttaccagcgtggagatattttagcttccgaagcttcacgatggttttcggcagcatcgctataaacgtgcttctaatgtctagtgtctcaagttgcctcaagtcacacaacaaatctggcaggtgacaaatgttgtgacattctcttagagaaaggtaccttaggtgaacaagctttccaatgtgctcaaggtggtgatcaactagaccttcagtgtcttccaagtcgagcactcgtagcatcctcatcttttcagaaacgaaaaaaggtttccattttccaaacaccgttaatgaccttacacgggacaggtccactgtgttctcaaactcatgtttgtctccttcccaattactgcttatggcaagatgacgggctgtgccctgtgtctttgagctgcaacctttctccagcctaagtacaaggttttcctccattgactttgtgatgctgatttcacgcatgagatcatgtagctggcaatagtctattcctccctcaggtctacttgcgttttgagcaaccggtagtgtcatgctcctacttatgagctcaatgaagttgtcatgagctatttcgattggagatttgccacgtgcctccgttgtgtaaccctcagcagtccatcgctgcatcaaacgttttcggctaaccttgtggtcttcggggaagatggacagatacaagaaacatgacttgagtttgtatggtaaaccatcgtagcttttcagcaggactgtgctaatggtcttgagttctggattcatctcaagctcagcactaatatgctcatttatcttcctccacgccaaagcagtctttggttggtttgccaagaaaccacctatggtgactattgcaaggggaagtccattacacttcttcaagatcagattcgcttgttcaactaagtaaggatattgttcatccaaatttgtcttttccttgaatacctgaaagtgagacagtttgaagtcctttagtactgcatgccaaataaattaaattaattacttatgcacatatgcgtgtactaagttaatgaattcaaacgttttgacgaggacaattgccatttattttgtaaatgcacatatgttagctagagaatgaaaggctgcttctggaacagtgcatgacggggcaggattcttcaaacagaatctggacttttaatgaaaatacctccttaccttgcttgctttggagatggtggtattttcgaaataaaatcaatgcaggggaaataatgctatcaattgatggaatttttcaagatgtcaggttccatcttgctgaacaagagaggatgagaaagaagaagggaggtgatagacaggaaagagcgcaaagatggaacttgccaccagtcggattctacaaggtaaatgtggaggtggatgggtttttgttgctaggaatgacacaggggaattcctagaggcggggggctggtaatcttgaacatgctgctagcgcattagggcagtcccaaccctccatctaggatggtgtctatggcattaactacattgccatgtaggatttttagcttatgtggcactatattaattaagagagagagtgaagagagaaagaaactgggtctcatgcaagacacagcttcaacacaagaacctatgcactagacactatcaagttttgcattgggagagaataatgccttcataatagatgaagaataaatatgattggtagagaagagagatgatgtatttattaatggcccactttaagaaaccatgggttgtagagtgtagtttctattgtgatgtcttattgacatggcaccatagacactacttatggacaccatgggttgggacttcccttacaggggaagctatggcgatgatgaatagtttggactttggagaaagtggcgcaactcggtatggcaagaatcattgttgaaacagatgcgaccaacctgggacgagcaattacattgcatgcgttggactgcagcccctatggagctctgttcaagaagattagggcttttttaagtatttctttgatcagttcattgcatttgtttgccctagaacttgtaataaggcggctgattgtctggcctccttcatcgctgttgccgtggactctgtctcaccatgtttttggagccaaagccccggagtttgtagctggtttactctttggtgatttttctagagctactggttaattgaaggtgaactccttcgtgtaaaaaaagttagttaatgaattctctacacctcttccatgttttgtttccgttttgtggtgatctcttccaccttgttaacaaccgagggctgttgacatcacgtttggcttcgagacacatgactttcgatctcttaggtgttttttcttttcatcaatcaagttgtctaattaatttccattttctttagttaggttctctatcatatctatctatcatattacgaagatagctcgaaaaggagacacatgtttgctacagagactaaaaattctaaagaaaatgaaaaggattgagtctcctagtttttattacttaagttcttataatgggatctgatagaccttctcatataataaatagcctttggtgaagatcaataataaggcaaattcattataagtaagtctcctacaaattttgtctgatgcataacatcgatctttctgtccaacaagtcaacattcgaggaagatatatcaataaattaaggagatgggtattataaataaatatcatatggttccctttcttcgagaaattgcagctttgccacgtaattggatggtatccttcttcaactatgtcaaggatatcgccttttctcttttgacatatagttggagggataatctcatttgctaattttaccgaactgcccctttcttcctcagccagttgttcgcacaaccttgtgtgcattgctccctgctacttgcatggcaccattgctgctcgagctacatgagccaatgccacttcctgtttgttgtcactgattattattactacccatcatctctgcccccgctctctcgtaggtggggctaacaaggtcatcagaactagccttgagagagagagagagagagagagagagagagagagtcggaggaagaagagggtgaatatgtaactaactaaggtccataccctttgaaaataagtcaacattcttgaaatttacttatgactttgtcctaacaatgtgcccgtcaaatatggatatggtcttcatgttaggaggcacacatcggtatgggcgatacgtgatgtgcacaatcgatttaattttgtagtgtcacttttggattagataaaatcctatgattaagcgaaatcacttacttaaaatcaacaaaaggagaatctttcgagaatttaaaacaaccaaacttaagatttatgaagtaagaatgtgttcactttgttgcaatgttcaacttcagcattaacaacactgaaaaaggcaacatacaaaacacactattactaacacaagcctatcagatttatgggtctatttagttttgttgccatttttcaactttatcaaactttggtaatgccaaattatggtatcactaaattttggtagggtaaaagaaggttgggtagtgttttttggtagaattttgatggtataaagttgtggagttactaagatttggtagaattttgttggtaatagtgtgtttaatttgttggctttgtaatttcagaactttccaaactcaatattctaccaaaatttggtaaggccctaattataccaaacactacataattttaccaaattttttccaacaaagtgaacacaccctaaatattccattggcaaacgatcgaatggtcttcctgttaaaaataatcctcgaatagtctcaagtatcactttaactttctgattggtgttcatagttttgttcacatttgttttcgctaaccttggatacagtagatggtatatatatttgatttccatctttaatcccaaaacttgtggattacgggctttactaaaacttgtgcgtgtgtgtgcatattgccttttcaaccttatcaattttgacattactaatatttgcaaggaaacgaaccaacacaccattgtcatcgctaccctactggtaattttggaaccttttactctagaaaactctttacgaaaattttgtaaagcctcaaatcaaactccacctaatctttctatatcctaccaaaatttgggcattaccaaagttagaaaaggttgaaagtagcaaaaaaatgaaatacatggcctacaaacatttattatatgatatggttgcatcactatattatttgattatttccatagaaaaaggttctgcttacaaaatgtgcatgatgatatttaccaaagcaaagcatgctcagtaattgtgattaaaatgcagtaatatcaagcgaaacaattagcagcgcatggcataccatttcagtacctctttcgtgagtagatcatgtgcttgattattgtctagcccaccgagctcgtatatattatttatttcttttggatatgtaataacaactgaaattgttaatagcgcattgtagtagtgctatttcattcgtacctttttagtgaagagttggagtgcttgatcattttctattccgctgagcttgtatatatgtgcattagttgtttcttttgaacaatgcttagcaatattctcttcccttgtggtgactatgatgcagcttccagctttgttgggaaattgtgccaccatatcatcccattccttggtatcccatagatcatcgagaacaaccaaatagctctttctttctaagagttcggacaaatctctcttttcctcatttccaaactgcttagctaagctgtgaatgagttgcccagagttaaaagggcgcaatactgtaacacaagcacgtgcatcaaaataactgctaacatcttgacttcgatatatatcttggactagagcgggttttccaaggccacccattccccaaatagagatcacttgagattgttgactcacttggtttttaattagcttgataatgtcagatttttcttttgcacgaccgatgagctgagattcctccaaggttgataccatcgtctcagtgcgaccaagctttttattagctgtgagattgttgttaccattactcgtggttatgtttgagctagaacttggctccactaagagtgttccgtcttgagaaccctacacacaagtgagttgttaggtatatatatacccttcctttaccaaaaacaatatttttcttgtgtttaaagcttgtaaatttatttataaggccttttttggcaggccacaaatcttggcccatccctcatggaatcctggcccacccatggagaatgggatgggaatgaggcctgccaaataaggcctaaaatattttgactatgaaaaactaaataaataatgtttgtatggtttggatctcagaggaattacatatctggtgacaatattgctggatcaatgaaagaaatagctttaggtaggccagggatatgaacaaagccacaaaatttgcacactcaatgcattaaaaaaaacttccatagttgaagttattttgcaacatgatgataaatttcataattttttccatgatgcatatagtgacaacaagtttgtttagggtttttatctatctactctttccatcttaaaatatagctatatttaggatttttttagggattaactattaaggaaaagtggaaaatcgaatcggataatgttgtgaccagttgatatgagaaaacatgtggagaaagtagtcatattttaagataaattttgaatgctaaatgcattatatgttgggggccaagaagtatttatcaagacacatttatcaacatctaacaactctcaagtctataattttatttttgtatgacacaagtaatactctaaatctctaacttgaaaaataaaaggaataaatttcatagaaccacatatactttggttaaattatcacaaaactgcagatttaagataatgtataaaaaaactacagatttaacacaaaatttattggataactacaaatttaacatgaaatttatcacagaactataagtggagtatttatgtttatcaagtacgggattaccggtttgtctccttaataaagaattgaggaatatgaggtgaatcccctaggaaacaactagagtttttcagattcactggacagagaatagtatcctctcacactaggtcatatttttcttcctcgttaagcaagaaagaaaggagagttttcacaagaaagaactacgatcagttttggagggctatcttaccgaccatcacttctcctttgtatgtgctgaagacgcaagtagcccaatgacaggcatgtgttggaggacaacatgcataggtcttttggcaaaattgggggcttgttgatctgaccgtcaatggtggcgagaattttgcatttggcctcaactattatgcagtatgccccaaatcgacttccaccactccctaatcggattagggatggagcgatgattagggcagcggcgcagtgcaatttgaaagtggtggagtcgatatgagataatgtagcggaggagtctaaatgcaatattctcgctatagtggatggccactttagcgcccgagccatatcatgtgcactttgaactttgggtggtacattaaaccaagattttatatctaaatgtgtattttataagtttatgaaattagatgacaccttgatacaagtttaagagccaatcatacattttttttaaagaaaagatgatagaacatgggtaccagcatgtcaactatagtatgttgggccggatgaaagtggcgccgacgtgtgagacgacttctatgagactacgacggtaattgtagttaactgggaccaactaagtaatcagtatatcttgtatatttgctagtattctaggtttgaatgaaatttaactacattagaagttgagctagatgaataactagctaggttgtactgactaactagatgattttagtagtttaaaatttacctccccatttagtttcaaaaagaaaaaaaaggttaccttctcatagaaagcatagataatctgatcatcgagcaatttcttgtgctctgggggtacactgtcttgcggtacacatagtctggcaacttcaacatgctctgtgcacaatatgattcggctccctctatcattgcttgggaagcatatttttatcttattccactcttccagagaggataagtcagtaagcacaatcaagtaactcttctcattcagatatccctcaaatgcactcaccaaatcatcttcctccatgtttcccatcttctgtagaattcggtccactaaatcagttgcttccattttaaattccctagtctcttgaagagaattctcgtacaattgcctgctaatgctctgcagcaaccatgtttgattgcaaagactttttagcctgatccaagcgtagcactcaaacttcctcatcttgagatcatcataggcccttctgataatagatttatcatcgagaagaccattttttctccataccccgatcactctaagctccttgtcattggtgttgatcagtccaacaagatccattttagctttgtcctgttgccgccttgtttcttccaattcagacatggtcgttgcaccggcaatcctagactgcatgccatcagttgccttggaggcagaaccatcgatgaggcggtagcggttgttcctctggctgacatcctcaaccttggctcttagctccttcatcttctgagccacacgacgccgctcaagcagcattcttgggctgcacttgcgccaccaagatggcttcccgacacggacggccatgtcctggaggcagtcctcgacatcgtaggcgacatcacggacctgctgcacccaggccttgacaaccttgtgcttgtcacgctcctcgtccgcggccatgaggaaggcctgcatcatatggagctcgtccctgataaaggcatggtcccgcttgatgccgagctgcaggcccacctcctccgcgacagcggattgggcgtagccaagcgctccactcagcacggacttgccaaggctcagcaccgtcgactccatcaccaccctggctctctctccctctccacacactgtacacacccaactcttggttgatttgtgcagattctgtggttgaggaagttgcagcaggcagctagcgcaatgagagaccaacagagtgatgaacgactataaacatatgttgcagggaaagtaaaggcctttaatttagaagatgcccaccttgcttgctgcttttacgttgtgttcatccaggcaaagcaagagatcgtatgatactttagctagatatctttgcgtgctctcattctccaaggatagattctgattaaggacaacatacatgatgcattccctccccaagtaagatcatgaccctcctctgtactgtacattacttgcccccaaggtttgggattttttttgtccgagtatttcttcaagtttcttatacatgttacgatacggcaggcagacaaaattgcaggatcaagctgctttgttcttgcaattcgtcaggctttcagagaagttcattatctcacaaaagagaaggagctagtccgatcgatacatcggaggacgaataaagatagagcaaaaagctcaaggcacattctaattagatgccatctttccgaactattttaattatttgtcatctggatccgatccactggtttgttgctattttgccatttttgctatctacgcagcaaaccgtgtacaaaagacctcattgcctctgatctcgttcctcctatctgtcttcttccctggagctccatgtctccatgattcagcacaaataaacatgcaaagctcaagctcatggcatcaacagaggaaagaaacaagaaatgaaatacgggcaggcatattatctatacaaccaaatagtaccagcgtacgtaggctgcgtagaacaggatggatgatggatcatcataatcaaagctcaagctccagctctttttcttcttcatcatctctaattacatttgtgcagaaaccaaacttgattgttaggcggtaaactgctactccccctgttttatattataagtcgtttgactttttttcttagttaaaatattttcggtttgatcaaatttataaaaaaaatttagcaacatcattaaatttaatattgaatatattttaataatatgtttattttgtattaaaaatgttagtatattcttttacaaatttgatcaaacttagaaaagtttgaccaagaggtcaaacaactaaattggtgtgttcttacccaagtttccaacacatctcactcgttttccgcgcgcacgttttcaaactactaaacggtgcgtttttagcaaaaattttctatgcgaaagttgcttaaaaattatattgatctatgtttgaaaaaaatagctaatatttaattaatcacgtgctaatggaccatttcgttttccgtgctcactgtgctcgatgagaactagaaccagcgaacacacccttagagtagtctactactgctattagtagcacagagacagagacaaagtcacattacaaacgttacagctaagacaagaacaagaacagctactacaccacaagacaatattattagcttcggtgattcgatttccctgccatagcgccaggagaaaaaaaggggaaggaattgctgccccatcattgcctgattaatcttttcgttcttgatttgaaaccattagcacggggcgacggtgacagaggataccattagcacgatgcagtgcaaaggacatagatgatttgcattcattcggaactctgttgggagaggaaggcgttacacggttctagctcagattagagtactgcctcgaagcaaatcttaaccccatgactacaacctaacagaagagatgacactacattaagttccaacaatgtcttcatcacatgaggatcagaaaactgccatgttgggttctgacccggcaggttgtgaacactgtcatattctgaatgtgtgccgggggatgatgaacagaggacttgctgagaatacccaaggtggatgtctcctcctgactgtgtgccgaagcaagaggaggaggtaggaagtctttcccccatgaaggatggctggtatgcctagaaacacaggcaatgactaattatatatgatgaactcaaacaatcattttatttgaacggttcagttttatttttcaatatagaattgaatggctaattagttgcttgtggaacttttggacttcttagttaaataattttaaagtggtgaacatgatcaattagcttttaaacaagtatggttcacaaaacccccggtaaacagtgaaaaactcattcaaaaaccatactttgatgcaaatttcggtttccattttttttttggcaaaaaccagagcttatcacataaactgccaaaacaggggtagcgtattcagggagccatcgtttttttgtaaaccatgagtatggatgtgcagaacaagtggcaaaattactagtaagaacacataaattgcacaagtaatttcggtaaggtgatcggctacctgtttttatcatagaagttgcaagcgagacgctaggtagtacaccagtggacccaagggtcaagtaggcgtgtatggtcactgcaaattaaggcacattctaatttatctttctatatgacgatgagaaaatgcacacatgggtaagccaaatggaatactacaacatacctcaggacactatcgaggaacatcaagttacccagtagtatgtctaggacaggattgaagcatctctctgtggaggccaatagccttcgatattctcagtttagcctaaaaaacaagaagtctcattaaaaatatcaaaagtcaattaactagagaacaggtttgtgcatataccattcttaatatcaggtacagttacttatactttgatcgttttctccaatcatctggaggcaataagcatgtcgagaaagctttcaaagaaaaaggatcatgcttttcaaaggaatacggtccaattgccttcactttcttccttctaagatcaatagctaccatctttcccttacccaagctagccttagatctcatgtacacaacatcaccatcatccacacccagggttggagaagctaaattctctgcaagatttggacttaaccctgatatgtcaacagcatcaacctcacaacctttttcccaacagttggacgaaacatgccgactccatgacacaatcctccaaccatcctttctctgcagctgctggggtttcttgttcaaatctttgaggttatatgacactatcaggtcagtgtcgtaaagaacttgcattttgctgggatcacttggcttctcagttgttacgatcacacggtgttccatctcgacgaagctcatcacaccgtcgacgcacacgagatcacggaacgacttagccaaagttcctgggagaaactccttcaatctgtaccagttctgaggcagcggcgcgggtagaggaacgtagcgtaaaccggggacatcttcacgcaggtcgcaaaccatcacgccgtgatcgagatcaacccatcccagcacaccttccgcgatcgtgatcaccttggttgcaataaccttcctaacctccgggtacggatcgaccatcggaatgactctccagttagtgtccttggatgaatagatgtgcatcgaatacgaacacttcatcggtgaccgataatcgacgacgagagcagctagatcgaaatgtttaccaccatttgggacgataccgaactcctcgattaccggtagaggataaacatgaggaagtggaacctgctccagcgacgacgaccacgactcgccattgtcaccatagccatgtagcttatacatcaaatagtcgtatctctcgctgccgcgagggcttgcgagagcagtgaggaggatgaacgagccttctgctccgacaattttggcatcgagttcgtcgaagttgttgtacctagggtgggaggagtagtggcagtggaacgataggtaggagattgccggaggttgggagatccaggaagataccttgatggtgtggcctctgctggatgtgagggtggcgacggtgtcgtcgttcatggcgtcggtgatgaggacgttcgtgtccaggagaatcggctggcggcggtggccgttgatgtcgatcgattgacgggacgtcgacatcaagtcgccggccggagcgtcgtcggagtcgatggcgcggcgtcgactcgccggagaggaactcggtggatttgggatttagagttgggacttgtaattcagagcctactgtttttttttaaatctagtttttctggtaaatatataaggaaaatttcgttctacgtatacgtatcgcgaatcctgacatgcaattttttagggaattagggatgtgccgtgtccaacttccaaacagaataaagatccgtctccttttgtacgacggcctccaaaatattcgcgggccttttgccttcggcccggcccatatatcgcctcaaattcccccagccgatcgatcgccgactcgactcctcctcctcctcctcctcgtcggcggtgctgcggcgctgatctccacgatggcggagcggtcttcttcttcgtcggagtcgactggtaatggtaatgtcaatgtgaatctctctctctgtctctcgtaggttttgtagtgtgcccaagatgcgatggatcgtgctctcgttgattgttcgggatgcgtgattactggttcggttgttggtttatagggtttttgtttatgtgatctaggtgtaataaacccgcgaattagtgaaacgaaataagcccttcggtgtttgtttgattcggtttatttatgtttatgtagatctagccataaaaaaaaagaacttgtcagggcagatcataccatcatcacccacagctccttgtaaaggagtaaagaaactgaaattggaagtttatcatatcatgttagttttttttggttcatatcctcatcctgataagaaaaatatcaaccttgatttggtgttatagtagtagtttcttatgaccgacattatttttgtattttagaatttgtttatgtgattgtcagctgatgagctgataaaatcgaattgggaattatttggtgcgttggtcaaatccatcttcattcatagtagttgcgttctaatccactttgcaacctcaatttttcgcggaaaagatttattgcattgcagcttccctcatatattgtaagaagaaaaggtagaaaagaagcaaggaatcagttcttttattcagcttctttactagccagttttatgctttgttgtcaaagctggctacggtaccatgcgatgcatgtttctgatttgatcaattctcttgcagatgagaaaaaaagttcaaaaccacaaggatcatccaatgatcatcaagggtttctgccaggaggctctcctgcaaatacttttgattttgcttctttgcacagcttgctcaatgtatgaccccccctccaccaccattataataagtttgcactacatgctggattcccaattggtttctgttcacttgaactctaaatacattttgtggtttctgttcacttgaactcttcatacattttgtttgttacagttattttacatgatcctgccagctgcatacttgcgctttagattttatgaaccttcggtactcccttttcaattgcttcaagtctccaccaatgtttttcaggatccatctgtaaaggagatagcagatcagattgcaaaggaccctgcgttcacccagatggcggagcaggcactggaaggcgaaggagaacagggcatgcctgcaatagacccttacattgaaacaatgcaaaagttcatggaaagcccccatttttttacaatggcagagcgtcttggggatgctcttgtgaaggtaccatgtttgtttcctagtttgtccaaatatctcccgtgtgctcattttccttgtttaatttggctattgttgtcctaaatgctccacaattcaattgcatggtttaggatcctgcaatgtccagtctgctggaaaacttgactagtccaatgcataatgcaaagatagaagagcgtgtttctcgtatgaaggaagatccagccgtgaaatcaattatggatgagttagagactggtgatcctgctgcactgataaagtaggtcatgtttactactgatgatatgcgaatatgaccatatgtttatcacttattgatgtatcctgcttttgctcataataggtactggaatgacccagaaacatttcgaaagatcagccaggcaatggggcctttaggcggccctgattttgctgaaccttctggaactgaaggaactgaggaagaaggtgaatatgaagatgaatccattgtccatcacactgccagtgttggtgatgatgaggtaagggggccagagtgctaagtagtacagctaaggattttaaatttcaaatccctcaactaacggcaagaataatggacgaaatacatacatggtcagcatgtggggcaaaaaatcttgcgagaatagcgccttaacctctcatcctttgttgtaattttccttttttctgctctcctccccctgtctttccccttgtcaccattggtggtatttgtatagtgcttatcttctgaaatataaaaccagctaagctggctaaggtttcaaaaaaaaggattttaaattattattaatattactatttagtcttgagcttgagaagtgcatatgtttctatgtcttgttggtgtgtaatgtataatttacttgagaagtgtccattcgtgtgtgtgtgtggttatataatatcttcaattacagtaatctgcctctccgttttggttttgctctgaacaacatgtctaggttttcgcacaaattgtgatctcgatggccttttctgtttcattatcaattcagcttgcctttctttacaagtttaagtcatctaatagggtctgaagaaggctttagatggtggagcagacaaagacgaagaagattcagagggcagaagggccttacactttgcatgtgggtatggggaggtatgcaagtctgcttaactaaacccaatgacaattgaaacctgtgcaagtagaaaatgccgaataaatactactattatctactagtacctatttgttgttattgcaaatgactaggttagcaatgataaaaacatctcgttgcgaatcctgtgcaaaacggattgcatgtatgccttactagtcttcagaaaattgcatgtatgcaatgtgacagttcattgtgcaaacgagtgtatattgttgccatcagtatccccgatactaattgaagttcccctaatgtttttttttggtagcgagctatcgttgaattcagcttatttgggggctagttgtctttttgcattctatgatgagttttgacaaatttattgatttatcttttttttttgcttttaacacacgtttcaagatttttttggtactccctccatcccagaatataagcattttggacatatgcaatgaatctggacatatgtacatctagattcatagctagaagttgttatattttgggacggaggtagtagatggaaaggtgcagagcttgctgttttactttgttagttttttgggggcagttcattgatgataatccagacctcacaggtcaatccacagtaacctgtccattgaacattgcacaaacttgccagatcaatgtgcacctctcacctagctataatagtatcgaactatgagtttccataaccctgctgtttgtataattgcatttggtgtgcaatgctagagcacaaaagttaatgaatgacaaactaccttttgattcattgtcttgtggatctagaatgtggtgtgagactttttttggggaactgcatctgctccttacttgttcactgactaatcaggatttggggtcaaacttttattttttcagttgaagtgtgcccaagtacttcttgaggcgggtgctgcagtggatgctttggacaagaacaagaacactccgctgcattacgccgctggctatggtatgaaggggtgcgtggatcttctgctgaagaacggagccgctgtgtaagttaaacctgctcgctttgctagctgcgatcacatcttttttttttttttgcattctttgactgtctcgaattgcatatcgcagcaccctcgaaaacatggatggcaagacggccattgacgttgcgaagctcaacaaccaggacgaggttctcaggttgctggaaaaggatgccttcctgtagatcgcctttgttattctcatgggcgcatgaacagtttggctccaggatcatcattctttaatttctttggtgccgccattcatatttctttgcaacccagtggcagttcataagatacggtgaaggggctgccacacaactgctgtggttcacgatgacttgcgtaccccagctttgtttctcttgttttcattagtgcaatcgagattgtgtatccacattttttttttcaatattgcgcatatattaaagatgatatatatgtcttttccttttatgtgaaatcatttatggtttatgtttatgttatttctcaaagagacggcacggctaaaccagtcagtatttttggaaggatatttagacccaaatataggttggatcttaatcgtatcccttaaccgtaaaaccgatataatcattccttcaactattaaaactgtgtaaaatgacagtgttgactagtggttgtcattgacatgacacacacttggtactctattcatcacaaaaatttaaaaagcgtttaaaaaaaatacagtgagaccccgcggcagcagggtggcacttgggccttgccgtgtcgccgtcgctggagcttcccagaagaatatggaatttggctggatcggctagctagatttttttttaataatggattaaaccggtttctacatttaaacggatatacacggcccctaatgcagagcccctgcgttgtgattgtccggtgcgcgagcaagcgttatccgccgtgcgcgctcgccggtgtgtgctctgaagaagttacctgtcgttgtgcaaattgcaacttgccgtcgatgcttccattcctcgcttgagtcgcaacacactgggatgatgatcgctatttaccacactctcttgacatgtacaggtttatctggactctggaaagctcgggctggaaaaaaaaatgaaatgggtggatgctgaccttctctcgatgaatgcggaaaagatcaatctcttccagccttatatttttcacttatacttataagccgaaatctgaatttttaacttcaaatttagagttgattttgaggttttttttaatcatagtttattttagatggctaagaacacacatataaaaattttattcacaaattaattttcgtttgcaactatatcgtttggtggccccattctttttttttaccgattcatacattgcatccagctactttccacctcccggtcgattgttgggttgttcaccatgtgcgtcgctaacacggccacctctcgatcgttgttaccaacaaagaagagcgtcgccaccctggtgccaccgagaaggcaatagagacatatagaggagatagggaagaaagatgagggagaggataacaagtaggtctcactttttttttataattcggtgatactgaagctaccacatcagcaaaaagacacattcaacaccacatcagtaaaaagacacattcaacacaatcgtggttggaagttcgcaccaaattgtcacctttgttctgaggatggagagtcctaccaacacattttccaggcttgcaccttctcgcaacaggtttgggtgcaggttcaggctcgtttgagcctctccttcttgccgccgtcctcggattttgccagttggtggctcgctgcccggcaatctattgcgaagatcgatcacaagacgttcgacaccggagtcattctcgttacgtggttgatttggaaatggcgcaacgcacgggttttcgagggaacggcctcgtcagtcacgcaactgtgtgcggccatgtgtgatgaatgggaaacttggaaatcagcagggctagttagctcgttgagtgttgccgtagcgccagctttagagagattacaacctttgtaatttgcttattgttgtaaaggcggtgttctgacgcacacattagtgccccttcccagagggtttgtgcagttttctcctttttttaatatatacatcggtcggtattcttcgccatcccggccaaaaaaaaaaattcatacttttttttttccttttggaagcgcttcgatcacaggtacacagcccattcattgttccatggcccaacaaacgtacacacacacctgtggcgacagaatggagagaaagcaagatcggttggggaacggcgggcgtgcggcggcgcggcggcgtggcgggcgcccgccgcccgttcgagagtgcagcattgccacgatgggcggaaaagggtgtgggggcaggcgccggcgccggcggcggtgggttcagcggcagtgcctgcgggtgaccggtttctttccgccgtttcgcctccaaactgtcaccaaatctttcgtctgcgcatgaacttcttctgaaattttgctggtatttccttttgaactctgctgaggcccccaaatagtttcagcagttgtcaaatttaagattcacatgatgtgtcctcagttaggtttatcagtttttgacctctagctcttaatttgtgtactaaatctccttatgggaggggatcgttttaaatctagagaaacgtccagcgatcttccggctagctccacaaggtggtgggctagtcggcctggtttcgaagcctcaccctctctatttatttgatattaggtttttccctagtattctcattttttgataatgatacctaaatgtggttgcatccgcgatcctatcactagctatcaactatgtatcttgaagagccccagatgttcgttcaattccagttccagcggtccagccattcccagcgcaatttggtgaagcaatttggttatggtggatgtaagtgaggtgtatttagtggtgaagctagcaattttgattgggcgaggagctcgatttgagggaaactgacgcatcagatttggagactagcaatggagtatgtgaaacaggtgggaagaatccaagtacaccacaaatggtgaatatgagggctgggctgatggagatgtagcgtgtagagcttgctttggcgccgatggcttcgccgtcaaccctgctctcctgcagctggtattgcaaatagctagcaaagtgacaacgaagaaatgagaagctgcagctgcatgatgattcaaatggctaataagctcaattttggatcaatggataagaaccaggtggcccccaccatcttggcatgtttgtccctgagctgaagctcctcattttaataccccgttggtttctgctcaagtcccctgcattggtggcagaagcagacccatccacacaatcaaagaagaagagtcagaagaagagaggtgagctggccagcaatggaggcgacggcggtgagcgtgggcaagtcggtgctcggtggagcacttagctatgcccaaaccgcgatcgcggaagagggagctttgaagctgggcgtccagcgcgaccaaagtttcatcagggatgagcttgagatgatgcagtctttcctgctggctgcggacaaagagcatgatggacatcatcacgaggtcatcaggacctgggtgaagcaagtacgtgacgtggcctacgacgtggaagactgcctccaagactacgctgcccggttgaagaaaccaccctggtggagcctcccttgcacagtacaccgggagaggcgtcgcatcgggaacgagatgaaggagctgagagccaaggttgaggatgtcagccagagaaacatgcgttaccatggtgtgtctgcagctgccccacagtcttcttctgttactgctgctgagctgctgcaatccactgccgccatcgacgacattgatgaggctagacgtgccgccaagcaacaagaaaaggtggacctcgtgaagctcatcaccaacgacggacaaggtggacttagagtgattgctgtgctggaaacaagaagtggacctgctgggacagtgcccgttgttcgagctgcctaccaaaagctcaaaggagagtttgaatgccacgcctgggtaaggctgatgcactcctttgatgcaaaccaattcattgggagcttggtgaggcagttcaaagcgaactctcgcgagggtactggcaagacaccacaaggaacaccttctggggtgtctgttctgaatgagatggaagcacaagattataatctgcttcatgactttactggatatgtgaccaacaagaaatacttggttgtgcttaatggcctgtctacaatagaagagtgggactggataaaaacttatcttccaaacaatcataacgggagccgagtcctagtgtgcacacagcaagctgaagttgcaagctgttgtacttgtaccgatgataagtacaaggtgtctgagattcaacacgaagggtcattttccaaacctctttatgtcttctacaaggaggtaatggttatatatccaacccggcacgttgatgcagaaaaattgcatgataaaatagtatacataattttccttttatttcaggtagggatacaagaattttttgatgaaactacgaataccatcactcattcacattgtttgtataggaaacaaaattcttaaatgcagtaacaacataattcaccgtgtcccaaacattacatttcaatatgactctgataaatgacttgatattcaggagtaagttcatcctattaaggcacctttctttagataatgatattaaagccacctactagcataagaggtcttttccttatcagataaagcatgtttgttgtcattgattgaccaatcttcactgaatagttggagtacaatcaaacaaccattttttgtttctcagttatagtgcattcaccaactaaagaaaaaaaaactttgaacaaacaattatccaggtcaatcaatgtaatgcttcaaaatccattcaactaaatgtacttaattttggaggtagttaactattgtctaatggcattttcttttttaggtggtctctcagccagttaattcagattccactaagatgaaatcagagaccaggtccagcatggagggtgcctctactactagtgacagcaaaacagtaccttctgatggcgtgatacaggaggatggcccgaaggacctgcctgaaagcagtttaccccctcacctcaacagagattccaacactgtgtctgtgaaggaactttctcgcagcacgacacagctcattggtagaggaaaagaaaaggatgacgtcatcaaactgctttctgattgtaatccgatccgtcaagtgatttcggtgtggggaatgggtggcattgggaaaaccactctcgtcaaaagcatctatcagagctccgagcttgagaagcttgggtttgagaggcgtgcttgggtaactgtattgcgtcctttccagcttactgagctccttaggagcttagctcagcggttggttaaagattcccctggaaagaaggtagaatctataccaggacttgcaaggagtggtttaagcacgatgggatctgaagaattaattgacaagttgaagcaagatttaactgggaagaagtacctcattgtccttgatgacctatcgactactactgagtgggattcaataataagaaacttgcctataaccaacaatggtagccggatcatactgactacaagatttaaacttgttgcgcaacattgttccaagaaagaaatgaacatgcacaatattgaaggtctaacagacggagatgctcttgagctattcttaactaaggtaaatgctcccacatttttttttgactaaatcactgttgtgtgtgtgtggggggggggggggggaagagcttccccacctgaattttgtcattgccataaattaggaggtttacacatagagttacaatgaatttagatttcgaagggggaagagaatatttccttccacatggagattacagttttatcttcagtttttaagatttcagaccatattgccgcttcactgacgcaccgtcttaagcacaattgtatcgacggtgcactccttctgaaaaccacatcgtgtctatggttccacaaagcccagaaacataggaggtagaaaactctgaaatgaggcatcggaattttctgcactggctttagttcgtgcaatcttgccacctcctgaactgtaggtgtaacctgaatcttttcccaaaaactttgagcgaaagggcagaggataaatgctcccacatacatagtactagcttgtttttgcccactatgctatatccttcatagatgttagtttcaaatttttatatttgaaatatatccttcgggctcgatgtagtcgtacaaaccgtctcctcctggcgcggagatttcactcgctccgactacaggaccaacgtcggcgttttctatttatgctacaatcattaccacaataaataacagaaaaacaaagataaccaaaacaaatagtatcataacgtgcaacaatggatgaaaaggattaaagaaataattttagagatttttcgaattttgacaaatggcgaaccctaggccaaaattagggtttcgtcaacgggtgctcagattgcaatgaaactggcacatatgggtttggaataaatctaggagtttggagtaggtctcggattttgatggccaacttgataggaaaagaaaaagggaattttctgatttatttttcaattggaaaatccggtttttctcttcttctctctctctacacagaagccggccgaaatcctcacgacgccggcggtggaggactcggttttggacaagggggcgccggttttgtgatctaggggtcaaggtgattctgttcccgcggtcggcggcgaggctggcggcagcggccagagacaggaggcggaggcagccatggcagcggcggttccagtgatctccagcgagggcgacgggcttggtgagcatcagtgaggcgaggagagtccaaggggggcggcagctcgagctagcgcggctgggagcggtggcgcgccatgcggccggcggcagccgaatagagtagcagcgtcggtggcgttccggcgacagattggattggaaaagagaggggaaagggactactcggcatggagaatttgttttaccttcaatttcagaggattagcaatgtgtgcgacgaattttagagctctgtgaatgacgccgaagtaggggttttggggatttttccctccggaggttggggcggatttgagagggtggaagaggtcgaagttgcggttcttttgcctccggtattgagatttctagtggaaggacgaaagagatatgatggcgggaagctggagatgttgcggcggcatttgtccgtcggtcgtcctcgtgcaagcgtgtgtgagcgtttggcgtgcttggtgcaagcatgagcaagcgtggtgcgaggcagcacggctggctcggccaggtcgagtagagaaaagaaaagaaaccagagaaagggaaggagaaagaagaaaatagaaaaggaaaaaaaataaatagatggaaaaagagaattaaggtaaaagtagagaaggaaaatatggagaaaaattaaaatggataggatttgaattagtgtgaaatttaggtggttcgactttcgggataaaattaaattggatcaaaggaattatttgaaggatgatatgaactttgtgacaattaaacaagaaagaaacatcgaaaataaacattgaaaataataatttaaataaactactaactcgacggttatatttttagagaatcaaagcaaactaaatcggttttaaaaaattatcaaattttagggctgttacataaattctagaagtagaagttaatttggtatacaactcttagtttttgtttccataaatataattatattatttttgtggttgagatataattatattatgtatgcagctatatcaatcaatctacactgctatgatctaatattaccatgatctaacaatcaatatctttttcttcaattattgtaagaatctgcaaacctccaaaacaactttcaggttttttaagctatatttataaaaaaggtagttaaattgtcttctcttgttgtaatgcatgagcatcttgctagttaataatataatcaatagtcctagacacatacaaattccaacttcctccattccaaaatataaggcacaaccactcttaacccaaaaaccaagaaacaattattatcacctcctagttttgatcaccataataaatataatgcatgcacccaatagaattagagatcttgaagggggaggatttaaatgataataatttagtggagaggaggtgctagttaattacatgcatgcatgccttgcattgtattatgaaacatctaaaaaaaactagttatgccttatattatggaattgagggagtattagttaaacctaaattttgtaattgttaaatcttgaagaaattaaaattgagatcgcaaacagagtactactttatattggagtgcacaccagctgcaacttgctaattattaaattataattttaataattggtaaattgagaaaacaatatattaggattctataacaagtacaattcattacttattaattgcaaatgtcagagattttaaatcataaaaaaaactataattgagactcctaaccatgtataactttgtatatacttattaatctcgtatctcaaaaatgttgaattgagacattccaataaatagaataaagtattagagtgaatccttgatacaattctgtaagtactaatgcaaggtttttgaagtattaataaaagagaattagtttacctgcatacaaactatgtaatataaatagtccatgtgaatgcacatgttaccgactagttttaaataactgattgccatgtctatgtcatccatgtgtatacatccttgtgaggtagattgatttgttatgtatcatgtcgattttcgccttttacatttttttcccttttaaaattaatgaaacaaaattttcagacaactaagattttcaaattttccattgggattttattattagaaaaaactagagcacacttccttgtgagtgagacagaaatctttagatatttcaagtatttagcttgttaagtgacatttgctgtaggtacgcatggatggtgatgaatcagaattgaaacctgacttgaaggaggaagcaaaaattatcatcaagaagtgtggccgacttccccttgcagtcgctacagtgggtgggtccttgtctgccaaacctcgaaatatcatagaatggagggagtttagtgatcgcatcagtgaagaatttgataacaacccacgtcttgagatgataaagaaaatacttgcatcaagctatgagggtttaacttaccacttgaaatcttgctttctatatatgtcgattgttccctgaagactctgacatcagatatagacgattattgaagcgatggactgcatagggttactcaagagcaacgagaaacagggggcacgagaaagtggcagaagaacagttcacagctcttctcaacaagagtatgatccaacaatcaaaaacgattgccagtgggaagacaggtttctgccaagtctataatctcatgcatgaaatcatcatttcaaagtctgaagaagaaaaccttgttcttgttctagatgaccacatcacctcgcgctctaaagataaagtacgccaccttgttgtgagcaagagctggagcagagaaaagaacgatatgcaaaatatagtggatgtgtcccacatacgatctctgacagtctttggggagtggaaatcatttttcctttctaagaagatgaggatgcttcgagtgcttgatttagaagatgcagaaggtcttcaggatcctgaccttgtgccaattggaaagcttcatcatttaaagtacttgtctctacgaggatcttttggagtcttcaatcttccaaattcctttggtaacctgttgaacctggagacactagatatcaggggaacatgggttacaaagttgccagcaaccattggtaggctccaaaacctgaaatacgtccatgccggatctttagatgatgaggatgatcagccgataattaaactactgcatcagttcagatcaatccgagaagagatgggaaccaggttcgctgtatcatatatcatgttgttcatcaccgcttggttaagaaacctggatgtatgtggtgttaaagtgccaagagggattggacggttgaggtccattcacacactgagcatcgtgaacattgcacggggaaaggccttgctcaaaaacctcaaaaagctaacccaactgtgtaaactaggtgtgactggcatcaacaagaataactgcaaagagctctgttctgccattgccgaccatggccgcttgcagtccttattactgcgggcagagggtaatgctgggttagaaggttgtttggataacatgtcccagcctcctaaagaccttaagagcctccagttgtacggcaatctggtgactttaccagaatggattaaggatcttaaaattctacaaaagctgagccttcgcaacaccaatctgaaggcagatactaccatggaagtgcttggaaacctaccaatgctagccattcttcgtctccaggacaatgcgtgtgaggaggaagaactctgtttcggtcccgagcgtttcacaggtctgacgtcattggagcttctcaattgggagagcctcaagtcggtgaaatttgaacgaggagctactcctaaactgaaggtgctactgctgcactactgttggcaaatacacaatggtgggttttctggcatagaaactctctcgaccctaaaggaagtttcaatcttgggctataattatgaccagacctacaccgaattcaaggaacaattacagaagcaacttgacatgaacaagaacaaaccaaatctaagtattctgtagtccaaaactgccactggctttcatagaattgctccctccacactcaaatatgtggcattgggtcattcaggtagtgtttcaaatttcaaaatcatgtataattatgacaatttcaacattaagttttactcccttttttctcctcatgtaccatacgctttaagtaattaagtgtataagtttagtttagtttcatggtgaaaattgtagtacctttaccatttacttccagtggcaaagacaacagaaaacacaaagtggttcatctatttatcgtaaaattatcagtgtttatattgtataaaataatactccctctgttttttaatatataacgacattgactttttaataaacatttgatcatttgtcttatttaatttttctttttttgcaaacatgaaaaaaatacaaatcatgcttaaaaaactttcaatgataaatcaaatcacaagaaaaaaaatgataattatataaatttttttaataagataaatgatcaaacgtataaaaaaaatcaacggcatcatatattaaaaaacggagatagtaaaaggtaaggaaagcttgagggcctgtttggttctcagttcggctccttcagtccatcgtttgatctcttctactacccatctgctcaatcaatggctgcctgtccaccctcactcttcgccctaaacctgatgttaatttcattaacaactacatacttcgtacttccctgtagcctgtaagtacgtgtactcgcgcacacggttaaccacgatcccttgttagagatcgaaccgctgccgagtttcacgccggattctgcattccggcctcttcatcacctgctttgccctgctcgtcactagctcctctgcctccttgtagctcctgcgtgcatcagagctctctcagtttcaagcgaaatggcaaaagattacagaaccatgtacgcatgtcaggatgcagcaattgacagcttaaaggcagcatatatacttgtatgagtatatgaggaggccaggccgccgtgccggcgaagccgacgaagtagatccagtccacctggccaagagcaaaaaatgacggctttgatcagtgcagttcagtccaagaatcgatcagcttgtgtagtgaaaggaatgtgcagagtgcagaccttctcatggtacggaaagatggggatgagaactgcccacatgtctgaagtgagtagtaggggggaaaggttcagcatggttgcccccacatagctgcaacaggcaacgaaatgataagcaattgaacaaaaagcgtgttcattgacatcatttttggatcatgcacttacgaagttccgatctctgaagttagaaatttcataagtaaaaagcagaacaaatgtgtcggcgttgtcagtgcgtgatttgtgtgttttcttcttcttccttttttttttctgattatagcttttatgaagcatctgaaatattacaaataggcatgccatgaaaattaatggtccaaatcatttcgatacttgttgaagttttcttcttgtgtcttttctttttttacaagagatacttgatgaagttcgatgctattttttttcatgcaagaaagtgaagaagagggccttggcttcaacttacaaagcattttatgaaaacactctgtgtgatcacccaactgaaccattccacctcatttcctctccctctgaccagatctggccctgccgccgccagagctggccggtggtctacgcggcggctaggatggcggcgacgggaggttggaggtagcggccagaggaagccaggcacacgtctggccacgcggcttggttacggcaggaggtggtcaggagggtggtgggtattggcgaggcgttggtgacggagctccttcggacgacagtggggccggcagaggacggtggcggcctgagcgtcgatggccgctctgcggcaagaagaagttggttcaggcggtgtagcgcccgttctgtcgtggcgcctagtgggaaaaatcctaaatgcgaaaattatttctttgtttattgtccagtgtccgtgccattccagatctcaaatccccaatccatcgtcgaatccaaaccctaatctcaatctgtcccgaatcaaatcgtctcgtaaaagtctattttgcctccctcgaactcatgggacgatctcttctcccccggccctttccctctcagcctatctctccctcctcctccatccttgcccgcacgtgcgaggcacgtgcgcagctcgggcgctgagcaagagagagagctcgctctctctttctcttctccctccctctctgctctcgctactgcttcccgccgacgccgctcaaatcgccgcgccacccgttgcttcttgcgcgcgcgtgccgccgtcagcgcctgccgcgcctgaccccgcgcctgccgccctgtagccgtgcccttccaaaccgcccccgccgtcatcgccgtcgtcacgacccggccccgccaccaccgcgcatgcttccaagggttggaggcagagctcctcctcccactgcctcatcgccctctctccccttcattcttttcccaaagagccaagaggcaagtctcctttccctctttcttgtcttctttttctccnccgcgggcatcatcctccctgtcgccgttttggccgctagccggagcgccagctcgctggcttgaccgcccaatgtcggttcctccctcccaaactgacattgtcgcccctataaatccgagcccctttcctcattccaaactcccttgttttcgccttccgcctccaccgcgccatagtcgctccgccctgcttgcacatctgtcgttcgtcgccaaagcaccgggagagccggtgcgtccgaagcacgcgtgaaggggactccgggcgctcgtcttttcctcttccccggcccgaggccggagagatcactcccgtgctgtcggcctctcgtcacagcgccccgcctcgtctcggtagagcatgccccgttctccctcctcgctctctctcctcctcttagatttgtcggtagcgatcttagcactccctgtagccgccgcccgagtccggtaaccgccgctcgtcgccagccgctctcggggtagctccgcccaatccagtgctaggaatgcaatcccgtagccgcgtagatgctctcgctgccaagaatcggcccctcgtggtctcgtcgcccttcccctcttttgccgccgccggtgtgcgccgccgcgattcatcgccgtcgagccatctccggtgcatccgagccgaaggctcgatccctctcgttcttgtaatcacaccggtgcatctccccttggccgaagatgtcccgacgagctccggtgagcaccgccgtcgcccgccgtccgttcccggccggcctcccttcgtcctcctccagccggcccacgtggcagccacgaaggcgccacgtcggcgccagctcggccgcgggctaggactgtttgacctcggagaagccgctcctccgatctgtctcccgtgcgcgcgtggtccacggagagccagctggctgcgcgtgggcccgccgtctcccagtccacccggtgcaccatctgtgagccgcatccgcaaaccctagctcccccgcgccgcataaaccctctctcccgtgcaccgagtcactgactcgtgggcctaccccgggaccccgcacgatggatccggctcatccggatctctctctctccctctctctctcccccgcctccctctgttgcgccaccttctgaggccgcgccggcccaaccaattggccgagccgcgccaactcctcttgggccacgctctagccacccatgaagtctaaatcccctccttctttcgttgctaattcaaaaaggatgttaataaatcctttttctttagtccaataaatcctctaatcttagaaattccatatctcatcaaccatgtatccttttgactccgttcaacttccaaaatctctcaaatctcgagatctatctaatggcacgcttagaggtcaataataggactttaatttcgccgtttgttgagtcgtctcgttcgcgtgtagcttcggagcccgaagacccggagtgcgcggatttcgaggatcaagctcaagaactcgagcaaggcaagtcacctttgatcatcttgcacctatactttaaacctaagtatttcttttccgcaaataatgcatggataggattaacacaagtaatttggccgcggcttgcgagatagcctaccggccccaatcctaattgttgcaattaccctccttgaattattgtacacttaaacctcctttgtcaactattgtacttcgatgtacgggccttcgggcacgcacgtcggagtcctcccctcaaatttcaaatatccaacgatgggtaaaacctgggttttacaaaggtcttggaaaaacccgacacctgggtcggttcttacgaactaaatgaatttctaaaaatcgcagaccgggggacgtgccgggagcacggtttcccgctcttgcacttaaggaccgattcctttggaatttcatccgtacatataacaagtacgaccacatgggtggaatgggacacccctggctgagtaattagctaatcaggggagccttgatgccaggagacaagtggattcgccagggtggtgtcggggaggacccctgggcttcctggcacagtatggtctgggacctaacctgttgttggtctgggacccctctcgtcggcatatggtaaatgtagcgcccgttccgtcgtggcgcctagcgggaaaattatctcttaaaaaccctaattgcgaaatttgtttctttgcttgttgtctagtgcccgtgccatctcaagatctcaatccgcgatcgatcgtcgagaacaattccgaatccaattccttccaaatcgaatcccaccacaaaagtctagtttgcctcccccgggttcgatgggccgaattccgctcgacccatctcttccccggcccccctctcttccgggcgctctctccctctctctctctctctctctctctctcgc

SEQ ID NO: 31138 - DNA, 16857 bp, Oryza sativa
  unsure (1)..(16857): unsure at all n locations
ccgttgcttcccgcgcgcgcgtgccgagtgaccgaccgcctggtcgccgccgccgtcaccctctgccgcgccagcccgcgcctgtcgcccgtgtcgacgcgccgctccaaaccatcccaccgtcatcgccgtcgtcatcccccggcccccgccactccgcgcgcaagccgccaagaggcggaggccgagctctcccttccctctgccgcgtcgccccgctccctcctccttttcccgattcggcaaaggggcaagcccctttctctccttccttttcccctttccttcctttttcccctctcgccggtgtcacctcctgtcgccgctttggacgctagccggagcgccagctcgctggcttgaccgcccatgtcggttcccctctctcaaaccgacattgccgcccatttaaacccgtcttccccctcccttcctttcctctcccattcgcctcctcaccgttgccgccgctcccgtgctctgcctcgcctccgccgtccatcgccaagcgccgggagagccggtgcgttcgtggacgtggaaggggactccgggcgcgccctcttcttcctcttcctcagcccgaggccagagagattactcccgcgccgctggccttgcgtcacagcgcccctcctcttctcggtgatgtctctctccgttcttcctcctcgctccatctcctccccctagccttcggtagtagcttgagtagcctccccgtagttagccggcgccggcctgaccggtgccgtcgctcgccgtgtgttcgccaccgtcgccgcccgagctccgtagcacccgctcgtcgccggcctcgctcggcgtagttccgcccaatccgacgctagcgtcgagttcccgaagccgagtagatgctctcaccgncgggaatcgacctctcgtgacctcgtcgccgtttccttcttctnccgccgncggttgccaccgncgcaatccgncgncgtcgagcaacctncgcgaatccgagccgtggcntcgttncccctgtcacgtgcaaccgggggtgtgcacgcttttgcctgtatcgccgtggttcgctccgccgctgggggcgttgtcccgcgttcattcgaggccgggtcgtcgtctacctcccgccggcccgcgtggcagccacgtaggcgccacgtcggcgccagctcagccagaccgggtcgggccgaccccggtcggtccctccgcgtgcgcgtgatccaccgcgagccgtgaggctgcacgtgggcccgccgcacctgcgtccaccgcggaccacgcgcatgcaccgcgtcccgaccccgcccgcgcgcgtgcgtcgcatgctccctccgcacggtgagccgagccgctgacaagcgggtcccacccgggaccgcgcgtggtgagcccggtccaccggctctctctctcctccctcccgcacgcgcgcgagtttgggccgtcttgggccggccggcccacttagctcggccggaccgctccatttctcttgggctgcgccctaaccgtccgagaaaagtctatattccctccctcccttcttttctttttccttttcaaaaaggatttaaataaatctttttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattctcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatgttatgcattgataggatcacacttaatctgttgtcccgcctgcaaggcagattggcagacctacctgattcgttgcatttgatccttcctttgttaattgttataccatgtccccttgtaaccacccagttgcacctcgatattcgtgcactctgtgcgagtatcgacggtcgccttcaaatttaaaatctgagtaacaacttgggtaaaactggagttttacaaaagacttggaaaaaaaccgacatctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgacccgggttggtaatgtcgtgtgggtaaagtgtaccccctctgcagaggtcattgaactgttcgaacagccgtgcccacggtcaagggcggatgtgaggtgattcctagcgtagttttgtttgactactgtttgtgaaattgctgttgtgaaactgggttcgatgtttgaaaaatcagcagctgacgggatcagctaggccgggtggccgtttgaaaagttgttggcccgggtggccgtttgaaaagctgttggccgggtgccaaccctgtttcaagatctaaagactgatacattgcacatactccgaccggacgagacgcactgtcccatccgtgtcgtttgagaagcactcacttagactttttagaaaagagttcaaacaaaatcaattacggaaacaacagcctttccctgaagcctgcattaaacacttattttcccctggcttgctgagtactcccgtactcacccttgctctatataaataattccccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagtaaacctgtgtcggctctcgaaatgccttgtcatgaaagcctcaaggtcaccagacgtggctgttctgcacgggctgggtgatccgggttagtaatgtcgtgtgggtaaagtgtaccccctctgcagaggttatcaaactgttcgaacagccgtgcccacggtcatgggcggatgtgaggtgattccttagcgtagttttgtttgactactgctttgtgaaattgctgttgtggaattgggttcgatgtttggaacatctgtggctgacgggatcagctaggcccgggtggccgtttgaaagttgtggtcgggtgccaatcttgaatcaatcaaagactgatacaatgcacatactccgaccggacgagatgcactgtctcatccgtgtcgtttgagaagcactcacttagttgttttaaaaaggagtttaactaaaaatcaattgtaaaaacaatagccttccctttgaagccttcattaaacacgtaattcccatgacttgctgagtactcctgtactcacccttgctctatataaataatcccccctcagttgctgaagaagatgagatggatcccgctgacgaggagttcttccaggagcaagtcggttatgaagagttttagggtttcgatctagtttccatgtcgcgcctgtgatgaatggtccaagtcttggcttccgctttcctcttttgtaatgcagttgtgagctcggggtctgtccgcagcccaacatgactgtaatcctactctataataaagagacctctgttgctgtgatattctgtcttcctatgataccagcactgtttcctgggactggtatcggttaacaggttaatttggagcgtcacgggttggatccgttcggagctagttcagggcgtgataggcggtgacccagtaggtggtggcggcggcggccctaggggttgcgttgacccgggacagcatcagctcctgtcggcgccgacaaccctatgggcagcggcacctcgggacggtggcggtctgagcacctacgcaaggctctcagcgagtaggcagaggtcaacaccggtggcggcaacggctcagacgaagacaacctgagcacaagcacacaaggccctcagtgaggtgcaggaggaggtcgaccccattggtggtggcagccctagggatgacagcgggctgggtccgaaaggcagaagagcatcccccgacgacgacagcatcactatgggcgtggagacctaggatccagcaaagtggaaagcgatcccgtcggctagtgtccggtcggctagttctgactaaacgatgagcgacgatggatgaaagtaggctaattaactggcggcgcactaggggcggcagcgactagacgaattccactagtcaaatctagctgtttcaagagagtatgtcaggaaatagagaagcacgggtgtgccgaggtcgttttgcttttcttttcttttttggttgtgtgttctcctccttgttgaggtgtgcgtctaagtgctcttgtaattttttagctgtgtatatccttcgtggatatagaggccggattaatgaaaatctattatcaaaaaaatgtgttatcatttggtaataaccattaaataggtgtgcctgaatgctctactaagaaaaaactgcacatatcttaatgaagatgagaagcctgcattaaatgatgattaacaacctaaacactagtactccctccattccataatataaggcataaccacttttttttagatgttccataatataaggcatgcatgcatataggccattaactatgacctcttctccattaaactatttctttttaaatcctccactcttatgttctctaattctattggatgcatacattgtatttattaggatgatcctaactataagatgataataattattttcttggtcttcgggttatgggtggttatgtcttatattttggaatggagggagtactccgaaagggcaatttcgtccttgacttaacgaagttttttttttatgaggacttaagagagttaattatcctgtccatttacagagcccgctggtgcgcagttcttcctactcacagtcaatgagacttagtaactgttttatttggttaaaggatatgagattttaggaattaaggagggaggaactccctgttttttaatgcctggattgaggtgggagttgggaggaagttccccccttatattatattatttagacagatatcaaccatcaattttcactcaaggtcaagactatcagacagtgtacgatggcccaaaccttacagaatcaaaagcggatatcagatatagaggagctctcgctgtccaagtcattagggaatatctcttgatttgggacttagtggatgcatgggttgatattacaagatggcattccagatcaacataagatagaagcttacagggtcaggatcatacactaccaaatcaatctatgatacttctttgttagaataatcaaatctgccttgttgtgaaggattttaagagctgggcacaattgaagtgcaagttttttatttggcttgcggtcaataatcgataatcgatattggactgccgatcgccttgcaaaacgaggacgtccacatcctgcagtttgtcccaactgtgattaagccaaagaaacaacccaacacatccttgccatgtgtgttatcccctggcaagtttggtccttagcccttcaaagattgggcatgtcttccatcgtgccaagccaagacgcaagtcgcttttctagcttactttcttaagtaaatttggtccgcctatcttagaccggcctggctagagactatggaagtgaaaacgatgttgccacagcggcaacttcctaaaaggaaaattgggctacagaaggttgttactctcctaaaacattgaaaaccccagcttctttccagttcaccacttcgtctttaattgagccaaaaaggaaccccgttgtttagctctgattctagaatatttgcgcgtttctctccttccaaatcatccaacagacccagcaacactaaggtgtcaaatgcgcttttgtggctggttcgaaaaacttgccgccattccagccaccaatgtccaatgtccaatccggactccgccggaagctataacctggcgtcgatccatcccttgatccttctccagacaaagaggtgcttgcaatcttcgtcgttcgtcatgcagagcgggcaagattgttggtgtggccacccccgcttgctgagattatcggccatgagacacctccctttatcagccaaccacttaaagaatttcactttggaaggcagtctagtgtgccaaatcagactgcagcatctcgcttctgtattcaccatgaagaacaggtcgtaagccgaagcaggggtgaacctcccatttacagcccacttctacattgtctcatcctcctctcccccttgcagctgcacctcctggaccgcatcccaaatctgaaaatactctcccgaagagtttcaattcacttgtcataacgatgacttcggaaatcaggaagcattcgtgttgggtggagtttaaggctagagcttgatttgcatagtaggtcgctattccttatactgcgtaaggtggtttcttttggtagggggtccttacaatatgtaattgcaagactggtttgagtttaggattggggtttctttcccttcatgatgtttttctctttgcttcatgaaataataataagcagttctcttgcccattcatgaaaaaaaaatatttatctacaattcccactaactatacgaaataagagattaaggctaaacatcaaatttccatactaatctcatcatcaatttctctcaactaaactctcgttatttttctcccaagtggccaagcacgtgaacaggattattactgcggatgcacgatgacacaaacgaacgatctttttagaaaaaaaaaggcaaaatcacaagttcacaccaccgtgtttagcactttgaccatccgtcttatttgaaaattttatgaaaaatattttaaaaaatagtcacacataaagtactatttatgttttatcatctaataacaataaaaatactaatcataatctttttttaaatagaacgaacggtcaaacgttgcacatgaacagtgctaaaactgtacttattttgggacggagggagtatgagagacggctcatttatcaacataaaacctacctaacatctgagacatcgtgcacgagcacgagatgcgaagcaaaccaaccattgcgactctagatctgacattaacatacatatataaacaacccgaatggccatatgagagcacctcgtttgactaccagaagcgcactgaccaaaacccctccaatatgaaaccccgtacatgatgaaacgcaaccggagcagcagatggagtcgattcagatcccagcgaaaccaaaaattgagaatcaggaataccaggctgaggcgaggggacggggacggggcatctggtggggcggccagccagggagcgtgtacctacgtacgcacgcacggcaagaccgggacgggcggccgccgccaagcacgggccgttccccacggccacggctggctagtttattactttgcctgtgttcttctgggaaactattttaaaagtttgagtggatgtccacccgtttattacatgtcatctaaatggttataaaaaaatttaaaaaatataaataagatagaatcaatatgtaatgtatcaatccacaaatatgtaagttaaaattcaacgtctacatgctgtaaaaaaataactcaaattactatatgtatatttacagataaatttgttatttttgttacaacttgtagaagttgaattttaacttgcatgtttgtggaatgatatattacatattgatctatcctgtcaatttttttgaaaatttttcgcaaccatctagttgacatgcaataaacgggtggacgtccactcgagctattagaatccatctccctgttcttcacccttcttttctaactcacttccctctttttttcaagggcacattttttaaacagttaaacggtgtgtattttataaaaaaattataggaaaattgttttaaaagatcatattaatctattttttaattttttagctaatacttaattgatcacgcgttaataggtaacaccgtttttcatgcagaactcaacctttgtcaccaaatttggctaaaacaacaaaactaaatactctcaccatccctaaaaaggattatattctatgcacataagtttttcatgtatacttcatgcacatcaactaatcttaccatcttaagtaatttatttactgtgggaaattgaattaaattgaaaatgtatggtaaattgaaaatgaattaaattaccgaccaatgttttgtgtatgagcgtcttctctcttaccgacttcgatcagtcagtttgtagagtcatacactctccctagcccccagccttgtcgtcggagaatcgttctcagagaataaggctcttggacccttgacctgccttggttgaataagcactgatcctagcccccagccgtgaagttggaaagtccatttctgattacacggcttggttaatacgcacggcgagaactcttacacgaccagatcttacatggtcttttgtctctgaaggatccgacaaggccttatcggctctgggcgtccccagccgaagatcccttaggttcctcagaggccttgtcaagacggcgtaaagggacagtaggataggtttcaacgctaggtgtcgtcgtggtaagggatctctggtaaaacacttggcgatattgtgtacctgctatcaactttgttgaaatagaggtattaggagagtcgctataccgctggtcgaagaccaggcagtagtcgtaactcgaccatttaaagtggaaatagtggaagaaacgctacatcgctggtcgaggaccaggcagtagtcgtaactcaaccacttaaagtggaagcagtgggagaaacgctacatcgctggtcgaggaccaggcagtagtcgtaactcaaccacttaaagtggaagcggtgggagagacgctacatcgctggtcgaggaccaggcagtagtcgtaactcgaccacttaaagtggaagcggtgggagaaatgctacatcgctggtcgaggatcaggcagtagtcgtaactcgaccacttaaagtgaaagtagtgggcgaaacgctacattgctggttgaggactaggtagtagtcgtaactcgaccactagaagcaaatgtacgggagatcactatgatcaactggttgagaaccggtgagtaggtgtctctcgatcatttggagtcgtggtacaaggaccgctacgctgtcggtcgaagaccagtcgcagctgttcgtcaaccatctgaagtcatggtgcaaggactgctacgctgccgtagtcgtacctcgaccatctgaagttaaggtgcgagagattgctacgtactagtgcgagaactagtgagcgagtagaattatctctcgaacaccaatggaagttgcggtgcgagagattactacgtcctggtgcgagaaccagcgagtgagtagaattatctctcggacaccaatggaagttgtggtgcgagagattactgcgtcctggtgcgagaaccagcgagcgagtagaattatctctcggacaccaatggaggtgctagagttagtttattacatgtgcgtctcatgtggccagcatgacttacacacccaacttgtagcatattcggatatccgatcacaatcatgtcgggtgatcaagccgacggcgttcgcgaggaattatctgttaacaaccttttctcgagtagtccagccatggccggtgctatgagataggtcgtcggtcttcgttggtaggttgggtacgataactctgcatttgtcgagaatgttttcgataatggagtgtactcgaccacaacctactcgagtgctcaattgttcctaaaagatattttctagaaggcaagacatatagcagagaatatcgagtatgtaatcaaaaaactgcatgtagcttctagtattatcaggatataacgagcagatgtaattatcaggcattatgtaaaccgtaaacaagcatgatttatacagaagaaaatagagcgagcccccagcgttagaccgtagtcgatttaacatcggggacactcgtgcaaaagatattgtataaaaaacatgctctaggtaaacataataaatcatggatctgacaatgctgtatgatctgaatgataggtacggtaaattgtatataaaatattgtgtacctgtgtagatatatgccggatatatctacggaattagtagattaattgaattaattaatctactaattaccttgattagccttggtagctggtctggattgttttttctggacgcataatacaggcacgtacaggtggcccactgacatacgtacatatgtacctaaggtaaaatagccttcggtacattgtaagtgttactgtatgtgcatgggtcccacggtatgcatgtataatatacatgtagatggcaatgcagtcggccggctgcttggttggcaggtctgacgacgggtaattgactccgatctgatgtaggccgatgtatctgaatctgatgaggacacctcgtcgattctcagaataggctaatcgtcagactgatctcggatgtcgtcaatgcccgatgatgataattcgtctaactttttggcggcggatgtcggttcaaaggtagttgattcgggcaaggcctcacggttgacaactttgaaccgataccctccacggcgatgacgtcttgaaggttggtcgatctcgagagatcgaattgttgacgacgatggtcccgatctcgtcgggggacgtactctggcggggttggagctcccgggtccgaagtcgtcaagtagcttgttattggagaatccatcttttgaaacccatctcgtcgaaattctggtatttgcatagtatggggaccgtcggtgctaggatatacgcgagactgaggtaaaagagatggggacgaggatttttatacaggttcgggcccctgagttgtcaggtaataaccctacatcctgttggccggagctggagttgcttttattcaccataatcacaccagtacaatatgtggggtagcctatctaactgttgtcgacatgacggtctgaaggtctgactcgtagtcgacaacagggtagccttgctcctcgaatccgtgtccggcgagatcagaaatagcgctttcgtctctcctgacggcatccggagaaaccgtaggggaatagccatgcctatccctgaagtcgatatccggcggcttgtcttggcgtatgttggcttgtatgttgtcccatatattgtgttggttgttgattgaggtggtcgtcgattgtctcgtgtcaatcgtgttgatcatgttgatcgtctctggattcccccctctcctcctagggggtcttgtatttatacccataggtgtccccttgtccaagtagaactagggaaaccaatatagatacaatccgagtagtccttgtcgtttccatgtagaactctgattgtctttccttatccggaactccctccatattcgaagtcagtttccgtataagacatggtatgtggtgggtcctgccgagatgtagtcgactatcattagatatgtggtatccataaccctgacagtattatcctaataaagtagtaatttatttactaaaagaagggctaagaacaacgtaagagtaattcatttcactacaagagaattgaactatcgccaccaatttattacaacaaaaaataattcgtggcaatatattatactatcacaatgatattttttctgtggcaaataactatactttgttgcaacgatttacaatcattgttttgttcagtatttttgttgcaataggaaatgagctatcgccacaaaaaaacattactattgcaaaaaaacatgttctatcgccacacatttaatttttgtggcaatttgcacagtacatggtacttttcactattttctattgccatgatcaataaattcgttgcaataaaaaatttatcatctcataatttgacttattcttttcatatggacacggattaggacaaattttatatgaaatttatagctctcgatgagatctacaacttaaatttttcatttgaaatattttaaatactcaaatacatgattcaaatctcagttaggtagtctcaaatgaaattgtatgtatttttaaacaaaattgatgcgtatgtgagttggtcatggagagcgtgcatgagggagagatcttgggtttgaatcctggacatgacaagatatcaaaagaagacaagatatcaaaagaaaataattaggatgataagttaatatgaaaacatttagtttgctacgtataactaatgccacacatggaatggtagcaatagttatttattgcaaccatgtgaagtgttgcaatatatattttttgccacatccattttatggcaatatcaaattttattacaactaaataaaaatcgttgcaataacctattaccacgctatttattaccacagctagcaacgattttaagattgtggcaacattgatctattgccacaattttagtattgatgctactatttttttcgtggcgataaattatttttctagtagtgtttattgcgagaacgaacatgggagtaatatttttacttatagtgtactatgtcacatataaatagttagtaatcattttactggacatttattttgaaaaggtgcgggatgagtacaagatccgatttctacgcatagtaattttattacttatagtgttctgtgtcatataaaaaggcttagtaatcattttgctagatgattattttgtaaattgccccattttggaggcatttgtaaatttgccactggtttttttaatattgcaagaataccactcgaataaaagttctagtggtatttttacaatattctagtgatagttttgcaataacgattcaaagtagtggtaaattttgtaattgccccattttgaaaaggtgtggaggtggggggagggagcgtgggtggggggtggggatggactgtatgtgaggggagcgttttagttatagtgcatcctggttgcggtttaacgcattcctatatatagagagatatattagcctcacccttaaatcctttcttttttattcttttttttttttgctttggttacgtatagtatcttcgggttataagctgttgctgtaaagttatctttcaagcaggccccaaaggatagcccttttttagtaaatttataatgccacttcaataaagtaattttagaaaattaattaaaagaaagacatgaaaaaatccttttttttctttttcatcattgcttgaatggttgattagagactgtatatctcatcgaccaatgtgaaatagagtatatttttatcacgattggaatctggatgaagttggggcggttaaaataatattaggtcttctactatgcaacttaggtatctgttccacactgttttgaaagatcgacagaaaagaattagttatgttaggactgagcacatgtcgacccactagtttaaatgactgatcaagtcttctttcaaaaccaatttgttaggacttgggtacatatttatgtacatccctgtcaagtcttgataaagattgtcagcttgctttgtcttgcagctgagctcctccttttaatccctcgttggcttccggatcagcaccagctattcattgtagcacacccacaaacccaggagaggtagcaatggaagcaacggtggtgagcgtggggaagtcggtgctggacggagcgctaagctatgccaaatccgccatcgcggaggaggtaactctgcagctcggcgtccagcaagaccagggcttcatcaaggacgagcttgagatgatgctgtctttcctgcgtgctgcagacaaagagcagggacacaatgaggtgttccagacttgggtgaagcaggtccgtgacgtcgcctacgacgtcgaggactgcctccaagactacgttgtccggttggagaaaccgtcctggtggcgaaggcgcctctcctgcacgacactgcgggagaggcatcgcatcgccaccgtgatgaaggagatgagaggcaaggttgaggatgtcagcctgagaaactcgcggtacaaactgcttggtggccctgcagctgcctcagagccttctccccttacggctgctgagctgcagtccaccaccttcgatgacattgaggctacgcgtgtcgccaagcagcaagaaaaggtggacctcgtggatctcattactaaggacggcgatggccttcaagaaattgcagtgtggggaacaagtggtgctactggagtggcttccgtcgtatgggtggcttatcaaaaggtgaaggacagatttccggaatgccatgcttgggtaaaagtgatgcatcccttcgatgccaaggagttcattgggagcttggtgaggcagtttaaagcaaactcccatgaggggactagcaacacaccacaaggaacaccttctggggtgtcggctctgaacgagatggaagcaaaagattataacttgcttgacgacttctgtaaatatgtggctaacaagaaatatttgattgcccttaatggcctgtgtaacatagaagagtgggactggataaaaacctatcttccaaacaaacataatggcagccgaatcctggtgtgcacgccgcaagctgaagttgcaatctgttggaaaaacaaggatgggtacaaggtgtctgaaattcgacaggaagggtcattcgtcacacctctttacgtcttctacgaggaagtaaaggttagtattactatctatatttatattgtcatgtatagttttcactataaaatgttattttttagaaaccagctgctagttcactgtattacccaacgaggtttttttttttcaaaatgactacgaatcagatgctcaaattttccccaaaaatcggtcattgtttcaccccttatagaagaatgtttcaacgcttagtaaaagaatgtttcaactcttaaaaggagtgaaacacaattgaattaccaaatgaaacaatttgcttcagcataagaaacaaatgatattaagccaaagcatttccgggttttttttcttgtgctttccccgtgaccgtgcccgaggcactccctcgaacgagcctacatgtggcttatcccacacaaagagtctgctaacagggccacacactagctggcgtggctaggccacacacttgctaatcagtttgggctagtgtaatgtccttgaaaacggttttaggcccaactcgtttagttagaccacacctagactttaactctcccccgcatcacgcaaaaagttcgaattgagagttaggaccagatggaggtagatatgtactaagggcaggtacaatagcacaaacatattttaaagagataaataaggagagagaagagcagcgggctacatatttgtagccatctgtagcacggactccaagacacagtgtttgtgtgacaggtgggaccaggtattaatagtgtagtatgcaactattgtatgaattagctattagattggctatagattaattggagctagtagttggctatactattaaacttgctctgattggatgcatatctataatatttcatattttctaacatgtatatcatttgaacacgcccgctggcaaacctgttaatttccttttgtgtctctggctctgtgctaattgtatctgttcatcatggttatacacaattacacattagaacatggtactaatgctcatcactgcaaattaagataaatgcattgttcacagaaacaacagttttacctaattgttgcttgtatatattcaggactctccaaccgaacaaactgacaagacaaagtccagctcaaacgccactgctagtacagagggtcgaaaaagcccacctgtgcctaacgaacgcaaggatccagagtcccaagttattgatctaatatccaaaggtgggcaggtgatcgctgtttggggaatggaaaatgatggtgtcagaaggactgctcttgtgaggaaagtgtatgagcgctctgttgacagatttctgaggcatgcttggtttggcatgacgtctcaattcaatcatgatgagctcgttatggagttggctcgccagttgaatccagataactgcgaagacacttgcctcaaaaaaaaagaagacagtcaagacacagaaggctctactcatcgtaagcagcaagaagatggacagaacagttgttataaatcaaaaaggggaaccaccgagtcgacaag

SEQ ID NO: 31139 - DNA, 9218 bp, Oryza sativa
gtaccctccatgtctccaacccaactaggagtaccatttcttatttctgaataggagtgcactcaactataaaagaatcttaattttgaaacaataatccagatctataggtgctatacagtagtaaataaagtcattaaacttcatttacctttggaagtacccccttagtctcataatatcgcagcttttagcttttaaaatttgttccagaatataataatttcttcaccaacactctatgcttaaccaataacaatattcgctcatttaattttcccacctactttattttttcagtcaatcacaatattttcatatttaatttcacatacttttctcaacaattgtgtctaatcctaaatattttagggacggtggtagtatatcgctaaccttattgcctgttgaccctttttttttcccaggtgggctctgagtgggttggtctagattccaatgagataaattcagagaccaagcctagcatggccagttcctctactggcggtgacaaccaccctgagggcctgcgtgaaagcagttcaccctctctcaacaaagatcctaatgcggccgtgaagaaactcacacgctgcacggcaatggtacccaaacgcagcaggacagtggtagccgctgaggaagctcagctcatgattggtagaagaaatgaaaaggataaacttatcaaaatgcttgattctggttgtgatgcgaaacatcgagtgatttcggtgatttcggtgtggggaatgggtggaattggcaaaaccactctcgtcaaaagcatctatcagagctccgagcttgagaagcttgggtttgagaggcgtgcttgggtacctgtatcgcgtccattccgacgtatcgagctccttaggatcttggctcagcggttggttaaagattcccccggaaagaaggtagaatctacaccaggacttgcaaggagtggtttaagcatgatgggatctaaagaattaattgacaagttgaagcaagatttaacagggaagaagtacctcattgtccttgatgacctatcgactactactgagtgggatttcataaaaacaatttttcctgaaaacagttctagccgcatcattgtcaccacaagacctaaattggttgcccaacattgctccgaggaagaagagtacatgcacagaatcggagatctaaaagataaagatgctcttgatctattcttagataaggtacatgttcccacctgtataatgacttatttttatcttttgagttcatgctctgtacaacttatatatgcatctcacaacatactgtcgagttgaaaagattgtgcttgtgcatcaatggtaataataagtgagtaaccatatacgccactacattttcttcccttccaatcacaaataagtgatgctttgaaacacgtgaaatcaaatgttttcaaaatttgaccattaatattgctatgaatatttgctgtgatcaacttttgaaaaacttatctttaaaatagtttaaaaatattaccactttgctatattattttatactccatcccaaagagaatgcaactctagcattcaaattttgtcaaaaatatatatattctggagtaatactttccccttcaatcaccactcattcagatttctccccattttatctctgaccaaccgcccaccaccgatcatctctaatttaatgagggcatcttaggtcatggtccttttcttttaatttatcttctgaatgttatatttttgggacgggagtagattttatataagtaattactaataacatgcttgtactaatgaccatgtcattgtctaaaaaatcacttatttgtgactggaaggagtagtttgattgtacatcaatgataactgaataatcatatatatgtccttacgttttgcagtttgtccaggcaattttttttttattttttaaaaacaatattttaaaattagacatggcatacattcagtgtacagtaaaatttcacataataatttggttgaatttttatgtattttgtaagtaaatttttttgttaagagatgataataatttagtctacacatgcaaatctcaaatatatttttgcactgccctaaaaaatatatatatatatatattttgaactcaattaattaacatttttccaatctaccactaaatgaataccatgttgaagttcaactacaaatcatttatgcatgcatgtatgtatgtctgtttacatatttcaataaagcaattgttgatgctgatcttcatattaatgtgtagcacctagtttaacatagatatgattcgctaaatctgaactatgattttagttcttaatatatttatttggtaattacaaggtaattacaacaatattatatactctttatgaatttaacttttttttcaaatttatcttaacatttatgtttaaaccaacatccacgattacttgctagtactaaattaattgtaccaacaaatagttatctaacatggaagttagttttgttttttctcaaaactttggtcatagttctaacaaatatatgttttttccaagtttgtatttaaactacctattattgatgttttgtgtaattccagttctactttttttaaaaaaaataaatactttgtcttcctatgagagcggatacaattctatcagccaaaaattggtgtgtgcctaaaggatttatctgtgggtttagtaagaaatgtatgtgtaacggaaatatgattaacatggcttgtatccatatcatatttatatctatgctaattgggtacaccgaaaaaattcttgtgttaattggataatattcaataaatctgccacctatcaaagtaggaccaaactatagaatatataaaaagaaaagccagcatcgattacatccagggtttgcaatttcaacaattttcgtgaaatttctagattttgagctggttcagaaggagattttgaattgaaattcaaatggttatgaaaacaagtgaattgaaaatactaaaaaaaatcctataaattatatggtattattaacaaatattgaatcacttgtctatttgaacctaagaatgagctatatagttttaaaaaaaggcacaaaggaccaaagagcccataaaggatcagccatttaactgaaattgaggggatatactcctccatccgttataatatgttggtattatcaatttttctaaaacaatattgaatttacatatattgaacctcaatcatacaaccaatattgtataaaaaaggcacaataggccgaaattccataaatgttgggcccgtttaaccaacacagagggatatatatttatccacacctttcatacattttatcggatatttttgcactatttttataaattctgaacatttttctctatttcccatttccaaataatcgagagacttttgcatacaactgatatgcttccgaactttttcaatcaattttccctttcatttttgctaggaaaaaaaactaaatttcaatttggccaatcaaaattcaacgcttttcaatcaaattcgatcatcttccaacaaatttcaccctccaacttcaatcttctgtttttgaaattctctcgattttttttattttcactatttcgatgatactcacccttcggtgttcaattgaaagtgtaacctctggttacaactttctaattatcaattttaagtttcggaactaaattaataagttacgaaattgtgagtccaagagaggtaaaacctcatagttatttattctagattcttgaattattaaatcttgaaaactttgcatcgtcattcctaatatataaactaggttaaactatacgcgttgcttcagaagtttaatatgataataacaagtaaaaataatgtgtaaaatagctagacgacataaacttatataagttgatgtgctttatgataatttaaatagtatatagaatgatgatccaaatataaaagtaaggtgatgtggctttatgagagaagaaaaagaggaagataatttagacaatatattaatcatctaagagctagaaacaattgaggtgatatggcttgatgagagaagaaaaagagggagataatttgtaccatagattaatcatctaaggtctagaaacaattgaggtgatatggcttaatcagagaagagagaaatgatattaggtaaatgaggatgaactatataggtacatagcatattataaaaataatggagatatatatattaaaatattatgtgaattatgtgggatgatgatttaacatgctggtattttaaagctctaaaattcaataaattatagataatatagcatggttgcgtgaatttaagatataataattgttagtagatgatgatattgcatatttgcaaattgagttatggatatggtgggttgtaactttatagaaaggtaggattaatttatcaacaaacaataattaatgcttcaaaccaaggacaacttcaaatttatatttattgattatgatccctcattagatagaaattactaagtatttattttgaatttcaagaattattaaagtaagaaaatactaaaactcagatttcatgatgagtgaaaatttgtgcttattactttagtacttaattagtcatgaaaaactacaagtaagactccaaaacaggtacaactttctaatatactccttcctcgcataaatatttattgtttagtacactatttggtcaaactttcgaacaaaattttgaaagtttgaccatcattaacatcacaaatgcttagtttataaggataaaataaatgtacgcatagatttgtctttaaacataccgtcattatatggtaatcttatttgatttcatcagcttgatctaattaaaattgatggtcaatatttgaccaaatcttgttctaaagaacaaatatatatgactagagggagtatgttagtgatttttgaaactatttaatcaaggaaaaactacaaattaggattcatgacaagtttagcttttatttattaattattagttatatattttggaattattagattgagaaaaataataaataaaatgttctggttaattatatataataatataataattattgagtttaaatatcatctttttggcctacgttgtttgagttcaagcaattggacaacaaaatttggcttcttccatcgagttagggtgcccaatactgcttggttaacctctttatacgaatccttggtttattaatggccgatggctctcttaaatatgatccttggttttaatccttgagcatcatccgtagtttagaattcttatattttcccctttaaagattacaataaaatcttctggtagttaactaagatttcagattttcaactggggctttattaaaaaaaagatgaaccagtaaaagtttcttgtgcgagaaagagagatcttcatatattgtgtttaacttgttaagtgacattaatggcaggtatgtaagaaaggggatgaatctgaattgaagcctgacatgatggacatcctcaagaaaaaccctgacatgatagcagaagcagaactcattgtaaagaagtgtggccggcttccccttgccattgtggcggtgggtggttttctgtccacaagacccccaaacattagggaatggagaaaattcagtgaccatatcagtacagaattggatgagaacccaagtctcgagatgataaagaaaatacttatctcaagctatgagggtttatcataccaccttaagtcttgctttttgtatctgtcgattttccctgaagaccatgacatcaggtatggacggttattgaggcggtggattgcagagggttactcaagagcaaagagaaacaataatgctgagaaagaagcggaggaacagtttacagcccttctcaacaagagcatgatccaacagtcaagaacagttaccaccgggaagacaggtttctgccaagtccacgatctgatgcgtgaaatcagcattgcaaagtctgaagaagaaaatcttgttcttgttctagatgaacacagcatctcgagctctaaagataaagtacgacaccttgttataagccagagttggagcagagaacagaagaagaacaatgatatgcaaaatatagtggatgtctcgcatatacgatctctgacagtctttggggagtggaaatcatttttcctttctaagaagatgaggatgcttcgggtacttgatttagaagacacagatggtcttgaggatcatgacattgtgccaattggaaagcttcatcatttaaagtacttgtctctaagaggatctgcaacaatcctcaatcttccaagttcctttggtaatctgttgaacctggagacactagatatcaggggaacatgggttacaaagttgccagcaaccattggtaggttacaaaacttgaaatacctccatgctggcatgccaccagatgatgaggatgacaccagaagctgggttccgactccgccatcggcaattttagaggcatttcgtgagtactggacaaaccaagaagaggttgggatgggaatcaagttatttgtatcagtactcatgtttttgatcagtggttggttgagaaatatggatctgtttggtgttaaagtgccaagacgaattggacgattgaggtccattcacacactgagcgtcgtcaacatttcacggggaaaggccatgctgaagaacctcaaaaagcttacccaattgcgaaagctaggcgtaactggcattaacaagaataactgcgaagaactctgttctgtcatcgtcaaacatggatgcttacaatccttattacttcgggcggagggtaaggatgggttagaaggttgtttggatggcttgtccccccctccaaaagaccttgagagcctccagttgtatggaaatctggtgaaattacccgaatgggttaaggagcttgaaaatctacaaaaattgagccttcggagcacgaatctggaggcggatgctaccatgcaagtgctcggaggcctaccaatgctcgacattctacgtctccaggacaaggcgtgcaaggagaatgaactacgtttccatcccgattgtttcacaaatctgagggcactggagcttatttcgtggggtagcctcaaatcagtgatatttgaagaaggagcgacccctaaacttgaggtgctactggtggaccattgttcgtccatagacgaagctgggtttgctgggatagaaaatcttgcaacactgaaggaagtttcgctccagggttactactacactgaattcaagaaaaaactacagcagcaacttaacatgatcgagcccagaccaaatctaaggattgtgttatacaaaactgtactcccccttacaatctattcacactatgtaatgaaccttgtccgttccctttgaccctttcaatgcaatgacaaaattcaggtggggaatccccccccccccccgggtgatttgggctgtgtttagttggatccaaagtttggattttggttgaaattggagatgatgtgactgaaaagttgtgtgtgtatgacaggttgatgtgatggaaaaggactgaagtttggatccaaactttggatctaaacacagccttggtaaaaaaaaaaaactgtactggttatgcatagaagtcgctccctccatactcaaatatgtggcattgtatcattcaagtagcgtttcataattatctataattctgaaaatttcagcattaagttttactcccttttgtctcctcatgtaccactcgctttaagtgtataagttttagtttcctcgtgaaactttgtaataccattgccatttcactgccagttgcaaagacaaaaacaaaagaaattggcacatctatttattgtaaaattattgatgtatatattttataaaataataaaaggtgaggaaagcttcctgcccagtttttctggtcctcagttcggctccttcagtccatcgtttgatctcttctacccatctgctcaatcaattactgcctgtcctccctcactccacccgcactaaacctgatgttaattcatcaacaactaacatatttccctgtaagtacgtgtactcgcacgcagttaacgatgatcccttgttagagagagatcgtgccgatgccgatgcagatgcaggcaccggagcttcaattcacgaggagttctgcattccggcctcttcatcgcccgctttgccctgcttgtcactagctccggcgacctgcgccgtctcctctgcctccttggagctcctgcgtgtatcagagctctcagtatcaagcgaaatggtaaaagattacagagctatgcaggcatgtcaggatgcagcaattgacagcttaaagcatacttgtatgagtagatgaggaggccagccgctgtgccggcgaaggcaacgaagtagatccagtcaacctggccatgagcaaagaacaccgttcagttcaagaaccgaccagcatgtctagtgaaaggaatgtgcagagtgcagaccttctcatggtaagcaaagatgcggatcagaacagcccacatatctgaagtcagcagtgagaggttcagcatcgttgccccacatatctgcaacagacaactcaacgataagcaatggaacatagatgatagatgcgagttcattgacaccatttttatcatgtaattgcgaggtcgtcatctctgaaatttagtcagtaatttctatatcagtaaaaagcacagcaatgtgcaataccttcagtactgtaggtacagttgagtagaacaggaacatcgctaatgcgaatccaagaaaaggaagcacctgagaaaaatagtagaaatggtcatgccaggaaaattaatgtttaccaattgccagcagacattgttcactttgttgtcaattttaacattaccaaattttggatagttttggcattgccaaattttggtagcgttagatgtatttagtttgatgcctttcaaatatttggtagtgttctgtgagaggaaagtttcggaactaccaaattttggtacagtggcattggtaaagaaatgtttagttggttgaaaatggcaataaagtgaacatgcttgaaaggagatcaaagctggatttgcaattttggttcgaaatttatg

SEQ ID NO: 31140 - DNA, 2067 bp, Oryza sativa
accattttgttgtttgttcatatcaaacagagttgaagggcttagataaaagtgtctgaagttccatcatggctactacagctcaaaaaaagtgtcatgtgcaaatcgggaggatggagacttactgcgccagcattccatttgattgaatgaagttcttttcgctcaagtatacttctgtagccatgtcaaggaaaaactacagggtgtactgtacagcagttacaaagaaaaaaaaagtagagaattatgcgaatgtgatcaatctatcaggaacgatgagatgatatactaaagtaacaaagatgctgattactgaattgcttccaatgtaagtaaaaagagggagtgctttaacagaaaatatcaaattaaatagatggattaagtccaaggatacatttgtattccactgataatagctccaaaaagtcccaacattgccatcaactcaattctgttgcttttcttgaccaggtactcctgaaatattagagagaaaaaatgataaatatattcatgccctgttgactctagatcatgccaatatgcaatcagatagttgccacatgcaaatgaggaaaggtgaaatgaaatactttgtgacttgtgaatgataagagttgctacttacctctgtaacattgctgcaagcataaagcatggaaccaaagattacgagcaaatctcccttcaaagggttgggtccttctgcaatacatttcagaaactgtacttatattctgatcactgatcagaatttgtgaaaagaaaaacataaaaagtatatattgctgtaactagtacaaattgcatcatgagaagttatgtccttactagctcgatcagaggcatggacatctgaaaatactactaatataagtccagccacgcaaactccaacaccgatgaacttcctgagcccatacttggtcttcaaaaatatccatgtaagaataatcacacaaggaattgaccagcaatccaagagcatcacgcttgtcaaagatgtgtactgataagacttcacaactgtttaaacaacaagagattcgcatgttttccaaaaacaaaaaacatgccattttattaaatagaatttacattaacacataagtgataaaagtagtctattattttttgcttctttttgctacatacctatataattcgcttccacgtcaataatcccaaggatcaaatagtagtaccattttatctgcacggaagaaatggaaaacttccaatcattatcctagataatttcacatggctgtgccagccaaaaaccaaaatactagtctacaaagtacaaactctaaagagcagaatcagaataagcatcagtctcatcgaacatgtagataaaggcagcaatcacaggtcctgtctataaagataagatatgccaatcttgcagcctacaatcatcaacggtgcagaaggaaaacaatgcaaaccaaactgctatcaactagtaaaaaagaataaactaaaggctgcccatgtgctgaactctacatttatagctaagagcaacagtccaggactccagattctgtacgtttctgaacaatttcatgtctgaaaaatgctcatccaacatttcactatgacaactatatacaaaattttgctggagatcgagggtgtatttagttcatgccaaaatttgaaacgatgtgatggaaaagttgaaagtttgtgtgtaggaaagttttgatgtgatggaaaagttggaagtttgaagaaaaagttgagagcttaaccagagtacaaaattttgctggagattgatgacagaggatgtggaacgtaccgtgaggggctgtctccggtagatgagtatacctccatagataaggaagagaaggatgtagttcaacagagactgagatgtcggtgcattgatacctgaaaaaaaaatcatttcagcaatgagatattatgttgaaaatttggcccgtgtgtttactaaattaaaattgatgctccatggcaccttctgaactgacatggcaacatccaaactaactgacactaattaaaaacactcatctttttccc

SEQ ID NO: 31141 - DNA, 5842 bp, Oryza sativa
tgcaccactcgagaagtcaaaagggtaatcttttttttttcctcctagaactaattacctcatcaaaaaaagtgaaaaaaagaaatccgaaactttttatcacggaaagaacgagatgtctccaccgtccaacagagagccaatcgtaacaaactactgctaccccaattaaacagaacaaagaaaaaaattaaaaaaacaggagaggtatgataggaaattcgctgtttcgtagggcagtgatacgatcatccaaaccaacagataagattgtcatcatcacctcggcgggcgagctcggaggaggagaagccggtggaggtgatgagcagcgacacgaactgccccagcgccagccccagcagcacatccctccgcatccacctcgccacgcaaccaccgtcttcctcagccgccggcagcagcggcggcgccattctcccctcccaccccgcaactgcaagggcgcaaacctctcggctctcgcgtggcgcgagcgcgtgcaatgtatggttgggttttggagggattcgcgggagatttggatatggcgttgaggagtgagggagtcgtggatgatagggagggagtaggagattaggttggcgcggggggaaattattggggaggatcggagggttggtgatggaggttgacgtctcgtgaatcgtgcgggggccatctgggccgtcggatccttctttccttcctgacttgacgccgcttttgtgttgagctgtttggactttggaggttggttttggatgcgttgcaggcgacaaaaacggtttacgccacttgacttcaaacttccaaactttcccatcagatcaaaactttcctacacacataaactttcaacttttccatcacatcgttccaatttcaactaaacttctaattttagcgtgaactaaacacaccctctggatatgcgattgccacatgtaaactttaaaccttcagctttagataaacaaaaaagatttgaaataaaagaggatttcaagcaaatttaatttgtagtaataagatgacagatcagggtggtgatgtggccagaggtgactatagggatatatggggcctgttcactttgatgacattttcaaccttaccaaattttagtaaagttactaaaaaaaagggctatatttagtttgctgtcaaatttttgtaactatataagaaatcctgccaaaattttgataaatttggtaaggttgaaaatgatataaagtgaacaaggccatggtttggaaaatacattttttttactaaacatggtacaaatgtaggtgctcacaacgcgtgcgcctttatctctattaacatgcatcctacctttataaatgcctccaaaaacttgaatcggtatattttaaaattgatgaagttatcataggtgtcttgttgttgatacggttgaagtctccccagaattcaaatggaaccttaaaattatctgagtgatgcacatagatagccccaaccctcaacgaaaacacagttacaaagttaaagcaagcaaccaattagtcaaaaaacctctgcgaaacatccaccagcatgtctgacttacctctcagtaagagagtcacacgagtaaattcctgtggcaaaaaaccaaaccaaaccgttcgacctttttcttgatgtgaaaccattagcacacccgacagtgacagatgctactagcaccattagcatgatactacaatgaaaaggccatagatgcatacacattcatgaactctgcctgttgggggagaagaaaggatgaactttcagagtttcagatagacagtgaactgacggagagacggacggacggtgaggcctatatagctttcatcatttgaacagagacatttcgccgggaatctgctctcccctcttgacccacccccaaccccaaagctgtactcgtattgtgctgtgcaatctttcatgccaaaaagcgtttggagcgttccatcgccacaaagatccaccacgccgtgtctctctctcgtggtttctccttcttcgggtgtgtttagttcctgaaaaaagttaaaagtttgaagaaagttgagaattaaaaaaaaaaaaagttaaaagtttatgtgtgtagaaaagtttttgatgtgatatgatgtgatggaaagttaggaataggaggaaaactaaacatggccttcttctttttttcatgttgctctgtgaactgaaaactgataagataacagtgctccaatatctctacttttacactgaaaaacactgcttcttgtgtctgttggttttcggttttctgaatctgaagaaactcgctgtctgccttcctgtttctaccaaccgcgcttacccaccgcttaccctctatctgatgggccttgctccagctccacctgcgttgttggtgacgtgtcacggtccagcccgttagtgagatgggccgcttggttgttggttcgaacagatcgcaccacgggcctaacacacgtacgttttcagggcatatgggcctagcttcagagtctctcagactcacagtaagcctactgcttccgtcttcgtcagaaattcatctcaactgctccttccgtttccatttcaaaatatagtaatataagattggaatggataaattctaatacgaagtactatgatgtattcctatcaattctaagttactatattttaggtgaagtaacactgtaaaagtaacaacccaaataattttgaccatcaatcgtggtagatcgacctagcaactgcgaagccggcaccatggtagctcaactacacacttcagacactcagatgtccctttccccttcatcaactcacgtctccgtctcctcgtagtatctgacttttaaggtttaatcgcagtcggttttaacccacagaaataaaatgattttgactcattttcacttgttcattgatgatttagactgtgtttgatagagggggcaaagagggaaaaaaatctcttgtatttcacgtgcacatttgtcgagctgttaaatgatatttttttaaaaaaatgtatagaaagattgttttaaatattatattgatctattctttaaattctaaataatcaatactcaattgagtattaaaaagtcataggctaatggtttacatttttttacgtacttctaaatcttttccatttccttccctttggaaaagcttaccagagtatactaacatgtcttctagattataataattcatcataacaatataaagatttgtttcagattagtcctaataatttaggttataataaccttaagccgaatccttaatcacgttttgaaatgaaatccgccgattaccccatgtggtctcttctcagcagcaaagccaaagcctgagctctcacaagtctcaagtaggagtagaaaactcctcggccgtatcgcctaactacaccaccccatcttctactgctcgctccccgccatgatgctgctcgcccgcgccgtcctccgctcccgcctccgctgcccgccgctgtctgctgcggcggcgtcgacggcggcgttctcgtcggccccgtcgccggcggcggcggaggcggagcgcgcggtacgggacgggcccaggaacgactggagccggcccgagatccaggccgtctacgactcccctctcctcgacctcctcttccacggggtacccatcccaatctctcctctctcttttttttttttttgttctgtctgtgtatgtgtgctcgcttgattggtaatctttttttattatttacggccttcgacttcaatctgtagttattccttgccgttagggaagtttattattaggagtgtgagagagtagatgaggagcaacgaatgcgatgcctttctttgtttctagatgtgcttgagaaatgctccctttttgctagtgaaaaagaatgggagaagaatgaattggtgggcttcctgtagtagcagccgggggaatagtgatgccaagataaacttttttactttgtggatcctggttcacggtggatgtagttctcgataaacatcctttttttggtggcatctgggatgatgagtagtggatacttctcttctttttttttttttttttacttttagtcaaatatctaatattatggctatagcatcaggtagactcgcgtccatgtccagctagcactgcctggaattagtagtaagatgatactaatctgtcaccgaagttctgatacatgatagtgattagcatcttatgacatactagagccttttagtagtgggactaccaattattcacaccaaacttagtgcggattttgtacttggtgttgggtgagatttgccacttaggatcgctgaactgtgggaagtgatgattgacgcaaagcataatgctaagcaccaactggaaaggctttaacattcaggggatattatttgtttactgttgttatagcaggtgctagctttttcgttatgtacaatcactagtgcttaaatttgtgtgtttgttccggaaaaaacttgaaatgatgtgtactatccctatgctatcaagaaattacaatgtgctcatatggatttgaggctaagcttttgcttggtcaagctctagtattaataggaagtaatgccctcaagggcatttataatctggaaattggtgctaaggatttcccatataggggcttcagacaattcggacttgatattgcaaatttagcttgagtaatgaatggcccatatcaaacatgtttggtcacaacaatctgcaacgatctgactggcttgatgcacgatagcttgtcagcattcattcaaatgcatatcttagtcgcattattagcttagtgcatctctgttggttatatgttgaacatatttcccaagcttttcgttgatcattttagtcaaagcctcaaaggggaaggaaaactattgtccagccttcacattagtcaatagggaaatagctctcaattgcaatgtattttcatttaaccagataatgcttgcattttctataggctcaagtccatagaagtgtccataaattcagagaagtgcaacagtgcactcttctttcaataaagacaggtgggtgcagcgaagattgttcatactgcccccagtcctcaagatacagtacaggattgaaggcacaaaaattaatgaataaagatgctgtcttagaagcagcaaaaaaggtactgtttttgtaactttatctcaaggtgaccaagttcatttatgttgttgtttttaaaaatcttgcgaagtggtaacatgagttcttacagactgaggacttcagctttagttcagaaaattatgggttgtaatatcatttcacattatttcttctgatctatttccgctcaggcaaaggaggctgggagcacccgcttttgcatgggagcagcatggagagaaaccattgggaggaaaacaaattttaatcagatccttgaatatgtcaaggacattaggtattatttttgaaagatagcacaatagaattattgtgtgcaagtatttggcagagtcttgcataaccatgcactgatgcgcatgctctcttccatgccattgctatgtcatcattagtttattcgtctgtttttttgtatttccaaacatattagtattgtcaatcttgaatgtaaaaattaaactattctttgcctgttcacttacaaacagacgtaatcttgagccatataggacactgacttaagcctctgcatacattacgatagaatatttgcatgaaggtagttttcttgctttatcactatcttgacttcgatttaccattctgtggataaatctctgcagaggtatgg

SEQ ID NO: 31142 - DNA, 4740 bp, Oryza sativa
aggcattcctctcgtactacaaattcagggtaaatgcatgtttatctttgtcgtgtgtatgtaacgggcataattggactgagggacattagtccttgttgaggtttcctggacctagccatggtggcaccagggagggagagaataaggactactccttacaaacttttctccaagatccagcaaatagctaccaaatcgatataatcttatctccaatctgaacaaccactatggatagtaaccatgcgggtactgttgatgtgcaatttcactggccctagggaggctgactgctgcttgtatatgggccctaatgggcacttaatgacttcaatgtataacctgaagcgccatgctctgtgtgcaggtggaattattggtcttggagaggcagaggaggaccgtgtaggattgttgcatacactggctactttgcttgcacacccagagagtgttcctattaatgcattggttgctgtcaaaggcacgccccttcaagatcagaaggtattccgcgctgctgattagttgttctaggttggatatttgcatctagcatcaggatatataaactgtgcagactataataagctttggtataagattatatgttgtgatttctgtatccattatctctaattaacattcaacttcagcctgtagagatctgggaaatgatccgcatgattgccacagctcgaattgtgatgccgaaggcaatggtgaggctttcagcaggacgagtacgtttctccatgccagagcaagcgctctgcttcctagctggggccaactccatcttcgctggtgagaaacttctaacaaccacaaacaacgactttgatgcagaccaggcgatgttcaagatccttggtctgattcccaaggctccaagctttggtgatgaagcaccagctgcagacactgagagatgtgaggaagctgcatcaatgtagaacaccaatagaaactcttgagaacacgttcggtgcaaaagtagcaccattatttccggttagcgcattgtattgtagagattacaatatcttgtagtaagttagaaaaagatcgacccaaataaatagggaattttctgtatcattgttcttgttgtgccattttgtgacatttcaatcagcttcaatctcagttttcctttttcctctttgatgctacactgaagtactgatcattatcaaatgaacctacattgtgaaactgtgaccattgtttgaagaacaagtagccactgatgttgtcactagataataaccagtttacccgacctgattgtgatagcctgatagtctgatggcttgcttcacacctgatgttggtgcatgcataagcatgacagtgacaggcaatctgaaattggtgtcagatcctgcaatcttatgaatcgtgaaactcatggcatgatgtaatctcatacgattggtccaaataaacaccgaccattgttgccttttcaagggacctgtagattgccattgcatgtacttgaggccatgatcatcagtacaagcttctaccaaaaggtgaaggcatcaacttttccttttccatctcaaaagatttgaaaataaaaaggcatcgtttttgcatggaaaaccttaacgtagacgttgattaataaaaagtttggccacatgtcgttatgcagtatgttcaaacttgcaatgacggataaatttacaacaaaggattgcgaggacctacgcaacaattccagttccatgatgattccatcgtacgtgtgtcatgagtgaaattggggctgaaattagcacttaaaacttctcttggaagaacactttgcacgtggaggcaactcagcatcaggctttcgaagaaaagagaagaacatccaacgaatatagaacatggtatctcagtataaaatcaatactttggtccaaaaagaacatgcatgtcttgaccgtactatagaaaaagaaataacgatggagcacaaatcttcagtatttatgctaaggccttgttctaaactctgcattgtttcacctttcctttttcacaaaattatattgttccatatgattgtacaaaatttaaattttcatgtctcagccaactgcttaccaaacaagccgcttatctcgagtaacacgtagggcagtggtatgttatgagtttaggtcccaagaaagttgtttccgagtttgatgacctcactctaaatgtaaatgctactattccaaactaccataaatgctaaaaccaaataaagcatatcttccaaagttttggtttcaccataaattttcttttctgaatagcggtcaactaatacattgttattagtggcggagaggaatttaaatctgtggggtcaattactagtggtttgtatttaagtgggaacatttctctaaattcttttggatttatacatgaaaatcaaggtttataggatgtttttcaaaaagttgtggggtcagccgaccccacagaaatggcctaaatccgccactatttgttaataaaacttcactaaactaatcacaatagaggggtctagaacaacaaaataaaaccatttcaagaaaagaaagaaactatatatatgcacgccgacacattttcttctccaaattagtcgaaacttgtgcatagaacgaaccctaagcctcccttcctctctaacatccattcatcccacccctcccccctctttttgccgcaatctccctacctccaccttgcccctattgaatccacggcctccctaaccttttctactgacttcacatatgtggtgctttccttcccatgtccaacgatcgccatcagatacatactccagcaccacctgatgctcctagccgctacttccttttcaccccacctaccactgcccactgtagtggacccccgtttttataacaggaatcaaccgtgtaaacagtaccatttccctggatcaagtagtctggtacacacgaattcatagctgaaataccaagtgcacatacacgagtgtctagtacgaattattacatcataagcccacaggcatagtcttaaatcatcgaactgagcggtccggaatacattccaaaaacagaagtaggtaaggcagcggagtcaaggcagcggcacgccattgccacaggcaacgaccgtaactaagacctactgagcgccatcgtcttcatcaccctcctgatagtaagcgtagggatcctccgaagcttcatctccgacctctgattaagtttgtatattgcaagggtgagtaccaaccgtactcagcaaaccaccacagcaacaatgcatatgacaggggtattcaaaggatggctatggttcttttgcgcaaagcaagttttgtaattcttttcacaagcctaagacctagcacagactgatcaaattttagtaccagtgttcatattaaacaatgacggttctatccaccatccattgtgatcccaaggatagcttcccgccattgagtcgtcatggttttctgaggacgcccacattcccgcctctcaggaagtggctccatcagtgtagaaatcatcatgcaatatcccatcccacacaggttaagaatttagagtctagccaagtgtaatacatgtcccggtgctcaataaccgcgagcacggttattcgaatagatttggtttactcacactgcagtggatgtacactttacccgcactccgcgactgcccaacatatgagcctcgtcccaacacatgagacgcgtcacggcaaagcttttcgataacctcgcattggcagtacccgctccatgaactttagccctcatgcactctaggcgtcatacgtttctagcagtgagaagagttctggcgctcccgggaagggaaaaacacacacattcctacgttgtttcttgtcgttgaacccagtccatcatgattgttctcttatgggtatcctcacgtagtattgccaagccaacctctgaccatccggaatgggcatctgccatccacctggccatccgaaccgggcatccgccagcagactgcttgccgcatcacacacctaaaagaagaccactacgcatggatactgcctctgctcagctatctactccgctaggtctatacccatacgagaagtgcggttgtacgggggtcgtttcatgcttaacttcatggctcggtccttaattgactggggacggtactagcattttccggataccacccaaatcctccgtccgccccagtcgaaaacagttgtttagttttatttctcctttcacaaatcatgtcatcaacattatggcaatgtggcgctcatatctccacataccgcatctcaattaccttcccaaaggtaattgcccaagcatatagcatttgataaatatgagtatgcataaatctagagtagcatttctaagcatttgtcatagttgactagggacttattcgtaaatcatagttacaaggatttaagggtaaacaataatcaaggcatggcatactcacaagtaggatgttcatcattgcatgcgattttatttgtaacaaaataatttcgcaattgggatcaacatgttcaaagaatagtgatgacttgcctgctcaaagtcttgcaggtcttagccttcacttggatccgcaactccttttgtttctatagctacgtgcgaaaattgagtggaatccggttagaattcaaataaagatccacatgcatccaaatgaaagtcgcatgcgaaag

SEQ ID NO: 31143 - DNA, 4290 bp, Oryza sativa
  unsure (1)..(4290): unsure at all n locations
atagtgtctttttcctatttatcccattttagtttatttcccatataaatttgattctataatttctaaatcttgcataaatgaagtttactcaatatttgtgttatctcaactaatgaattcaccctagattaatattactcatattttattggtataatttatttgaatttttaattagggttaattcttgttccattgcatttaaatctaattaatacaaatatggccgtgatgatattttatttattcctatccttacataatctttattttaaattataatttatttatttctttaaccaaatctaatttcagggttaattcctaattaattttcccctatttgtgatcgatgaattccgaaatcaaaatccaataaaatcgtcgaataaaattggcatgatgcaatttatttaaaaagtttttgaaggcccatatttttagagtttagattttttatcggtcgaattttcaggtgttacaactgtccacccttatcttacagctacactgaggctacttacatagttgtccctaccacctttgatacccgggccctcctcccaattcccctccacacccgcactcccaaactcaaaactttatctggatgtgccgccacttaggttccaagatttcatcggatatgaaggcgaatttggtgatttgagatagggtcaacgaggtatcggatcccttacctaggttgactctaggggtctacatatttgcaacatactctttccatgtgttttctcattttctatcttttcattctatctatgtacaattttagattacaaagctcatgtcggctcgattgtcagtctatgctctcacgtcagctttttttttttctacaagaaccccttttcaattttagttttagattcactgctagagaataagacatcttgatatatgatttttggagtcgatcagaatgccataacttagactaaattgataaaaaaaaagccatagatatatgtatatcagcactgaaatagaaggtgactttggatgttgaacaaaagctcgtgacttagatttaaatcatgccaaaatctatatattatagatatatatgtatatcaataccaaaatagaataaatacaactttttagaagggagaaaccttttaattgtgattattaacatcccaaatcacccctctttgttgtatactacatagaaaatccacaagtatactgctagtataaatttctcaattctaaaaggtcactttaaattactcagttacaaacaaactgcttatattgagtaacatgtaaggtgagttatcaggtttaggtagcaagaaagttgtttctaagtttgatgacctcattcttcatgtaagggctactttttcaactaccataataaatgctattaactccaacctaccataaatgctactattccaaactatgataaatgataaagccaattaaattatgtgttccaaagttttggttccgttgcatttttttcatttgtaaatagtggtcaatcaatatattgtttataaaattgtgttaaagtaatcacaatagatgggtcttgaaaaacaaaataaaatcatttcaagagaaataaaaaaggaattacatacatatacgccgacacattttattattgaattagtcaaaacttgtgcataggacaaaccttatctctaacatccatcgcatcccctcctctctgtccaccatctnccttccccaccaccccaccccatccaatccttcactttgttaaccccctcgtcgccgacttctccaaaaccagctaatatccccgctatgttttctttcctatctcaagcgaccaccatttaccaccactttcgtttcatcccatccatggcgcccattgtcatcctttgatgttatggctacgataacactactttcatagtcgcccctacctcctttgacacctagcccatcctctcgatccccgtccacacccgtgtcgcaaacttgaaaccttatatggacgtaaccacggcctagtttcctagaaatcatcgaagatgagggggtgagaatttggatatccgaagatggggtgagggagatggagggggaggggaacatgggtcgaccgaggcgtcagatcccttgccatggttggcacatggtgcgaacaactagatctacatgtctgcactacaaaatatcgaggtatttctttcgacgaattttctcaattttggttttgcttaattctatctatgtacaattttagattacaaaagtttgtatttgctcgattgttactctcatactcttgtgattgttttgttctatcatcaaattttagttttagatttactaccaatagaaaagtctttggtatacaaattttagatatcgaataaggggtatctaaaaaattaccataagttttttttttaagttttctgagtgaaaaactttcaaatgtaactatagtataattaaagtgtaactgtattgtaactatactttaactatgatataacttatataaaacttggatttaaccatgttttggttggttagaaccgagatcttacgcatgacatatttgaaacatgcaaaaatcttgaggaagtccgatggctagaaatcagcaaatttgaggataaaaacttatggaagttctcaagcaattctgttgaacaaaacctcataacttagactaagggtgtgtttagttggggaaaagaaaatttttgggtgtcacatcgaacgtttgaccggatgtcggaaggggttttcggacacgaatgaaaaaactaatttcagaactcgtctagaaaccgcgagacgaatcttttgagactaattaagccgttattagcacatgtgggttactgtagcacttatggctaatcacggactaattaggcttaaaagattcgtctcgtgatttcctccataactgtgcaattagtttttctatttatctatatttaatgcttcatgcatgtgtccaaagattcgatgtgatgtttttgggaaaaaattttggggaactaaacgggccctaaaggcatgccaaaagtcacaccaaaactgaaagaacacaactttgctagcctgggccctatttggttccatttgctaatgtttagccctcaccttttagccttaaattagccctcaaggatccaaacaggtgggctaattttgagctaatgtgaattagcccccctcaaaacattagccgctaatggggctaattttgtgtggggaccattaaaaagcagctttctctctccttctctctcctccctttctactctctctccaccttttagccttgaattagtctatggatccaaacataccaccctaggctaatgtttagcatatcaattcatgactaaacattagctcttaaaattagctatgggctaatcttccacacagggcgctgatactagtgagaactgagaagtgcaaattgcatcttccaacctcctaatcttgattattacatcccaaaattactgaatcccctcctcttattgcttcacagttcccaaaagtgtaccacactggtatataaaaaacaccccatcctgtgtgcctgccgactcgcccacgcaactccgactctttccttccccaattctcccgtccaccggccgcggacctcgccggaaccctagccccgccgcccccctcccctccccgatcgcccgattcggtggtcggggtgatggactccgacgccgagatgcccatgtccagcgacgaagagatgttggatgacgaggactattacgactacagtgatgacatgggtgaggacgatgatgggaacgacgccgggggcgggggagatagcgatgggtagtaggaggaggagggggatgagaagctggtggccggcgactacgaggcccgcgaggcggaggggagcgacgaggtggtgtccccccgcgagcaggtgaggatttttttggtcggaagcagatcaggtggtggactggtggtggtgtttttttttcttttttcttttttttagcagaaagcgcgacggtcgatttcattaagattttgggaaaaaaaagttttcatacaactcgagattacaccccccttcggtgtagcttagcggggaggcaaggcgagctgaacgtagatcaggacctggaagatcaggggtgctagattggtagcgtcgaacggtctcgagaatggcgtcgttttgctgaaataaggattaggatgagcttatggcgtccttttcttttttttttctttttttctgaaatgaggatcggg

SEQ ID NO: 31144 - DNA, 1741 bp, Oryza sativa
tatgagttctctgttcaggaacatcagcaagttaagcgatgaatggtttgcggatgaagaaaaagttcgtgatattgatggattacttttaaatggaattgatcttactaactctagaaagggttgtattatttattcaaatgccagtatattgttatcacttggttggtgtgctggccacatgtcatatctgatcaaacctttggcttgggctacatatacacttgttcttacatctgacagctgttttggttgcagctaacttgtggaatatgttttgaaaggtattcttctgatgtgatgagttctgctgattgtgatcatttttattgccatgaatgcttggaagggctctctctctctctctctctctgggcatgcttttgtgcataacttcctttttgcaattccaacactagcttagatagtttcaccatcagtgctcatgtatagactatcttgtagacttgtagttgttgtttttggtaaccatgatcaagatctgttcctgtgttgcagttattttatttttccctcagaataatgaaaatttatgataatataaattcaacctttcaggtatattagtgctgcaataagtgatggtccaggatgtttgtcattgcgatgccctgatccatcttgtggtgctatggttcttcagaacatgattaataagtttgctaaagatgatgataaagtgagatatgcacgatttatcttacgtgcatatgttgaagatagcaagaaggtaatatgtttgaacaagctaactaattactccacttgatagttctttgtggagtacctattttttattgtttatttttctaacgatttgaaatgatgagctgtgctctttctgttaaccttttgtataacctatggcatttcctgcagactaaatggtgtccagctcctgactgaacatgtgcagtggaatttgtcagcgatgggaactatgatgtctcatgcaattgcaaattcagtttttgttggaacgtaagtatttctggctccattttcctgacgatttaattctacttttttttattgctagtgatgaaaagtgtggagcttcatcaatgctttggtgatgtttgcagtgcacggaggaagctcatcgaccagtgaactgggagactggttctaggtggatattaaagaatagcgcagaatctgaaaatatgaactggtatggttcaggctcaaaactttattaagccatagtgtacggatagtgtatagataaggaattcattaatttttgtggagataaatctatgttcaaacatttgtgttgtatatttacttctttttttaacctatccttgatgccaatattgcagctatcttctaactttcctcatggttatgagtaaaaactgaggtggtgaaaaaaattgtgcatttaatttacgtacgtatattcagatgttatgtattcagaaacatcaaactttgtggacatcctcatgtgtgactggtggtctggaagcagaagatttgaggatgcaaggaactgtgaacactattaactctttgctgagtcagggctgcaagggctgatgcattgttttttaacaatatattatgacggaaaacatgtattatatgtggcactgtggcttaaacctcataataaacacctcttaatttatgttaaatacttggcattgactccatttttatcaattgatgacttctttttatggaaaaacttgtggaggctctagtgaga

SEQ ID NO: 31145 - DNA, 1745 bp, Oryza sativa
atatttatgtccatattactagtgtatgtacctctcatttgttttctttgaacatttcaggttatgtctgggttcatgggctgaacatggggagagaactggtggattttacgcttgtaatcgctatgaatcagcaaagaaggagggagttgtatgttttatcttgagactatccaattgcatttagtagaaggaatcagtttctagatgtcttgtgtattttgttattgcttctgtagaattaaatgtttcaatcccacaagtcaatgtcgagtccaaattgacagtttgttcaattagttcattcattcatagaatcataagggttactttttcctaacttaattacctctaatgcagtatgatgagactgaagcaaggagggaaagagccaaaaattcacttgagagatacatgcattactatgagcgctgggcatctaatcagacggtatgttcaacatgctcaagtttgatgtctctttgagtttttttttctttctacaacaactatacgtgcagctttagtcattcttgtgctcataacttactctgtgtttttgaaccttctggtttacttggcaagtgttgtgttggccatatgcttgggcagatactaattttgacttaaattcttacctaccgagtgtagcccaactagctgcagctttatttgaagattacttgccaagtttatctcttactccctccgtcctagaatgtagcaacctaggataggatgagacccatcctaggacaacgaatttggacattcctcatgtccagattcgttgttctaagatgggtcatcctatcaacattatgggatgaaggtagtaagtgctaataaatgctcttttttaatttttatgttggattaccttatcagttcatgatataaaaaaatacagttccagatgtttttctatacctgatgggtatatagtttctaatctactgtacatgcttgggatgaatgttctgcattgttctattctgaacttggaattttttctgctgtagtatgcaagtttctgtactgacatattcacttatattgccagtcgaggcagaaggcacaagcagatctgcaaaaggcagaaaaggaacaagtaagcattcgcatcatgttaggttgggggcgttgcatttagggcaagacataattgtttatcttcgccattcattcgtattttatatttgatagctgctaactctatttcttctctatgtgctacagcttgcaaaattaacagatgtttttggaataccggagacccaactgaagttcataattgaagcttggtcacaggtttgatatcataaatatgtcatgacccaaatgacactccatactatacaattcacctgcgtctgatgcatgcaccattccactatgtctatttcagattattgaatgcaggcgggtactcaaatggacatatgcttatggctattatctggacgacaaggtcaagagcgaatttttcgagtacctgcaaggtagttgtttgttgcattccaaaataaaatcctaagttctaccacgtgcttgccaaaaatcatgtggtatgtatattatatcttttataggtgaagctgagtctggtctggagcgtcttcaccaatgtgctgagaaagacctgcaatcatttttgactgtgagatctgataatactgaacctgcaccatcaattgctgaattcggtgacttccgggtgaagcttgagtattctatagtgtcac

SEQ ID NO: 31146 - DNA, 682 bp, Oryza sativa
attctgctttttagtgactatcatcatataaagaggcaaattgagtcagagatgattcaagctggtggggtgacaccttcaaagccttttcttgacctctcaaaaccagagcatttactaaaactgaaggatcgtttgaagaagtactgccaaaaggtgatatattaaaatgcatggattaattaaacctttttggtggcttgcaattactatacttttgtcccaatgcaggcatataaaagagtagttgacaaaccaattacagaagtgaggaacgctggaatatgcatgcgtgaaaattccttctatgtagacacagtacgaaggtccgtctgatgtttattagtatattttagtgtactatgttcattggatagttcatggatatgtaacagtgatttctattttagcttccataatagctcttagtggagcaaagtgcaattttctggttgataaacatagcattgttggctaatgctttcttcaaggtgctctaaaatgtgtactttgtttgaaaattccagctttcgtgatagaaggtatgagtacaaaggtcttaacaaatcatggaaaggaaaactggcagaagcaaaagccaatggaaattctatcaaaattcaggaagcacaggttcacaatgcattattatattatacatcaagaaaattagatcaatacc

SEQ ID NO: 31147 - DNA, 821 bp, Oryza sativa
ctataactgcagatcgaagctagtttgctgcagaaagaatatgtggccaaggttgctggggtgtttcctgatggtgaggtacgtcacttatttggtgtcaacagctcaacatgtcaataaatttgctggatccaagagcggaagattttgccaatgtaaaataacttgaatatactctgcgaaggcttgtagaccatttcttatactgaagtcacccgtagggttttgttatttttcccatgttgtgagaatgaaggcttggatctaccacctaggaaacgactgcgtggaattttcttgtgaactaaaagcatttcatttagtatttgatttcataatttcatacataactgctgatttcccacaaatatctgtctgaaataattctttttcagcaaactgttaatgcaaatgtgcacttcaacgcacgggaaggaaggagcactgcagaggtatgtaattagtaatcctgcttgtggttggtatgttttgatgtgtgtgaaactgcatatactgaagatattgccatctctttcggcaattattgactgcctcgacctctcttctcatgcaatgtatttgcctgagcaattataggtttatcccgcatgtgatatactggtgctgagcaattgtaggattgtacagtgtaatgtggcgtgtgctctttaatggtaacagtgcatatggctatctgtaccaaagaaataagagataattgattataataagcaaaagaaatagttgatatgggtcctatagagttcttcttgtacaagtagattgaacaatgcattcatttatgcatgaactattttcag

SEQ ID NO: 31148 - DNA, 8249 bp, Oryza sativa
ctccatctttagatctcatgcgttcgtatgttcgcagttggcagcacaaacatgtaaggcaagaaatccatgcggaaaaaggtaagcatattttgatctcaccagttacaacttacaagcaggccacgtccttgtccacggtagcttatctttaagagtcatctgccaatctgccatgtatggtccaaagtccagaaatgaccttgaattataccagtttttttcggtttccattctcttccagaagtccacttccagtgcaactgtctgccggagctagataaaagcccatgtaaataattgaaccgctaaactgcaagctgctacttggttccctccctcccgtaagaaatatagcttgaggctatgattagcatcttgacagaattgcatccaaaatctattcccttctaccataaatattttatagttaggataagattcttttaaaaccttagccattaaccctaaaccttaaccattatccaatttggggataatattttgagagtacaaactaataaattaactattacaaattaaaaggatattttaagatactgttttaagaaatttatactgttttatgatactaggttaccatttggcaacgtcaatagtcatatagttttgccctacttctgtactagaaaggactgtagtttgtaccgtttatacttaacgtttggtatttcgtcttatttgaaaaaaatatgattagtattttattattagatgataaaacatgaataatactttgtatgattattttatttatttttttcataaaatttcctaataagatggacggtcaaccattggatacgtaaactcacaactatacttaaaatagaacggatgcaatagttagcagaattctttagttagcaacaatgctgcaccacactactgaccatggtgtacgggtgtgtaggcgtgagtgtggttttcgcgtgtgcactcacacgtaataaaaaaaaactactattaataacttatatgtaggttaaagcaaaatctgtcatgtttttgttttccaaaacacatcacaaacgcaaatacatgtgcacataagtagactcatctatatgaacacagatacatcatatcttataaatatttttaggagactaaatccatatgtttaaaaattaaaaataacaaaatcgtgatagacgtctcattgtggatagttatattatctataactaaaacttattagccatgagtgtgattatctacattgattcttttctttttgagaactatctatattgagtcaaagacccgaattcagataggtatcacaagaagcatgaccaactatctatattggtctttgtttgcatgtccagcggagtttgcatggcctttgctttcttatcctgcacctttagatggtgtcgatggactttttattcagcaagcagtctctcggctctcgctcatctcaatcgccggtgtggaggtcgaagggagagggtggtgggccccagtccaaagcgctcatgcatgatgtcatggacagggaaaggacatgcgggcccccacactgtcgttgtcatttcgatcggagccgtttcgatgcggttttggtctcctcctgaattcccagacgctgttgccccataatgctcccatgatcgttgatcaggtagatcgatcgagagattgcagggcacagcccttgggcactgcaccttctgttccacagcgcaactaattacgtactcctactgctttctctgtttcaaaatcctacttccgttttaaaaaagatctagagctgtatgctagatagtactccctccgtttcacgatgtaagtcattctaacatttcccacattcatattgatgttaatgaatctaaataaatatatatgtctagattcattaacattaatatgaatgtgggaaatgttagaataacttacattgtgaaacggaggaagtatatcagatttgttataataagatatatcactttccatactgggttggttttgatgagacagtgagtgaattacacagctatatttattttaggattgagagaatactcaacacgctcatccccagctctagaaaatattactcctagctaagtcacttctcactcgcgggtaagtatatatattatatatattcattagaacagatggatcagtttaagattgttcccaaagtatgttacacatgctgttagcaatgaggttctatgttataaacccactatattagtactagaataataaaagtcagaaatagtaatatgatatttatttttggaaaaatttaatttaattaagatggtacaagttattaagtcatctaaatgattttaaatattttactccctccaaaaaaagcaattgtggaatttaattgataaattattagggattcatcggcggtctgggataagatgaaagaaaaattggttgagtgtggttggagggggaaaaagtactctagagtataatttccttttgcaaaattttaatgcaagaattggcaaaaaaaaaaaggtgagtacgtaggtacgtgtctattactccctccgtcttaaaatataagagattttagacgaatgagacacttacttatccagattcatagtactcattctagaaagtgtctcatctgtccaaaatcttttatattttaggatggaggaaatagtatgtaggaatcagaactaaagaaatgatacacgtaatcaacacagtaaaccgaccaagatttatattttgggatggaggaaatagtatgtaggaatcagaactgaagaaatggtacacgtaatcaacacagtaaaccgaccaagataatccctatccaaacctaagcttctaaaacggctagaatattactccatttgttccacgatcttattaggtttatttcttaatccaaatatcttgatcatagatttagttagaccctactagtacatggatatgatgccaacagggacaaaggcatcggtagaggagaaagacaattttcattgtgcttgaagaaggtgtgggtaccgcaaagaacatgtgggaacacattgtacgcagcctttgccctttttttcccctttcacatcttaggcagtagctagtggagtagtactaagcacttagcaactgataataattttgatctaagataataaaaatcaaaactagtgtggcacactgtatatatacgtatctagccagctagtatacatcacaaatctttttaatattacttgtaagagaaaatctactcaaataccattgatttcgtctcagttcaacaatttatcattaatattatttattttataatataccgacgactttatcatttgttctacaatatatcatcgggctaggtcattctaaaaacaccgaaaataccgttatatacatacatgactaataattgatttatcctatcaaaggttttaaaaaacttacgattttctttttgttgtatagattgattttgccattttggccatgagattttgcgtaatggtatatgtttattatatcaacattgtgaattcttttagtgttttttataattatttgatatttaaagagtgagaatcaaacgattgcacatgcacttagtgttgtaagatccaactctgcctagctagagcgatcgactagaatgacatttctttacagaaagaaaatacaaaaatctaaattacttatatctacaatcacaagatttgtgcatcaagacctcttaagaggcagttggtgagaacatgggtttctgatttctactccctccgtttgaaaatataaacaatatttatgtgtgtttctcaaaatgtatttgaacggaaggatttccaaaaacatattttctttttgctgataagaccaaataaggtcaacgacatgtattaagaagaagaaaagttacaagaaaaacacgacaaaagctatcgaggttatatgtgcaccaaagaatatgtccaagaaccacacgctaaccacacaagctagcacaaaccactgagagagaggagcctataacatcaaaacgtcccccgcaaagcgtggcaaatcatgccgagcctatgacaacatcacaaaaatgagactccgaaaatggtgccatcatataggtcatgacatcatggatgtcgacatcgcccatttaagaaacatgcggttttcacctagagaaaatcgtcgagaaagaaagagatgtaccctcgacagtgcctcaaggggttacgacgccttaagacatagccggtgctggcctagtgatccaccgggtgagacttccgtctgaacccctacaaccttgattgtatttaagaaggatgcccaaatatatatttttttcaaaaaaaaagcaaaaatacttatattttttaatagagttagcagtaatccattttttttattttataactatatgttcacgaaattaatctgggatgagaatttagattatttgagtccatctcatacataccaaattaccaatatagtaatagaaaaagactaaatcccaatacaactatttctcactttatcttttctgaatacaactatttattatttttataatgtaatgattactttaaaaataaactaaaataattaaaagagatttaaaaatgaagacggagccacataggaagtaaatccctggtatgcgtacgtacgggacgagcaagaggaggagggtgatgggcgctattggcctgagactgaagagaaggtataggtcagcgtgaggccggccgggcggcggcatagcgtcagcctcgggaagccgcatgctcgccaccatcatcgatcaccgcgttgcgtgcgttcgtcgtccccatctgctagccggtctcccggccgccctctccccaaacgtaaatgagcgcagcatgcatggccatcgccatgctagcttctttaatttcttgggcatcgcactagactagctgcatccatccaaccatccattcgagcaggtacaacatcagactataaaccaactataaacatattttaaaaagataaaggaagagagagaaaaatagcggtctacaagtctgtagccagctaaagcacgaattccaagacgtaatatgtgtataacaggtgagaccagatgtgaatagtatagtaagtaactattgtataaattggttattacattagctatagatgatttagaggtagcagtgggctatactattaaacttgctctaagaaggctgaatactgagatagatgagagaggagaggagagcgatgagaagcggactataagtttacaaccgacttagacacagtaaccaaaaaaatctatgagacagtcaggtggaccatatatttataacgaagagttaattactatatgagtgaactgagagataaactataaagatagagagagagagtagatgcaaggatgcgcccttttctttcgctttcgcgcggcgttcgcaactttgcatgcacgacgacggcagcgggcgaccaacagacaaacgcgtcctaacatcctcgtgcatgcctcttttagccatctactgttacgccaaaggttggcttagagcaggtataatagcagtctataaaccagctataaccatatatcgagaagaaaagagaagagagagaagaaagcgggctacagatttgtagctggctgcaacacggactctaatacgttacgagtgtatgagaggtaggatcgggtattaatgatgtaatatatttttataggtaactattatatgaatgagctattaaattggttatagatgatttgaagccaacagttggctaacttgctcttaacggggagcattattctctccaggtgcttaattaccttcgcctttgctaaacccttttttgatcgatcatatcttgcccatgcacacgacgctcccggccaccaccacaccacaaggttaacagtgtgaaagttcaattctgaaaccccagccaaatcaaagagttgttcagttgactgatttttaagtaataaaagaattaggtttcaattggtcccaaaataattacaaatttaggatttaaactcgtcccaaaataagtactccctccataggagtgtaattctagagtagtagttgtgtcattggtcacctcttattcaattcttttcacatcttacccatctcactttcatccacccatcttataatgagggacatatacgttattttacctttctcctaatttgtgcttcgactcctagaattatagatattttggaacggaggtattccgtctatttcaaaatatattgcggaatttgtttttgataggataaaggtttgatcaacaattgcttatgttgtactccctccattccaaaatatatggcataactacttttttttaaagatgtttcataatataatgcgtgcgtgcatgcatgacaattaatagcacattctctctcctaaattattatttttttaaatcaatatgtttaattctattgggtgcatgtattgtattagttgggatgattcaaacaaaaaggtgataataattatttcttggtcattgagttaatggtggttgtgccttatattttggaatggagggagtacaaaagtataatcatattaaattacttttgaagatgaatataataacatcaaatttgattttcaaaacttatattataatagagtaatccttcatgaaagtgttatcctaacgaaacaaaatatcgctgtaaaaatacatttttccttgatggctaaaacatatttttcctagcagccagacatttcgtcagcaactaaaggtaagtgaaaatcaactatcttcgctggcggcatccgattgccagcgaatatcaatttttgctggcggcgacataatgcagctaccaacgaaaatcagaaataaaataacaaaaatattttgatttttttaccgggcatctgtaacacaactatgcatcctaattgacaatttaggcaaatttttagattaaattcacaactttgtgatttgtataggattcaaacgcaaagacctctctctccacacatgtattacattaccatcttactatgaagtacttattatccatagtcagaatgctattgttttgattttcattgttcgaaacttaaaattcgttttttcctctctaaatgatttcgaattaaaaaaaaagtcatgaactactttgtatctacaactttgactcagatcatatgtccataggaggttatgtgattcatatatctgaaattttgtaaaatagatcttgaatcgtataacgaatattttgaaccctacgtgatctcaaatggaaaagttttgaactaaaaagttgtagatcaaattgagattaattaacaagtttggtacaaattttattttcatctgactttatatgaaaaatttaggtacaaatatatgtttttctaaaattgattttcactaacgaacgtcttaagcatcggccagtgaaaatcgattttctctggcggacacttaaggtcatccgctagtaaaaataaacgtgatgtttactggtggcactatttttaatccgcttgaaaaaaaataaaaagggtaatgctatgacaaaatcgttttttatagtgtatatcctgcattttgaaatggagcgaatattatcaatcaccttgtcaataatcaacagtaaggtagtgcttggctatgtgttactagtacaacgctgcttgatagacccgctgccgcttacttgctactgcgaatggactagccataaagcgttgcattgtagtaggattgtaacaggctgtcgaacatggcctagatcaatatatatccaaatatttcatatattatttttttcttctttttgacacaaaaaatattctaacctaaacttacaaaaaaattgcacttgctgatttattcttgctaatagaggaaattttctatgattatataagcatatataaaaatgtgtctagattcattcatcaattaataaaaaaagaaaaaatagaagttgcaattcatctattttaaagttacacttttctatatcaaatttagtgtacaacttgtgcagctttgcttgacaccttgggaaagtataggtgacggacgattaaaaaaagaatcaggcgattgataaattagcaaagctgcggatgaaaattacttcctccttttcataatgtaagtcattttagcattttccacattcatatagatattaatgaatctagatagattaacatcaa

SEQ ID NO: 31149 - DNA, 3031 bp, Oryza sativa
agcaggagctactccctccattccaaaatataaggcataaccaccccttacccaataaccaagaaaataattattatcatcatgtagtttagatcgattattctaataaatacaatgcatgtatccaatagagttagagaacatgagagtggaggattttaaaaagtaataatttaatgaagaagaggtcatagttaattgcctacatgcatgcatgtcttataatattatgaaatataaaaaaatggttgtgtcttatattatggaatggagggagtagcttattatatcaaaatagaccattgtaacacttcattctaaacgtcttttttagactaaccttgtaaaacattgacccacgttactaaaaggggagagtaagtataactttgtgatctttttcatggagttgagtggcgcgtactgatgaagcgtgctagacaggaggctgctctcacttttattcagactagtagcttttcggttagttaccggcagttaattagttagttttgtggctgatatttcttctgatggtccacactgctgtttgcctgtttctctgcccaataaagctaacttaattaattccacacataacctgccattgtgtatgtgtatggttgtacacacttgtattacgtacgttctcgtacaggtacaaataataacaatccattgcatgtgtccatatgtatgcgtggaatgtacaggcaactgcagccatgcatgagactagcactagctattgtgggctcaagctagtggtactagtatattacaagtttaacatcactttgtttacataataattattactagggtcaatttgtactatattattattagcggtactatatatattaacttaacaattttaccgcacttttttcacttaattattactaagggtcaatttgtacgtgtgctatacaatacgatcgatgaggatagtaggtctcgatcttctgatagatattgataactctcgattttgtgaaaacttaataaacatgatccggcttctgatcaacatgattcaaatcctgcaatcatagcaccacgttttctttggttatcaaccgtgcactgctaggttgacctcgccgagaaggctaatctctgcatgcgaatcaaagaacacaagtaagaacaacatagattgcaacacaattgcatatgaatgattaagcactcgaatttagggtttcacaaaccaaactagcggcaaaactgtgatggcagaaataatctaagcaaaacctgactctaaactatgacgactattaaaaaaatatgatttgggacgtcctaagattgccctatggcgcacacccccttgggcttaacccacgacatcgttatgaggcccaagacccaaatcagattcggagtggatgaggtacgtggcttgttttgctgattcccgacagcttggtgcgaattttgacgtgggaccaaaaccatctgaaagtagactccataggctttccaacaagtactcatgatccccgagattctttctagatcagcggttagctccgtttgaagttaatgctgtcaagaggcccaaatccgaatccaaaacgtgtagaactttatctcttatcatctatggaccaaaagtgacgtggtgaggtttgaatggacttggagaaggtattgatttggtccccaatcaacttatttgatttatccatgcatttcttatgctcggtctcatttcttttgcctatgcaagtacctctgcaaaagaaaacacactaaactcattgtgtagcaatatttgttcaaatatataacaagtaaatctaatatagaacatatgcacttttggttgatgaatacatatggtagtcatggtcatatctgatctagttgtgtccttatcatactcatcttcttgtttggaaaccgtcctcggtttcaccttgttattgagcctactgaacttatctttatctatcacaacatcaggtaaggaacatttcttgattgctatatggttggattctgaaattttgccacttggaaaaccacagcaccccccttcttgcaaaccaacatatagctcatttaaacaagtagagaaactagatagagaattatttatacgcatgtggttctctagacaatacattcatcgtgaaaaggaggtatagttaaattcgaacaaatatatactcgatgcacattatattctgctttactattataaattgccaataacatgcaaaatcatatcagaaggacatggcaattcagatctagcaaataatttattctctaaacagttgagtggacaaagatcatcgaattgaatatagccccaagtatttaaaaaagatagtaatttaaactctttattctcgctagcaatgtgaataacatgcttaaactcaacacatgatggctcaactatataattaacatgtccattcactagttgtggcatggatataagaaaagcatcgcacaaatcttgtttatcacataaacaaagtaaattattttatgacaaaggtatttcagcaattacctaccaacttttgtactacaccatcgatcaaaaaataaaaaataatttatgactagaaatttggatataggctatgtccatattcatcgctagaaattgttttttcacctataacttttatactattatacgtactagtctattttcccacaatcattttctttacttgtccttttggtgtctcaatttgtatgaagaaatagcataatcccatgggacgggtggagtaacaagtttatgttattacaatagtacttttcgaggcaaaaatgaaatatatgtgtaccacatcttttgattttaaaataagcatttgatgagttattgatgataggaaattttaaaagtataacaccatcttatcttaaatattaaatatttttgagtagatattccaagtacatgcctctcaccccttcacttcttgggctagcttgcatgcgcgctctcccctccttcacgtacggcagcatagctacgcttcgtagtact

SEQ ID NO: 31150 - DNA, 737 bp, Oryza sativa
ggcccggccggatagttagcacaaagcacaagcatgcatccaaaggatcaagaaagtacaaagcgattggacaaaaaccaaataaataaactcccaaaggagcgatcggaagatacgtatcaccgccctcggaaaaaaagttcagaacaggcatctatcacctgcgtccaactcgatcgatctaccaatcgaggattttttttttaaattctttaattgataaaattagaatacggtaccgttaacattattttttaaagaaaataggcattttggccttggcagtgcaaagtttttttttatgtacatataatgttacatagacgacgtggaaaaatgatttagatatactacctccatttttaaatggacgacgtcgttgattttcacatataatgtttgacaattcgtcttattaaaaatataaatattatttattttactgtgatttgttttatcatcaaataaaatataatcttaacttatactattaagtatctatattaaatttttgaataatatgaacgatcaaatattgtgcaaaagttagtatatagaaagaaatttttgttcaaagggatttaaggaatgaaaaaaagtataaatgagtcagcgcaccggactagaaatgcagacatggggcagtagaatctatagtgctaggtagtacaggctcccatgttacttgctcacgccttgcttttttctcgtgcgatcgagagcaccttttggccatg

SEQ ID NO: 31151 - DNA, 1633 bp, Oryza sativa
caaataaaatggttttcctacaagtaatttgtttataatatatctgagatttcatatttatgctgtcattaattttcatgactatctagtgtttctgatgactgttttgattgaagcaatagatgaatgtagagcttgccttgctggactaatgtaacattaatccttatttgtctactttataatgtataaagggctttttcatgacctgaattttgaatttggtgcatatgttagtggcaagatattttagtgtacaactaacatacttctaaatgatcagtgtagttaaagccttaggtgcaaagagaaaaaaagcctgtgccttagactcttgaagtgcaattataaaaacatgaatgtttacccctagcaacgaagcttcttgaagctattatgacaaacaaatagttaagaaatatataatgtgtcgtaatgtgagattagcaaactgcaattgaacaagtcttaggctgctctattatacatagtatacttctttctaagatagatagaacaagtgagtgtgttgttgggccatattttgggcccataggccaatatcccttctctagtttctattctttctacctggcaactagaggaggctggagcgagcttaagccctcaaggcacgcaattcgctaatggtgctgcacctgacactattcaaggcgattcagctgcactgccccttgcttttgggcctgtttgtggggagctttagatcctatgaagcagctggtaggaatctagttggcttctggcttctcgttcattttctagattctgcaactacagcttcttagaatctggacaaaaagctggattgtttaggggagtttataattatgggagaagctgcagctaccaaaagctcttccaaacaggccctttatacctaggcgaccgctttttgtgcttttggctgcgctcaattactactgcttctagtccaaatactaggtagttggtttgacttcgcacattgtccaacacaccggtttgactactcattctcattataacatgctagtaaaacaaaaggttatgtgctagtaaaagaaaaaaggtcttgattctacaaactaaaatatttttttatgagtgatttattttatgtgtccaaatctaaatatggaaaatatgttagtggccaaaatcgaagaatgtttgctcacgtgagtcataaatacattgatttttggactggatgtagacatgtatgtgaactgactaatttatcaaaattaattctaagtggtcatttatgtagtgttcaaggtgaatgctccgatgctaagacttcatatgcaaatctctatgttaacacttgtcactgatgtttcagtgctgggaagaagctcacgatatcctatccctgtgtgatgcttaatgttgatgttgcgagaaacaacactaatgatcaatatcaagtaaggaatacaagtgttattcataaagttattacatatttagaatgtgttattttgcttactgactattggaaagttgttcactgattgatttgtttattatcctaccagacattgaatgacccagtaaataagctatatacaacacacagtgaatgttccattgaatttgaggtagatggaccttacaaggtaaa

SEQ ID NO: 31152 - DNA, 1183 bp, Oryza sativa
tggattgcattgttaaagtacatttttttattgcagaaccaaggaattgatatttcagacaatgagttgcttgatttcatatctgagtctagcacaatgagtaaatccctagttgactatggagaacaaaaatcatgtgctgtaacaacagcaaaaagactagctgaattcctcggggattcaatggtaaaagacaaagggctgcattgccaatacatagttgcccgggagccacaggtaagtactgaatagttcaacaattaacatcatgcacttacccattcctttaaattttgatagttacggtaccatatttcaattttggatagtcacggcatgttcctttcagtgggcaaatattccctttattttgttttcatggaatttgtttattctagttttcatgatttggcttgcttttttccaatattcctactgctttgttgacttgctgaaatcatgtagggcactccagtgagtgagcgtgctattccagtagctatctttgagacggatgctggtattattttaccttcaaatcatgtttttgcaagagccaaacttttcaatcacttacattctcttgctatccttgtatcttacagaaattgcaaagttttatttaagaaaatggtgtaaaatctcctctgaagcgagcatccgatctattgttgactggtcttactataagcaacgcctaagctctgctattcagatgattataacgattcctgcagcaatgcaaaaggcaatatattttttacttgttactttgattatattatatactttttacgtgtcccctttgattttccatgacatttgtgaaatcatgttgctacagatttcgaatcctgttcctcgagttcttcatcctgattggttgcacaaaaaggtcagagagaaagatgatcgatttcgccagcgcaaactacgtgatatgttcaatcctttggagaaggacaggggggtgcagaatttggatggcacaggagatatggaagatttattaccgctggatggtggtatgagaaaaagtcatgtacccaatggttttggaaaagaaaataacccaaacgacgccccatcaacagaagttggttcaaagcatagcaagaataaccaaaaatctatatgtaggtcaaatgacccccttgcggtacatattcaaaatgatgctgct

SEQ ID NO: 31153 - DNA, 742 bp, Oryza sativa
atttttctatctataccacaggtaaccttttatgagaactttgtaaataggtaatgcagtatccagtctagcttttgcaatggattgttatttttatactctggaatactatggtactattgtccatttcttttctttattgacattctatgtactttgagttcatttattcaagcgctattattacagagtcaaatactagttcttttgtatgctctctgggtcccaagattgctcttcctagcagttatttgtgataattaatccatgtttatgctcctaaatgtatggtagaataagcataagttactcctacctgtattttactaaccaatatttgaaaccttgactgcactcatacttgatatatggttgttttgatttggaaactgatctatggattctcttatttccagcttgtcagaaggaaggggtgtatatgtcatgtacttccctacatctttcagaatacatgcagtggttgtcaatccgttccgcaataaagagctatcgccatcatttcttgaaaagcaatatcgagatgcttgtcaagctcttggctctttgcatgaaaacatcactttccttgtaagaatgaattatcgtatctgaataaaaaaaaattgcacgtgctggtttagcatgctaacttctgactatttgattccttccataggtggattaccacacatcaattgatgcaggtagcaagcatgggcaaaaaatgttacttgaaaacagg

SEQ ID NO: 31154 - DNA, 19974 bp, Oryza sativa
cttgtggcctttctaccctgtcatagtgtacaagatcatcagaacataggctaaaaaaacacatatgacagctaaatttacttcaccgcaaacttaactgggaaagagtcaaacaagagtagctttaaatacatcatagaagcatcttagcccataactaaaaaggtggatactatataggagcatcttagcccataactattaagacggatactatatagaagcatcttagctcataattgttgcgatggatactatactctacaggtacctttttacaccataaattgattcaaatgcctctgcagcatttagttcttcttcattcttttcaacaacatgcaataggtcacttctcacacgcattaattgctgtacggtatcaaactggatcttcaaatatttcctcttcaaaccagaaaggtggtttttctgaaacacaaagagagagttataattaccttccagaattggcccaatcaaatctagataataaaaaatggcatatgaataagaacattggcacattggtgaaaccagtctattcaaagctttcagggaccacccaacccatgaatcttactctaccataacaagtgttagtctctctactatataaaagaagctagtggtggcggtcgctatgcattcctccaccacctttgagctggttggatctcccgaggataataagtatatcatttgtgtatgtcgtttgtaagcctgtgcttgtaataatgttattatggattgatattgtttgttacaaattagataagttttcttctaggatttaaataaaaatttgaagataaacatataatatgtttatttgagattcaatgaaatgcatgggtatttgacaagttagagtgttacttctagtcaaagtcaaaagctccatatggatccatactagagtccagctgtaatcctaagtactatttgttggaaaattaatttgttttcttgagaagaagtcaaatttaatttgactaaggtaaaatgcatgtagactaagtgaattgcttcaagatttcactagaactaactagaacatgcaagtactagaggattggtgatcagctatctgtataaaacctatgtcagcatgcatggagtaatcaaaatggaaatttactagctagcggtgtataggttggagctatgttgtgtttcaaagagaaagaaggaacttcactactaattagttccaatattatgtagcatagctagttttgagctgttagatgagttgtaacatgagctgtaatattgtgtaactgtagcaggtcggttactgtagaaaccaagttaaaagtcctatagaaagacatatatccctatgtaacaaaggtcttgggcatgccagtgagatcagtgaaaatgtagctcctttgctatactcttttctcttgctctctgttcatgctatgagtgaatgtctatcctagttttagagccaacactattaatagagtggggttccaagtacaacactaaattattttcccaaattcctacatggtatcaaaggtgggtcccaaccctaactcaccataaagtttcagcccctttcactaaaaatgaagtttcaaccccacaagtcatcattgtcaactttctgccaaactcttaaccatcgttgtccatgacatacttctcaaccaggttactggtggctcccagcatgaattgcttgtcactgacattgatgtggttaggtcatacccaaccaccacaatgtaatgtgggagcaggtcaccacagctgtaacatgctagaccaagtcaccaagcacagcaagcaggagatcaagtcagctgctactgcttgatttttggcctaatctgtcggccctggtttttaaaaagatcaagattttacgtattattattatcaggattttcaggatgttacaaaatcctccatagagacatgtgctctgtggcggagactggggatggttgatgctgttggtttgaactgttcacaggaaagctgtgcagcctcatcagttattgctttacccaagagggagaaagaggaatagacaggaagggaaggatctgtgctccatgatgttctgatagtgctacttgttagatcaggtgaagtcaattgaggacatgtaatgtgctttgctgttcccagtgtatggtattatctgcgttgctatttggtgcttgatcatattggtttgtgatactatggccagtactatcatgggaatgaatgattgatgcttagcagatcgtcaagattgtgggagacatgcagaaaaatatgttcatggtggtgaacttggcattggaggtgaagccctactggtggaagaatcgcatggccaagtaccagaggttatggtcatatgatggaagttataaatataatggtgatggtagagatgcagagcaggtgtaggtgcttaaacaggagtagaaaaccacttaggggaattgttgatgttaagttagagcctaatacgagtctgagtgcataatcttatgtgaatatgcattattgtccaattgtaatcctaagcactgtacatgaagtgtgtgggatcttaagggtgcaatggtgcatacatgatcattcttctacaacaaacagctaaggtaaaaggacaaaagaaatcacaggtgaagaactcttaacaagatcaaaactcttaaccatccaaatttatcacaacaatagcatttactgatgcaaagaaaatgtagtgaattaaacattcaaagcaaggcacatactagatcaagatcttctttctcaataatttctatgtcagcaatgtcgccttcataacgtcgcctgagatatgcctcgacttctaactccatcttatcctgcgacattttaaaattccaaaatatgatatctgaaaagaaacatcaagcaacggagaaactaaaagtcatcttatgattcaaacacaagctcaagctcaccttagtcgcagcataaaagtaagggggaaatttgtatttcactttaaatgtagaaccgtcctgcaagaaagcatacacgattagacgtgacaaatcaaaagttttttttttgccataactgcaatttacctgggacacgaagtataggtcaacacagctgtatatcttcccagtgtcctcatcctcccatgatgactgcaggtatttgaggtgaatcaagaaagtcacaaaaaggtagttgattacattttgcaaaacagtgagagattaacttaataatcttgtccaatttctacggatctgtccataacgtggatggaccaccaagcttaataggtgtatccattcagtgcgggcgttcattggttccaccagatatggcaacagcagcacagtttttatcatattgtcaagagattgtattggagaatcgtttaagaaacaacttctccatgatgtagctactttattttttttaccaaaaaaagaaacattataactgtgtcacaaattatcccacgagcatctagaagcgtcaaaggattgactgttgctattagttgcagtctgtgacagcatttgacaaacatcccccaccacacccacctggcaaatcaacgtgctagaccaacgttagcagcaactcaccaccggcattgctcagtgatttcacctactgcttactgaactaaaacaaaaggaggctcccgaatttcctggtctgcatactccgactgatcgacccatttctccagtcatattccacttcaaagtcagaagcaggtcccaacatttacaaagttatgccgctagtttccagatgacactcactcccaattcaagctagaaataatcccagagagagggcttaccggggagaaggtcaggagccatccgagccggcgctcgctgtcggtgtagggcgcaaagccaagcctgctctccaggagctcctccgctccgagccgcagccgctggtccttcgccgccgacgacccagaccttcaaccgccttccctttccccttccccttcttctccttcggccgacgggcttcggcggcgaccatcgccgccaccgccgccgcccatgctccccagcgcgcgcgcgcggtacgcggggcgcggggagaggaggagaatcgcctgcgccgctcggctctgcagcctccgctcgtgctgttgtgtgtgggggggaacggggagaaggaaggaaccctagatcagatttgggttttgggtggggcggcgaaatgaaatgggcgccaagtccggggcggcgaggcgggggttttcccgcgcgctgccaccgtctcatcattttgcatcccggtcccttggtttcgttgttttcaacttgggagcccagcccacggcccttggcaagactaggcccactttatgctttctagctggaggcccaatctactcaaggccttgtacatgatgggtcagatttttaagccttctcggggtcaataaatccataaggaaaaaagtatatttgactccctcgaccatgggccgagtatgattggagccctccaaccgagtatttcacatccctcaattatttaaaccggtacaaaacaactaccataataatattgtggggtggtttctggtcaacaagttgagtcagcacgggtttcaacaaccctggtcaacacggatgcgctcccccctcactctctcaatcgtgcatgcttccaaaccgactaaaaccctagacaagttggggcaaccagaaaggcgatgcagggggcggcaaggttgggctccgctctagggcttcgcagctgtcgttttggttggccggaactgaatatgtgcaggtacacctcatccctcccccattcattcccttcccattttgtcccctgcagcatgtggttttatcgatttgggtgtgatttctaccgagcttaaatttactaaaaaaaggagttgaaatgcattttatatgaatttctaaagttcagcttatctaaaactaatcattttgtagatagtatttttaggggcatttgatgtgaagtacgtatactattttattttactttatagaagaacataagttggtggatctatagaaactgagtttgttccaaaatgacttaaattgaattctctatgcattttataagtttgtgcaagccttatgtgtgatttagtttagatgagttttagaggcaaaatttgtactgtgagtgccaagtttttattccataacattaaagttcataatttgatgagttcacagaaatttgatttactctaaaatgtgttgttttcaatttgttatggtttttagaagtttacatgtttttctgttgaaaatataaaagctttaggtacttcatttagattttttccaaattttaaataggttgggtccacaggtcagtgagaccaatatgcaaaaaggttcctaggtttgaaccaagccacagttctaggcccatactccctccatactcgtaaaggaagtcgtttaggacaatgtttaagtcaaaccttaaaaatataaatcataaataactatcgagttgttgagtttgaaaatgtaaaaattatatgaatagatttgtcttgaaaaatacttttataaaaatatacatatatcactttttaataaatatttttatagaaataagaagtcaaagttgtattttgaaaaccgtgtcgcggtcctaaacgacttttatacggatcgagtatgtcattgagtggaaaggttagacattgagttgtttaaattctcaaaacaaagtcgtgtttccttctcccaccgtccgccgcctttcgtcccgatcctgttcggattctcctcgcttttatttatgtgttcggtttcgtggtttctccttctcctcgctcgcacagcttctccatggactcgcccgccggtacagatgatccacccccgttcgcagcctccggtcattactcattacggccacgcgatcgtcgtgctccaccctcaacaaacccacgcaagcgtccgcgcatatcgatccagaatgacgttattggcgatataggtgaggcgcgggggtatgcgcggccgatggggctggcggccgtgttggatcttgctctttccccttccccttcatcggtgaatgcttttttttttccttggtaatactaggctgagtttgtttccttgttgactcctgtttcgacagatgctagatcggggaacggcggggcaatcttgctgctgtttgagacgccatcgggctttgcaattttctcttttgatgggatccgcctcatcgcaccaactgccatggaggcatgtgctcgttatccttccctttgttatatagactgatgtgctgcattttggtcatggatctgattttaaatttgatttctctctgcaggatatctggcaaaactttgccatggaatatagggcaaaatttgtaagtcctttcgtttccttctgattatatattttttctatgggttgctcgtccgtgactcgacttatttattttgcattgaatggatggattttaccataacatcattgttcatcagttatttccttgcctttttaaactctgaaaagtgcataagtttagaacaacaacaacaaatgagaagaaaaagaaaaacaaagaaagattaacggcatgtagtcactaaatccatctgaccagccctggggcaaatgagattctatcttcctcacttctctgcatcttcaaactcgtctctacctttatctgatgttccaatgtttgggttgatttattctcaccttgcctgaactatccttagccaggccacaatgccttccagcttgaagtagagcacagaaattgagctcagcaacagagggaatgaaggcactgtgcttccctccagacagctcctagagcatagccgatttcaaataggtcctgtagtagtagcccagacagttgcatagcttgccttcagcagtggctgcaagggaccattgtagagcatgacagttgtgtagtttcttccaacgatagataatctagtctgacctttgattgaaaatatcatgagaaaaggatcattaccattggatttgactccaatcctgcgattctagtcgaacttgttaaagaaaccaaccaatttcacctgcttccctggtagattctcagactaggatcaacactatgccaatccataagccatgtagccaacaaattaggaacttggtttagcttgcttaggaatagcagccgcatgattgatcttgatggacctttaccatcaacatatcatcggtcttaccgattctcttccaggttgtgggataggttgcaccctgaccagcatttcctgctcttcatctggagcatatgttcgtgcctccacttgaaactgcaaggtggtggggatagtgatcaaccaagtgtattccgaccctgcctagcctcctagaagcccagttaaggttcaaatcttgtgatgttctacgccaccattggagggccaaatcagatttggtggcattcaaatattgccattctggattgatattaagttaaaagttggagtaccgcatgatttatatttttctaactgacgaaatcaatagaatgtttgtaaagcatgttcctaaaagcatggtaacaaaaaggtttcttaaaagtcgattggagcaaggtgaaacctataggggcatttggtacgcaccactttgaaaccaaagagcaccacatttttgaaacatgtcacattagcccatggtcttaattctgaattgaaccgcaacaatttgatagatgaacacttaaagctcccaattgtatcagattgagatgcattacattgcatcaaacatatattgctaactgataattgttttttcccgccattaacatgctcatccctgtttgtttctttatcaggtagtttggcgtcttgcttttcaagtttttacagacaagtctctggcaattaactgtgatactggtgtggacgatcagcttaatctcatgataacaaagtaccaccgcaaaggggggaaaatagctgttgggaaacccgaatataaaacaatcatagaagcaaacctggttagtgcaagctccctactttgttgcatcatttgttctgagctgcattttttatttgttgcatcatttgttctgagctgcattttttatttacattattttcagggtatttcctgtctgtatgatgaatttgtgatggaggtgatgtggggtttgacgaatcttatgcatagtttagtccctgaagaaaactctcagctgagtaaggaggaccgtctccagatgagtcaaggattaaaaatgctcctgaatcgttatggatttgatgtcaaaccagggatggtgagcttactactagttacactcttatagtttgttcattgtgcatttgaaaccttcatttaccgttggtgttaatttttatataaaagttttcatttgagtttttccctattactgacgaaatgataccctttgtttccaggttaacaaacgtattcttgaggcagcatctgacttgtatgattgtgatgattgtgagaagaaaaataattggtccttgcgtcgtgctggtcggaaccttatggatatctctagcattaacagtgaggattggggcctgttgaaactttctacagctctgatgatagtatgttaccctgaagaaaagatcatagcatgcttgctgaaacattctacagatttgctgatagcatcttaccctagaagggaagttatagaatacagtcaaaaggtaaatcgtaattatttttttgttgtgttccagcacatctgatggtaacttttcattcaactaatgggccaaagcattttaatttcagatgttttcaccagatgtgctatctaagctggtaactgatgcaccaaaatatggcatttggataaaaaagcgcacttccaagagaatccatgaagaaatggtatttttgtatcaacaaaggattgaaaagcgaaagctcttggccaccttgataggggaggctacaaaggtttatgaagctgaacaagcggaattgctgacaaactagaagtgaccacaggtattctgaagctgctatctatgcccaagatgacttccagtgatttccagaccaccacttcttttgtgttttgtttatctcaagttaaatttgggaattactgatatgatcagtgtactgtttggtttctactttagacaagttagactgtgcttctccaagctgctatttgttttggttttggtagtattggtttctactttagacaagtcagactgtgtttctccaagctgctatttgttttggttttggtagtactagctgaagcgcacaatgccgcgctgcccggatcaattgaagtccagtatatatatactatttaccaatggcattcgtcttcattcatgttttggtctatatcccataaactatcattataaaaaaaaattggcacataaaaaacatatagtatatagtctaaaggaccaaactaaaagtatagaaagtttgaataaaaagtaaaggaggtaaattacgtgtcaatgacaatgagagtttacagaggtattgtaggatcgtaaatggcatttcccaccccaaaaactagctattgatttgtccttccacaatcaatgtgggactattcaacaatcttctccttcacacattggtaagggcctttctcaccccttcacacattggtaagggcctttcccaccccaaaagctagctattgatttgcccttccacaaccaatgtggaactattcgacaatctccccctccttccacaaccaatgtggaactattcgacaatctcccccttcacacattggtgtccctcagcccttcaccgtatacgggcccccacacccacggtccattaggtatacgggctccgcaggcacctacgatccatcaggccttcacacattgtgtccattgggccagagatgttaacctagccaggctctgataccaattgtaggatcgtaaatggcctttcccaccccaaaagctagccattgaggtgaggggctcccccacttatatcttaggtcctttgcccttccataaccaatgtgggactattcaacaatcttttgggtgctacccttttttctttgtatgcttgggtgatgtttggttggtgggatggaatgggttgggacagggcgaacccgtttttccgttagatgggatgagatgatcctgttagatgaaacttccccttatatccgggtcgaggctgtccgacaaattcgagcggacgaacttgtcccacatgggatgggcgcacagcgtgagccccgttgctacattggatccgacgcaggggatctccggatccgtcgtgcgggctctggtcgactcgctccgccctcacggtcgtcgagcaactcgaagtaggagagcatcgtgttgaggagcttgtgcctgactgcgatggtggccgctatcggggccgaggccgacaacaccctcctcggcgcagcggacaagacacaagcgcggaggtggggcctgacggcgacgcggccgcgggaggcgaaggagagggagagggagccagggggagggggaggacaagaggaggctgtcacacccggagttttccccttttccgtagtttctaaatcattaataaatcgtctatagaaattactttggttaaccaggaggaaatccaaattaacaatgcattaaacaatcggaattgttggggagaaattttttcgaattctctttgctctaaaatcattaacaggacttaaagcggaatattcagagcaccggaggcaatgtggttaatttaatttgtcaaattttgagttaataataattcttcttttcgcctttggtcatgaatcttgcccgattcactcccctctctgtccgcggttttgttttgcatggcgaaccgtatttgttttcattcgcgggggcgtttctgttcttttcctaaaacagcaccgcatttgtttttctttttgggaaagtccttatcctaatccctttctttttttccccctctctccccccgcgtgcccctccccctagccggccgaaccgcctctctccccttctcccaatccgagtcccagtaggtcccacctaatccatctatttttgccccctataaaagtattcataccccctctattttccttgttttcccacatagttgcaaaacccaaaccctagccatcggccgtccctcccctgtcgtcgtcgctagtcgacgctgtcccgccgccactcgtcagtgcccccgccatcgccgccgttgcatcgccggtactctgttctcccttcccatggatgttttagttgttgcaaacatcaattcatctatctaatcttttccgttcaatcctatctagcgtcgtcgtcgtcgatcctgagctcgccgccagaaccgccgccgccatcatctcctctccggtgaggcttctgtcttgtttttagggctagttgttccttcacttttgttggcttgcgccgccgtgtcgttgccgtgccgctaccctagccctagccgccgcaggtagccaccgttgacgctgcctcgttccgcctagccgccgctgccactgccgtgccgccgcccagctgccactgccgtgtcgctgcctagccgtcactgctgtgccaccgttgccgccaccgtgccgcaccgctgccaagccgagccgagccgccctacccgtgtgccgacgtcttgccgtgccgctaagccgctagccgctgttcgttcgtagtttgaccgaagctttagttcattcggtcgttcaagtcattctttagtttagaaccgtcctgagccaccggtttggttgaccgtttggatggtcccgtgacacgatgagttggtatctcgtgaggcttgcttatcgatgttaatttcccctttgatctattttatctttgggcaataatatgtaataaatgactaaggtttttcggttactagtaataacacagttcatcttgtaaattcatatctaaatattctgagctccgttttaacccgttcaaattgcagtgaattcgttaaaatgtatagaatccattaaaattggtttcttttgatattttagtagccttattatgtgtattgcttgtgtgctttgtgtgtcatttagattccggctgttccgatgctccagtttattttgaagtggtcgccgaggttccgtcagttcaagagcaaggcaagtcatacatacatcattgatcatattgagcctattttacaaaatcccctcctttctattaaattgcattgggtttagaatgtttctattattctcagcctgttgattatatcatgccattgacagcttgggttataattgactagatgattggtttaggaatgcttagccatgcttagaccaattagctcacaatgggattcattataatttagtccttaattatgttatgatgtaccaccatggttctggtttaattaaactaaaatatgctttaatggtgggttgtgggtacaatgcatgattgattttggaagtcgtgcacatgacaattaaggaccggttctcgggaatccctgaaagatatactcgtattgaccacaggccagatgggctccaggctaaatctaaagtataatattttctagttaacataccatggcaagggtgggcgtgatggagtatggatggaccgggaagcggtctatgctgctttcggatttacctaggcacgagaggggactgcccactgcctgtttaggggtggggtgaaacctgaggtgagtatgttggttaggggaggttatatggagggttttgtcacgatttccccctttgcagtatcacggtgatacttcggggcatgtaacatgtgtagaatcgtgtcttgtgggtaaagctgtacatatctgatcagagtaaaactatttgaatagccgtgcccgcggttattgggcggtcaaccagctcaccgtgattagtctcatcttaataatttgacttaatgaactggtgtagttcatgtggttttgattgggcctattgcaacgtggttttagcgttgaacagtgttcatgttaatactacctaattatatactgtttttactgctttcaaattatgatttataaatgctacttttactacaaattatcctatgagccattcatttgaatatccttgcatcatgcctccccgttgatatgacttgttgagtacgggggttgtactcgatcttactttatttctccctcaccacagaagtagagattggtttagatggtaagttctctaaggattgagcttgttccagacgtcaaggttttgcctgtggattatggagaaaacttcgcttttgccgagaagattaagtctagttcttttgtttttccgctgcgtttgtgagtttattttatatagtcgtggaattgtatcaaattgtcgtttgtgtactttggctggtcctggatagaagtttaatacacattcagcttgaaattcgagttgtagaatttctggatgtgacagaggctcttcccggcagccgcgatggcggagagggaggtgaggacagaggcggcggtggccatggttgctcctcctgctcacttactcacgccgctcctccaccttctcgtcgccggtttgcttgctcgcccgccgggctgtagtcgcgctgcttcgccttgtcaactatcgtcagtagttgcaaacggcgtccatcccatccctccctcatcccttcaaccaaacaaaaaactaggatcgtcctatcctacaatccaatcacgcgagtggaatcatcccaaccataaaattagggatggtttcatcacatcccatctagtcccagaaccaaacacacggtagaatcgcactgaaaaatgctaaaaacagaagacctacatgccaactggtggttcatattaaatgcatgcacaactaaaataaacaggtagaaactgatcttttcaagtgcaacatgcagatgccctacctccatcgtactacctccatccagattgaagttttgtactgtttatatctaacgtttaaccattagtcttatttgaaacattttatgattaaggcctaaggggcggcggcgaggtggcgctctccaggtgcgacgtgcaatggcggcgctggggaaaacggccagcttggcggtgccctgtttggagatgtgagagggaaaagtgatgtttctctaagctctaaaaggtggtggtttggttgatggaagagaggtgcctgacatgtggggccctgcttgccacgtcaatagaaaccgcttttaaaaccaccgaaggagtcaatttacactggtttttaaaaatgggggaggcgttatatctgattctgtgattgagggagaatttaatcacaagcaatagttaagggaggcaaaatggacttattcctacaataagtaatgtataagtggcattttaaaattgttatatcatatttgtatttaggtgaaggagatatgtggagagagaagaaaagcaaattatagatctgtagttaggtacaacatgacatccaagagatcgacactatgtgtgtgtgagaattgagatatgccaggtagtaattgaccatactttttaattcgctataatcatcatctttgcctgcccatgttttggcgaatttggcttctcatacccattaattcctacttaataccacaaagggggcggggattctggagtatcttgttatatttttcagaccatcatatagaagacacgcaccatgctttgtgacatttcttataataatagtcaagttgttgaagtagaataacgccgccacacattaagcatgtgatgtgcaacccacggtagcacccggaaacacgccgccatagggagtgggtagatgccgcctaacgaacacccgggagggaccccatcaaggtgaacgagcgtcggtttattctagactcggcaggctagctaggtgttgacgaccaaatttggtaagatgtgaaccaggttcgacattgggatcgaagcggattcgataaagagatcgattcgaagaacagagcgtgaatcggctgcgaaggcatcggctggagtctacatcggctgagatggatcggacagaggatagccgatacagccgatggaggtgatgcagctgattccgatgaagacggtttcgaagctgtttccagaatcgttcaaagtgcttcatgaggattgccatgatggagataaagctctcggataaggcaattgtatctattagttaggatatttcatgtaatttccttagagatatgtttggacaaaagtctgccgcaaaggcttatggtatcttagagtttgttagagataagtgtcgtgtccggcaaggacatattttgtatctcgggtataaatatgacccgaacccatgtaatcaattaacaatcgttcaatacaatctcggcgcatcgccaccctttttactttcgtttatttcgatgagttcttgctttcgggttgagctgcatcgattcgatcttcaactagaggtaaaacttgttatggcggcttgcgttatcggggttaatgcttccatctttatgatactttaaccctgttcatgtaatccgtcgagttatcatatacatgctgcaatctatactagttgtgctatataacttgttatcggctagttcttattgttaggaaacaattggtagagttatgttttgttattaatctagattgtatcgtgtatccaccatctcttgcagattttgatcatcttgcttagatctcatatttgtctttatgcttaatgctgcatcggttgagttcgatctattaagtagtttttataattatgatatctggcttgttttataatcatcaagagagatagtattgaggtttcagccgattttacctgatttagctttatgtcttatatgcttaattgatatgctaaatctgccctttatattaagatcttgttacaataaagtatattaggcttctgtgtggtatattctatctgttttaatatcttaatatagagtggtatcggagtatttgccaatacatgctaaatctatctgatcggctatgctataagcgtttataatctttatgttaatatatatttcgacctaaatgatttatactgtctcggcatggcgaccaatctatcccaatcacttgatctaaatatacatcgacatactgattatatagcgttaatatctacagccgatcgaatagatttagtcttatcttgcttattcatagctgccgatcgattcacatcgtcttgaagataaatgatatgccatcggcgactagccgatcggctatcgtttatggatttaaccgcggttttttttgtctttgtttcttgttgtttgcaggttcaaatcaactggcacgctcataaacctaaaggcaagattttggatctgtactgaagttaagtagatcttcctagccagtgtgtgtttttcgcttcaacactagggcgtcctctaacaccgtagagatgagagacgacgagcaattggtggatttgagaacgataaacttgggataggtagcaagaatgagtgagatgtagaatatataagaaggtttggatactaaattgattttgacgattgattggttgttgtttcaatcggacttagaccccttatatttataggagggtggacttacttctgagggtttttttcatatccaattaggtgtggaaaccagttaggactctaaaaatctcaggcctaagcaagaaaaatcgagcaccacaaatcagacttggagtcagactatgtcagtttgactggccaaatgtcgttggtggctagtcagaccggtctcgcgtggcaactggcaagtctgggttatttccaaattggactgtagttttctttttcatttgagcattttcacgaatataatcatctccaatttgtgaagcatatatactgcaggaacacatgtcaacagcttggtggcgacaatacttgcccaaactttgtacccaactagttgaaatccttaaccaatttttaccgtagaaattaacaaagctggacgcctaggagattacaggagcaagaagagctcgtccaattccagtgtccatctcaaaaaggaaaactccaatttgtgctactagctaagtgcaattgatggtctgattttaacttagttgatcacaaacagttctggagggtgctccactgcttcccccttcttttttccaaaaccaaaaacaatatcagaagtttgaaattacccagcactaacacggtgcagtactggggtttacatatgatacactctgcactagctaattcattttcgcttctgccgttttgacgacgagctgatgatagagtgggtgacagtgcttgctaggctagctaagcactagcagtggacctgcgagcttacgagggggaagtcgaagggcgtcatccaggcgtaggtgaagcgcacgggcggcgcgccgcggcggatgactcggccaccgcggagcacgcagcgctcgtcatcgacggggcggatggcgcgcgggtccaccgactcgacgctgctgagcccgtagcatcgcagcaccaccctcgactgcgcgcaccggcaccggttcgccacctccaccgcgtactccggcttcccctccaccacccgccccgtcgccctctgcctcaccaccaaatccgccgccctgcacgccgccgccgccgccgccccttcgcctgcacgcccacaattcgtttatattagcactgcaatgacaatgcagcaactatcaagtgccaagtaatgctagtactataattagcaatttcaatcaccttggctggcgtcgcagaggagggcgagggagacgaagacgaaggccgccgccgccgccgctctcgccatggtcagccgaactgctgtgagtgtgaggtgatacggttttgatttctcgcgagaaggcctcagcttatttgtacccactacccggatgcagagacatggatggatcgatcgatcgattacgcttgttggataagggaggcagggcacggcaggacagcgagaggaaggaatgggttgtcgtgcgtggcgcatgcatgtcatgtggcagggccagacgacgacgacggtgaacggtcagatgtccagcgcgatcacgcatgtgatcgatcgtctgcatgattgacgatcgcgcgcgtcgcagtctcgcaagagggctggctcggtttcgcctgtagcaaacggctcataggttactgccgtagtagtactagtatatactcactggcactcttgcaggtgtcagctagcaacgggcggcgcggtttattatgctactactagtaagtgtaaagctcaaacttggtagctataaacttgaattgagacgatacatgtaaacgataattttgcaacctagctacagtagataggaaaacatggtgtacgattggcttgattgccaatgcatgaacacagaatcacgataatttttcttcctctcttttgatctttctgttaatttttttttctttttgagatggagtgccctggccatcgtgaaccatgaatccatgatcgctgtcgggaactcgggatgatcggcgccaagtgatgatagatttgctctgttttttcttttgcgacgagtttgagttcacgcggcgtgcatgtgggaaccaggacgcatgtgcctgagtgcctcccaggggcgaagccaggataggttgtcaccggggtcactattaattaacgatcctaacaattggctatagcttctaataattttaaggttattgttgtagtagtggttaccttttacatatcagggggtgtttagattaggggtgtaaagttttggcatgtcacatcggatattatatagggtatcacatggggtgatcgggcactaatataaaaaattaattacataatccgtcagtaaacaacgagacgaatttattaagcctaattaatctgtcattagaaagtgtctaccgtagcacaacattatcaaatcatggagcaattaggcttaaaagattcgtctcacaaattagtcgcaatatgtgcaattagttaatttttagcctatatttaatacttcatgcaggtgttaaacgttcgatgtgatatggtgtaaattttttgtgtaggaactaaacagggactcaattacaaccacatcgttattgtactagattactatatttgggaaaagaatataacaacctcttatatggtgaaaatcacctttgttatattcccccggctcatgcctcatgatcatgtaactgaacttgaaaaatcaaacgtttatatttcaaaactctaatttcctcaaattcagacttaagagactaggttcaaccaaattgtgatgataatcaagaaataataataggattagttggctactggagcaattaatcctaaataagggtcactttatgagcgccagtctaaaacgtatatatatatctatgtagactgacatataatcacaattgctaactaattttctatttgctagctgataatagtatcgtttcttgccaccagttgagctttaacgaaacaatcatcggggtctagtgttttctttgaccggtcatagctgtaaaatagaaaggagtataagggactcggaagaaatcatcggggtcaactgaccccaataacttgctatagcttcgcccctggtgcctcctttctcgtctacaggcctggtttttctaggaccttttttcgccatcaacatgtgcgtttttcttgtcactgtccccttcttttgtttttttttttggcagcacggctccagattatgtgcacagggtgcttattcacacatctcactggatgggttgcccatttgcccgtcatcaggaaatttccagatcggttacattgtatcgtttcctaacaaaggttgcatatttgttgcgacgtttggaaagtcaaacaatttgaagcaaatcgactcagatcctgtttcatt

SEQ ID NO: 31155 - DNA, 2323 bp, Oryza sativa
tagagactaaatgatcccaacagggccttagtcataggtggttcttcgttagaaaaagaaaaaagttactggccccattggttcgcttattcgtggaataagccaaacaacatatttgcaagagaagagtaatttatgaataaaacttttatatatgtgttcttagcgatataaaaggaaaggttgaaaattaaactttgatgaataaccccaaaatcacttccaattttaaggttgaaaattcaaattttggctgataagcataagcataagcgaaaagatgaggccgtaacatattatcgcagctcagcaacacacttcatatgactcatattaatcatataagaaaaaaataactaatgtacttccactggtggagaaagcgtttgtagtcccggttcgtaacccccttttagtcctggtttctaaaccggaactaccaatccaggactaaagatcgagttgatctttttttttgcatggccctgttgctgcatggtttatatatatatatatatatatatatatatatatatatatatatatatatatatatatacattaaagaaaatgtgtacacatgcatatagaaaaacagacatgtattaattacaatccattatgatgtcctagctagtacgatttcgacgtagtagtagtcgttatctcagaagctaaggacctatgaattgtatttccgtcgtagtagaattcacccttgggatcaaggatttgttcgttgatgaatcccatgagttgttcttgaaccaccgcgataaattccttgtgtgtgatcaggttatccctcatgcgaataaactatatgaatgtatgaaattaattagtaattaaacaacaaatcgatacgtaatgaaattttgaatttatttgtacgtacatcgagctctcttgtggtgatgatttggtctgcaaggcagtggcaatattcgcacacgtagtagccgcacaagttagttccctgcttttgctttgcgcactataaataaatgacaaatggcgagagatctaattaatatacacttgtatgtatttgaattggagattcaatataaatgtagagcatgtgtactcacaggaaaattgaacttccgcctaagtctttctctccatttgccgcggaccaaatgacggaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacggtgcaggccttcaggtcgaagagtaaaagcacccaggggaatctgcaatgtgggttggatgcattacgtatgaaacacttagcatgttcttacgggaatgaaatttggtataggaagacagtaaaattaaactaactctatgttgtacggcaacagtatgaacgtcttgtatgctacgccatcaggagatggacgagattgtcctatgtggcttgcggatactggtcaagcattgcgacgtttactttccgagggtcgatgaatccagtatcgaaaaccctccgccgtcgggccctttgaatctccattctacaacgataaaaggaagtatatattatatatagtctacttatacacaaggacctaattaattaaaggaaacgtaataagaaatctaactgaacgatacttacaaaatccagcaactcataatagagacgtcgagggcgtccagctggtatagttcgtagatacccttgaaattgatccagagaatgtcatctccttgcaagaagtccgtgtccctgatcctcgctccgatcatctctctaccggtggtgctcatctccatgtacagttgatggaacttgtatatttgtgtgggtagggactgcagctgctcaggcttgacaagcggtttaccgagttcgtacatgtatttcgcttccgccttttcgattggtgcgcctcgtagcaattgatccacagttagcccggtgtcattaataaattcttgtattccaaaatcttcaccggtcaccaacggctcgatctcctggtttggttgctctccaagctgagggactggtttggactttccaaaaaatgctttcttgagtgttcgctcatagtccgatagctttatggcctccttggcaggtgcagacatacccctaaagaagttcttgacactcgggtctataaaatcttcttttctggacttcgaggcttcaattgtctcctgacttctgatgacacataagcgtcaagctcctcttgcgtgc

SEQ ID NO: 31156 - DNA, 5314 bp, Oryza sativa
acatatataagcagcaacttgcggaatggacaaatctaaaatcgataaactacgagcttacctttattgataagttcttgaagggaatatgcagctcacatggtgtccgctgagtgatgtcatcaacggggcaggtggtttcatcatgggtttgcatggtgtccatgctctgtgatactacctgccccgttaaggcgcaactgctacgatttccagaagggctcacaattgcaggaggaatggtcggctggggatcatgggaccgatgtgcggccatgcgttcatcaaccttccttgccacctcctcttgcatgctaagctcgtagctcaataccttgtactcaagatctgcaatcttcgcctcggtatctctcttgctcctcatccgactcctgtatgtgtggatgtcctccttgaacccaatcttccaaggaatcacccctgtcacgccgggaaattcactagtaatttccgaactaatttgtgcataaaatcctcgtccaggaatcagccgaggtacacaaactgacaatttaatatacaaatccatcttaataatgacgttacatacttacaaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacagctccacatcatgtcaccatgtgcctcagtaccaccacggtacctcggaaaggagctgtgacaataccccttgcataacacaactcaccacagtgcaccgttcctggatcataatcacccccttataaacaaggcatggactccccagcgacccccgtggacttctcgccacttcacagtctggcgcactataatgaatcatgctatacaaacgataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgcattgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcatgattttagatgaatttagcaacttgaaccactcaaaaccgagttacgatgatttagttatgaatttctgaagatttaatctattagaaaaaacaggaaaaagaaaaacgatgatgacgtcatgatgacctcatcaatggccgggccaagatggcgacctcgccggagattggatggtcggctgcgactttggaggacatgaacacgtagaggacgacgagacgaacccaacggtactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccggaaaaatcaaaaaactcggttttggagataaactcgaaaacgagttcgattcggataagatactcaacgatttgctccgatttttgggggtaaagatagaggaggataagaggaatatttcccctcaactaaattggaaaaaggagcaacggggaggcgagatttggaaggaggaggcggcggctgcacagggcacagcacgggcggctcggctctgtccagagctggaagatgaacagtagatcagggagggaaaatagacttttccggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaattacaattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaaagaacatttaatataaattctaataataatttattaaataatttataaatcctgaaacaaaaatcaggatgtgacaacccctttccctcgtgttcgtcctggatgctctggagtctgcagggcgagtgacagctcgtccttctctctgtcgggtcggaacgtgccctaagaagaggcttccactacgtccgttagtcgatgcgcagcctcgcgtatctgatcgctgaagaccagagagccatcagctgggttgagcgttccaccgtgagcatagtaccagaactttgatcgatccggccaattagcggtggccggttcgatacccctctcaagcaagcttgcctccatctcctcccacttcggcatcgcgacgctatagccgcctgaccccaactggtgatggtacttcttcttggcggcattttctttgtttctttccatcatcgcctgcccttgttgacctgtctgatatgcaacgaactcgtcccagtgatcccttagctttgggaatgtgtcgaagttcggtgtctgccccttcaggatatatttctggtacagatctcccttgaagctctgaaattgttctgccattttctttagagtccaccttttcactttgtcctctgtacccgcgggaagggtgaatgtctcgagcattgtggtccatagcatctctttctccgaatctgggacaaagctctcatgatctccgcatgcccttgttctgcgccagtacaccatactgacaggcacgttatcccgcacaacccaaccgctgtgatgtacgtagttcttggctgcttccaccggggcactaggtcggccgtcttcgtccacttccgttatgatgtgccgaccctcaagcttcttcgcggcacctcgttgcccgcgtgccctcttctgtccagcggagggttgacttccactagcctcctcctcctggttcccctccacatccctctccacgtgcccctcctggttcccctccgcatccctctccacgttctcttcctcgttcaagtactggtttggatcctcgttcccctcttcttcgttccagtactggctgcttccctctgcgattgtatcgtacaatatctgtccctcatcgcgatcagccatctgttcatacaagaaatagttgctaagtcatgagacatttttgctttaacaatcttatatgctaacaatcatatatgctaagtctaactgtcgtacatgctaagtctaattacaaatctaataatcttatattaaaactataataatcttatattaaaactcaaatagtcatatatgctaagtctaactgtcgtatattagaaccctacacaatcttatatattgtatttcacgttcgcgttctcgttaagttcacgtttcattcacctacgttcgttcgttcacgtgcgtccacgttaacgtacgttaagtaatgttcgcgtccttgttaagttcacttttcgttaacgttcacgttcgttaacgttcgttcacgttcacgttcgttaacattcgttcgttcacgttcgttcgttcgttcgttcgttcatgttctcgttcacgtacatttcgttcgttcacgttctcgttcacgttcatgttcacgttcgttcgttcatgttcacgttcacgttcacgttcgttcgttcacgttcacgttctcgttcacgttcattcgttcacgtggcggcagcggagcggcggcggggctacgcggctgcagcttggcgcagcggcggcgtggcggcgcggcatcggcgtggcgcggcggcggcgtcgcacggctatggtgtggcggcgcggcggtgccgtgccgcggcgacgtcgtggtgtcccggcgtgtcgtgccgccgcggcgtcgtggcgcggcttcgtcggctttgcagcttcgtcgtgacgtcgtcgccgatgcatgccgcctctaggtcggggtcggcatcgtcggcgcggcggagtcgtgatcgggcgtgacgacgtcggcggcggcgtcggcaacgaggtagccggcggcggtttgggggaagagagagag

SEQ ID NO: 31157 - DNA, 2201 bp, Oryza sativa
aaccgggactaaagatatttttccgctatttctaaattctttttaaacccggttagggttaagaaccgggactactgataagcgcactgaatattaatttccattacatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaaattaataaaaattctaataatcatatatacttagcatatgaatgatattaaattgttaaaaattgtaattaacatatgtatatacatacgatatgcatgttttaaaattagtaaaaattctaataatcttatataattagcatatgaatgatattaaattaattgttaaaaactctaattaacatatgtaaatacatacgacatgcatgatttaaaattaataaaaattcgaataatcatatataagtagcatatgaatgatattaaattaattgttaaaaactctaattaacatatgtaaatgccacaagcctgatttaaaacttttaaaaatcctaattatcgcatataactagcatatgcatgatttaaaattgttaaaaactctaagtaacatatgtaaatgccacatgcatgacttaaaacttttaaaaattctaattatcgcatgtaactagcaattacatgatttaaaattgttaaaacctctaataatcgtatgtaattaacatatgccatacaaaaattgatttatatggataattattacatccaaaatagtttacatcgtgtacacaataattacggcaatacatcggcggtgacggttgaccggacgtactttctcctcactattgttccctctttgtgatcgctacgtgagtaaggggtgtcttcatttgataggaggatgctagggtcaatcgtcaccgtgaaagggggttgcccatcaaactgatcgtaatcctcgtcagtcttgccatcaactccgacgatttttcttttgcctgggagaaccacgtgacgcttcggctcgtcaggccctctgcccttctttcctttgctagacatgtccttcacgtaaaagacttgcgttacatcattggtaaggacaaaatgttcgtccgagtatccaaccttgttaaggtcaaccgttgtcatctcactgtcatcaatcattacgcctccaccagtcaacctatcccattggcaccggaacagagggaccttgagaggaccatagtcaagttcccatatgtcctcgatggcaccgtaatacgtgccagttgttccatcgtgtcctatggcatcgatacgaacaacgctgttttggttcgtgctcttcatgtcttgggctctcgtgtagaatgtgtacccattgatctcatatccctggaatgtcgcgatcgacccagatggtcccctcgccaggaaggccagttgttggttgatcatctcgttacccagatggtcccctcgcctggaatgagatgttgtcgtagccacacggggaaagtatcaatgtgatgccgtgtaatccatgcatcggacttaccgatgtttctggcgcgaactagagccaagtgctcctcgatgtaaggagctaccaatgaagattgttgcaaaaccgtgaaatgggctttacggaataaattgttgtctaccgtcattattgctttcctttcaagagttcccttttcccgtatctcccttcatggcgtgattcaggtaccccgattgggcaaaggtcttcaataaattctacgcaaaattcgatgacctcctctgttccataccccttggcgatgcttgcctctggacgagcacggttacgaacatactttttcagaacgcccatgtacctctcgaaaggaaacatcttgtgtaggtacacaggcccgagaatactgatctctttgacaaggtgacaaagcagatgcgtcattatattgaaaaatgaaggtggaaatatcaactcaaaactaacaagacattgcaccacatcattctgaagggcttctaatctatctggatcgatgaccttctgcgaaattgcgttcatgaatgcacatagctttgttattgttgcccggacattgtttggaaggataccccttattacaactggtagcagttgtgtcatcacacacgtgacagtcatgagactttaggtttg

SEQ ID NO: 31158 - DNA, 1596 bp, Oryza sativa
tgatgacccatgtacacaaccttcctacagtgcttaagatacgtaatttctggtttattccttacagggagggcaagcctttttccccttgttgaactgtccggataggttgctaagtgcaggccaatcgttgatggttacgaacagcagcgctcgtaggtaaactcctcttgtttgtcattgtcccacacggggacaccttccttcttccacaatagtttaagatcttcgaccagtggtcttaggtacacatcgatgtcgttaccaggttgcttggggccttgaataataatcggcatcattatgtacttcctcttcatgcatagccatggggggaggttgtagatacacatcgtaatgggccaagtgctatggccgctgctcatctctccaaaagggttcatgccatccgtactcaaaccaaaccgtatgtttcgtgcgtcctttgcaaagtctttaaattttctgtcgatgttccgccactgcgaaccatcggcggggtgtctcagcatcccgtcctgttgacgctcttcagcgtgccatcgcatcattctagcattccccttgttcctgaacaaacgccttaaccgtggtattatagggaaataccacatcaccttagcaggaattctcttctttgttagctgcccgtcaacttctcctggatcgtctcgtcaaatcttgtatcgtagtgctttgcaaacagggcatgcttctaggttctcgtactcctcaccgcgatataggatacaatcattcggacatgtgtgaatcttctgaacttccaatcctagagggcagactatcttcttagcctcgtacgttgtctcgggcaatttgtttccctccggaagaatggtcttgacgagtttcaataaatcgccaaatgccttgtcactaacaccattttttgcctccattgcaagaactccagagtggtatccaactttttgtgcccctgctcgcaacctgggtacaaggacgttctgtggtcctctaacatcttgtccaatttatgggcccccttttcactttcgcggtcctccttggcgtcctgcaatatctgaccaagatcatccacaacgtcgttaccatcagcatccctttcctcctcgcccgtttgatttccttcaaatccaacgtactgagcaaagtccggaatattgtcgtcttccacttcatcttcttccatttcaacaccttgctcttcgtgggatgtccaacaattatagcttggcatgaaccccgactcaaacaagtggaattaaatagtcctggatgcagaatactccttctgattcttacacttattacatggataacaaataaaacccttatgcctgttagcttcggccactctcaaaaaataatgcacgccgtcaataaactctttggaccgccggtcagcgtacatccattgccgatccatctacgtgacatgaaaaaaaatcgtacataaataattattctaacaataatgacagtcattcaataattataaaataattacaaactctttcaacagtcatacaaaaatgacatatcattattcatacaaaaattataaaatattacaccaaataattcttatttact

SEQ ID NO: 31159 - DNA, 2973 bp, Oryza sativa
ccgtccacgactgagctcagggagcgcattgctaggtaagcctttgaataatccttttggtctttgattcacaaggttgttttcagttatgcatcattttcatgtaattttgcatccggagctaacctaatccagagtaatgtatagcatttaaccactttatagcaattgtacatctgaaacttgttttattgactcagtattggtgctactgtcacttgatgatctttggatgtcaactagtgtttttagggttaaatctagtgcaacctttttgctaatttgtgtattacgaaggctttatgcattattttcttctactgtctcacatgctgggctaaattgtggctgatgaaatttctttccctggtccgactgaatgtggtccatattgagtgcattttgggtttagtcatcctattatccacgtaagcctcatatgaattcagaaaattgaagctgaaggaagacaacattgcttctaataattttaccaggagtaacatactaaagttgaactgttgaagcaccctatagagaaacttttgctaaaagattcctacggtaaactttattataatcctcaatatgcagacctgctgtctgctttcaaagttgtctttattgcattgaatccaggaactattcggtgtaaacagagaatgctgtcttttgtatttgtttattatacttttggttatgcttgttgcattctgattaactgctgctctgttgacatagctcaagaattttacttatttgtgctgtcaataacccggatttcttgtttatgtaatggaagcataggtttggtttgtacagaacacgatcaaatatactgaaataaatgccatcttgttacacctttgatctttgttcaatactcaactaaactctaaaacttactgccgtctaatattgctgttacaacctctttcggtgttaagctcttctttagtttaattgattgatagttagtatgcaagagttgtatcatttttcctcgctgttaaatcttgtaattaaaatttgaggacacaaataatctctaaatcaggtatttacttcaggtcaaaggaggaaagactgaatgatacaaagcaaggaggaatactggatgataatggtggtgatggtgagatattatcgtgggtgggcaagagtcgtaaacttgatgaaaaaaggcaagctgaaaaagagaaagcattacatcgtgctcgagcattggaggaacaggtgatggtttaaccatgatgtttatgtgtatacattttaaaatatgtacaactaactttcatatatcaaacttgcaggataacattttagctgaaaatgatgaggatgatgacgaggagcaacaggaggataaccgagtgggaggtaattcctgtgcaagtttattttgttatgccttttgtgtagtatatcgtctgagctatagtgttctgtgcactgttatcagaataacgtgtttcactcttttcatcttttgtccagaacacttatctggtgtgaaggttcttcacggacttgataaagttttggaaggtggcgcagttgtcatgaccctaaaagatcagagcatcctggctgatggggatatcaatcaaggtgatgggcttttacatgtttatatgtaccagctcctagggtaactattgtcttacttgagaaaaatatttgtagaggctgatatgcttgagaacattgagattggtgagcagaagcaaaggaacgaagcttacaaggccgcgaagaagaaaggaacatatgatgacaagtaagttcaccatacatatatgtgttactgctaacatgctgtgtttattggattgatgtgatataatgttcatttttctgcctgtctttaggttcaatgatgatcccttgtcaaagaaatctatactctcacaatatgatgacccaatggaagatgaggtaaagtaaaatgcgatgttcaattttgtttgctttgtatccctctgttggtagttatttttattgttgcacttatcagggagtgacacttgatgaaggtggacgcttcagtggtgaagctgaaaagaaactggaagaggtaattcaacttcatccctagaagccatggtactttttagggtccattgcaaatactttggttgcatctttgtgtggactaactatattttgattttgccagctccgcaaaagaattgaaggtggttttgtgcagaaaaagacagaagatcttacttccgcagcaaagatgtcatcagactattatactccagatgaaatgctccagtttaagaaaccaaagaaaaagaaatcccttaggaagaaagaaaagcttgatctggatgcacttgagtctgaagctattgctgctggactggggacaggtgatcttgggtccagaaaagatgcaagacgacaggctgctagggaggaagagcaaaaggctgatgctgaaaagagaaactatgcgtatcaagcagccattgcaaaggctgaagaggcatcaaaagcattgcgcccggagaaaaatatttctggtaaacacgctgaatctgaagaactagtttttggtgaagattacgaagatttgcagaaatctctggagcaagcaaggaaattagctctaaggaaacaggaagagactgctgcatctggtcctctggctgtagcagaactggctactgcaagaataggtcaaaaagatgcagatgctgccgaaggagatgcacaacaaaataaggttgttatcacagagatggaagagtttgtgtggggcctacagttgaatgaaggtgacctcttttttgttttctgtgagtaatttcaaagaaatgcataggcagtgactaattattggcttcttttggtatcttctttcagagactcgcaaaccagaagcagaagatgtttttatggatgaagatgatgacatgatcatgtcacacactgtggcaaaagatgacatgagtgggctgg

SEQ ID NO: 31160 - DNA, 7366 bp, Oryza sativa
atttgagctccgtatgtgacaaatggttggtctgcgttctttatttgctttagatgacaccgaaggaggcatttcgggatctttcacacaaattccatggcaaggcacctggtaaaatgaagcaggaacggcgccaaaaaaagtatcgggatgagttgaaaaccaagcgaatgatatcttctgacacaccattaatgtctgcggagaagatgagagaggctcaagctctcagcaaaacaccataccttgttttaagtggcaatgcaaaatcagggtatgtccacagtatacttctacatccaagttcttattttaattttccttccgatgctgctttttaaattattttgatgtcttccaaggccttaatggaagtccaaaacacttgctctggatttataggtgttaaggacttaatagttaatattgcacaacagtacttttttttcacgagatattatttttgtttagtttgtgttgagcacaattatttcatctgtattatcactgatggcttatatttaattgaggatatacaatgaaatccattttcgaatggttaatatgatagcatgtgagctcccaatgtagttggatatttatttacaatttagagggattgaggttcacatttatgcctctgtttttttcattactccatctggttgagagattgtacaaggcacgtctagattacatttgactgctggggaatttatcaaaaattgcttatagcttgtgcagttatctttgcatactatgtatgtgattcctattaatatcatagttttcctgatgaagtgcctaaaccagttctgtttaatgtgattttagtcaaacgagcgatgccagtggctttgctacagtggagaaagagcaccctgggagtctgacgcccatgcttggggccaaaaaggtatggcattccctgttccattaagtaattactttatgaataaattatttgttgggtgttaggtaatgtataagctgtacatatgtaatccaacttaccatattcagaatcctgtctttgcctttcttttggcaggtcgagcactttctgggcatcaaacgaagcgcccagggtggaggattgcctccaccacctccaaagaagccaaagaactgaacctgcagtggacttggctgagtagaaatcaggtgttttttagtgcatttgctactgtaggtttggagcagatttcgagggacctacaccagcagataccaacgacccatgaagcagccccaaatgagttaacatgtaagaacctgtgaatttttattccaagttgattatgttaacattctgacatgggcgatgtaacttttgtaaccagctgtacttacaaggctgcaccacaaatgcagtcagaactacagaggtggatttaaaatgttgtcgtgtctccacaaatctacattggttgtttaagctggacatacaagttacgattgctgagtgctgacaaactttatagtgtttttcacgtactctgtcccataaaaaacaaatctagtatatgatgtgatacattctagtaccataaatttggacatgagtattaaaatgtgtaacattctgcctcccaaaaacatgtgtaacattctgtactagatttgttttctgggacagaaggagtatgttggggaaagagggagtacgttgacaaacaagcatgtagtagtcaggtacatcaaaggaggcaaaggcaatgcacaccgtgatgtttgttagtcatgtagcacatcgaaggaggtaaggcaatgcactctacggccgaggttttcctttcatttgctgccattcttggagtgtcctgaaagatgccaaagtgtattactagcataatttgagatagctcctgcgaggctctgaatctgtgatctagtacggcagtactagagttaccaccaatgctttgacgaggcactcctgaactgcttggaaggctagtttttggcccaaaaactggtttggttggagtaaactgtaatgaatccgggctgcgatatgtttggcacggttttagctccagctccacctctcctgtagctggagtttagccaaatagtttcagctccatctaaaaaaggagtgtagctggctgaccttctcataaaatagactagcgatatggagttgggtttaggtctaaatttaagagttggagctttatcaatagataaatgtttatgttaggatcaaaaagctgcttggatgggcggtgtcatctgattaaaatctgttcgcataggtccattatacctggaaaataatagactgctttcgagccgaaaaaaataaggcatatttgttgttggtggctagattggatggccgtgtacctcaccaccttttgtacttgtatactgtgttcgagctatccttctcaccatttttctttttagattggatcgatgccactacaaatatatcatttgagataaatatcactactattcacaatatcggctatatttatgttactagaatttgaaaaaattgaaactgtgctactccatctcgttttccataaaaatctccgttagtctgaattgcacgtgaaacctagccgtcagttccatctttaccttcctcccctctcttctctttccccttcctctatccaccaccgtcataatcaccgtcatcgaccacgtccctggtgggaggcatcgagagccaccaccgtcgacgtctgcgacctcttccacaggccacatcgggtgttctgggagttggcgttgccgtcctcgactccatatgaggcgggagggctcgggagccgccgctgctgtctctatcctcgtagcggacacggggatggaggaagagatgggagagaaagaaaagggaggatggaggaagatagaactgacatatgtgttccacgtctaaggccgtgttcttttctcctctttcccagctcacttccctcgttttccgcgtgcggctttttaaactgttaaacggtatatttattacaaaagttttctatatgaaagttcctttaaaaattatattagtccatttttcaaatttttaggctaatacttaattaatttcactataatcgcgtgctttgtttttcgtatcgatcccgaatgcagacatggtctaacggaaaatgtgatgagtggcacggttttaatttccccaaatttcagtgccatgttgcccatatcatgaatagccgttgcatttatcttaaatgatatatttgtagtggtatggatccaattaaaccttttctttttggaagatccctaattcactaccgtaaattaagtttcacttggtactactagtatcaatcaattttattacaggattgaatccgaaaggctaaaaatgcaacgtatgtacgtatgtgcggctcgcaaacccttcctgcattgcagtaggtacgccgcggcggcatcgtcagcggcgccgtagccttcttcgccgtcgcaatattcctcgtcctctgtcttgatggctgggttgcggcggagagcctccgggaagaggcgcttcatgccggtggcctccatgatcctcttcccgagcggcggtcgtgcccccttcctggtgccgtacagcgcgcggcaggcccagtccagcaccccgggggcgaggcaggctaccagctgcagcggccggaacagcgacggccacgtgacgtaccagtcgccggcccggatgccgtccatggccacctcgcccagctccgccacgcggcccaccgggaacacgccgatctgctcctgcacacgtgcaactccatccgaacgaacagcgttaatttggaggctaaatctctgtaaaaggagcaatctatcctctctctgatgctgttagaatgaaacaataccacctctgttttatagaacaggtcacattgacttttttataataaatatttttaagtttgattaagtctatagaaaaatgcaacgacattttcaacacaaaataaacaccttattaaaatatattaaatattagttccaatgaaactcatttaggtttgtagacatctattaacttattaaagtaatagaaaaagaagcctccacgttcgctctcacagcctagaaattcttatattaatcggagaaaaagaaaaatagagtcaatatagaaatacaatttagaaatagttaaaattagaaattaaaaaaataaggaatatttgaagaggagactagagttctatagaaatacaattgagaaataaaagaaattcggaattaatcggaattaaaaataaggaatattataattagagtatagagtccatatagaaatacaattaagaaataatagaaatttgaaattaaaaataaggaatattagaagtagagtatagagtccatataggaatttaaaactaactaaaattcagaataaacataataaagttaaaagttgagtttagagttcgtataaaaaatacaagttacaaataactaaaattcgaaattaaaaaaaacatgggaagaagagtctaaagtcaatatagaaatacaatttagaagtaactgaaattaaaaattcaaaattaaagatattaaaagatgagtttagagtccacatagaaatacaattagaaataataaaaaatcagaactaaaaataaataatattggaagaagagcctagagtctatatagaaatacaatttacagataacaaaaattaggaattaaaaaaagaaatattgaaagacgagtctagagtctatataggaatataatttataaataactaaaatttgatattaaaaataattaataaatagcacgtatataaaatacaatatgaatattacacattagtagtttcgtaaagttagtacaaaatttaaaattatgttgtcattttaatatatttgaataatacattgagaaaacatatatgctattatacgagggaaaatataatgatgctagtcgcgtaatctgcgcgggccaccatgctagttactatataaataaaaacttggttaaatttaaagaaagtttaactataatatagaatggaagggggtatcaaagtcgtgaactttcggagctataaaaccatttttaaaattttcatttaattgatatcttacatctctggcttcctcgttgacagcgacatcgccgccgctctggatgcccttgcccttggtaatctcggattcgacgtagccaggggtgagaactgtgatcccgacctccgacccgagctcggctcgcaatgtttcgtagaacctcagttgcgccgctttggttgcctgataccgtgacgcacataaagaggtcttatgaacacatggaagaggcgaaaaaaattttagagaactgacgactcatttgtggtggtaacacgtacattgtagaagctcattcttgaagtgccgactgttcctgccgcggagcacgacacgacgagtttccctttgctggccttgaggtgtggtagggcatagtaggtcgggtacacggatccccagaagttcacgtcctgtgtaaatgtttcaaccaaaggatgaatggatagactatcaatatgcaataatagggcatgcatgtaggtgatgtatatcgtcataaacaactattttgtgttattctaacacttgtgtagctatatccatattttttttagcaaaggtgttgcatatatatgactctgtttggatccggagggcccttcggaattttgctatttaggagtattaaacgtagattactaacaaaactcattccataacctctagactattttacgagacgaatctaacgagatatattaattcatgatttgctatagtgatgctacagtaatcagctgctaatcatggattaatacacataattagattcgtctcgcaaaatagcctaagggttatggaatcgattttgtcgttaatctacgtttaattcgtcgaaatagcaaaatttcagagggatatttaatagtccagaggatccaaacaaggccataggccagtgagtgttcaccagcgtttaaattaagttggtgctcgagatcattgatgtaaaagagggccgtggtaatctgagcaacaacaaagtttaaaacacctaatccaaatttaaaaaggattggtttgaaatggttttgtgaagtagaacttcagcgatagaagagtattcaaaccgcaattcacttctctttccaagtcattattatttttctaaaatcggactgctgagtaactaaaccaccccggtctaaaccgcgggttgaaccgttggagtaaacgatttagaatctaatggtaaataatgtccacatacatgtaagtttggataaacatgatagttaaatagaatataatagacttaaactttatagttgaaaaacattcagacatatagaaaaaacatatttgaaaagatttatgaatttgttttaccatcatcttggtgaaagcggttatgttggtgacttcatcgaaggagcaagaggaccagataccggcattggcaaccagatggttcactgcacgcagcatcagcaagagacagaacaacaacaaatcgttaataatgcctcctctataattgcagacttgcagttagggagagagagagagatcggttcgcgcatgcaaggatgaaagtgcactacatttgccgaagtgcgcgactgtctcctcgacggcgcgtctcgactggtcggcgtcggagacgtcggccggcaggacgaggacgtccggcgagccgcgctccagggcggcggcggcgacgccctcgagagccttcttcctccgcgccaccagcgccaggcacgcaccttgcgctgcgtactggtaggccagttcctgcacaatgacaagagcagctagccacgttaagcaccaccacgtgtattgtcagtatagtgacacatgatagagaaaatataattcgagtaacgccacgtaaactagtataaataaaatagaaaaaatacgaattacccccaactatcgcggtcgtccgaattaccccctgaatcacaaaaccggacattcttcacctcccaattatgtaaaccggacgaattacccccctcgacccaatccgcggtggtttttagtctacgtggcatatacgtggtatcccagtcagcgttttctaataaaaaattatgggacccgcatgtaatagtcttcactttcccctctctcccactcttcctctcttctctctcactctatctcactcttcattgattcactctatcggcggcggtgggaaacacggaggagcgagcggcgggcaacggcgcacgggggcggacggcggacgacggcatcgtggcgaaggccgagcggaggcggctgcgggcgcggcgcacgggggcgggcggcggacg

SEQ ID NO: 31161 - DNA, 4486 bp, Oryza sativa
atcacctgtccgccgcctcccgcttcttcgccgccgttcgcctcgcccgcctcgtccacctgtccgttgccgcccgcctacctttccgcctcgtcgacgctgtcgacctcgccacgggacgcgcggagcggtacacggtgaggtacctcgtcgcccacccccgtgcgcgtggccgcgacgccgccgtccgccgtccgcccccgtgcgccgcctccgctcggcctttgccgcgacggcgccgtccaccgtccgccgtccgcccccgtgccccgccttccgccggccgccggcccgctcctccagtggtctcccgccgccgccgatagagtgaatcagtgaagagtgagatagagtgagagagaagagaggaagagtgagagaggggggaaagtgaagactgacatacgggtcccacaatttttttattagaaaacgctaactgggatacgacttagatcaaaactactgcggattagatcgagggggttaattcgtccggtttacatagtttgaggtgaagaatgtccggttttgtggttcaggaggtaattcggacgaccgtgatagttcgggggtaattcgtactttttctaataaaatattatattatgtttatattattaatagaaatgtagaagactctatcctgttcagacgagacaattaataaccatataaacatctattgtactttatgcgcattctccatcctctccccctttccctcccacccacatggctctctctccccgaaatgacttgtgtgcgcatgttcgcgggcgcggctgctagcgaacaggtcattgcttacatttttgccaagcatgtttccttttggaggcattttccttttttttcttttatgggcttggagctaattcaagtgacggctctctaagcagagacaagaaatcatggcccatgcggcccaaaatacgcattcatgctttttttccctatttttattatatctctatatgaagttgtataccaattattttgcatgtataaatttatataccaaatatttatgtgtaaaatcgctacaccaaatttttctacgatataaagcttatatgtataaagttgcgtgtataaatttttatactaaatgtttctgtataaaatgcctacaccgaaattttctatggtgcaaagtttatatgtataaaacttgtatggtataaagtttagatgtgcaagtttatatgtatatattatatgtatataaactttatacgtacaaattatttgggataaaatacaatgggccgcatttagtgggtcaaaagtgactaagccagctagcggctaaaaggggaaaggcacccacgctcgagggctggacttgtcagtatttgtcctgctaatgcgttcgtgctacgtgaatattcgtgtactagatccactcctctgtcccaccctcatgagctctctctcccaaactcaaggagtgctctctctcccaccctcatagctcaatggccgagaacactatgcagccgtcaatctatggtcaatagccaccaactccgtgttgttatggaaggccgccttcattcgaggtggagggataattcgtgaggctttttggattcgcagtagcttcgtttgctgactcattgtgatccacaacgagcttctttgattagaggtggtgaatcgaatgatgtgttttttttttgttttgaagcattttgagaaatgattttcaggataattttgctcgttaatttgagttatctagctttattgaaggattttgggcacttttttctaatcatttgttgcttgttttatggggcaatggaacatgcagtaacttttttttttgccatggggtaatttattgttgttcgggtgttgtttcgattaaattttttaaattgattattttttgtttttcttgagttttctcatgaaacacaaatttgtggatatcccagcaatactttcgtaatatctaatgtatcacgttagtggtaccatgatattgaggttttgtaactacaggcggacctatttatctctgtacatataatatcatacctgatatctatatgtattactccttctgtctaaaaaagccaaccttggcatggatgagatactttctaggacacgaatctggacactccgtccaaaaaaagccaaccttggtatggatggagctatgtccagattcttgtcctacaaagtgtcctattcatgttaaggttcgcttttactttttttgggatggagggagtagacctggtgctcggtactagggtatgatacctttggaaggtttctcgcatgctgatatcagcatgacgcaaatacataaagtatcccttccacttgtgtttctttcgagtctttgttcacttattatattgttaacaacaataaaaatatattgtatggtataatataacaaaacataattcttttggtactactaataatttgaccaattaatcttatagagtttatataagatatggctcgaacagggagcagacaacttggatatgatttcccacgcttatagcaagaacattttctttcttagagcactttagtatgaaattcatgatgtcgatatttattcaacgaaataggcgtaaccatgtttcttaaatgcaagactgtcaaaaacattaaagcaaactattaattaatataaacttccgatcgagagcgtttaagaacaatttaatattgttcatgcagtcgtaaaaagatttttctcgacaatactcccacttttatctaaaagtgtaaggcatagcatttcttttatcaacaagactaagaaaaaattatctaacaaatcaacaatcaggttccgatcaacaatttaagtttaacacgataaaacataaaagataattttttcatttaagtcttgaatatatgaagactacaaatatacctatctcattaaaaaaacagaaaatgaaataatgaaatagtttgtataggactttttgacagagggagtaagacggtaatggtccagcactacggtaaaacgagttactgcaggtgggcacagatccagatcggatcactttgtcgttagttaatcattgaccgggtcgcagccatgcatgcacgattttgtgagtgtagaagacgtcatcagcaattaattaatcgcatgtgttcaacccatactaccgatgagagaccagatgtctaattagaaggagatagcattacagtttacgagatacagtagctttacttgattctacaactaaaggcaattgggccggttcgcgcccatgtgccctgggaactacgcaagaatggaaccgaaatgacggtcaatacgtgtcataccaaaaactactgcttcatatgttttaaaatatatcaaactagtaaacgattaaacaacgacgaatatatatatataaagagtatatctacatttatactacttgtgaactcaattgttactctccctgttttatattaatcatcatatcattttctcattaagatcaataaaatcttaacttctctgtattttagggtctatatgatatagctccagctctaaactctacattcttgagagttaaagcccaaccaaacagttttaactccacctaaaatgggtgtggagttgtgtgaggcgtgtagctctaccaaacacccttatttattataagtttgtagtaggggaaaaatcaattttcatatagactttaactcttcttatgcctaagaaacaagagagctttactacccggccaaaagcttgcatgcatacatataagctcaatttgcatgtacaaatataataatactaccgtcaaatgaatgagccaaggttacacgatgattaatttagagtttttgatatttttatacgacgatcattacaagatggaggaagtatattttaaacgtatagtgtttactactacctccatcccaaattacttatcttttaaggtcgtttagtatatcataaggtttgaaacaaaagacttcaatacccttataaaataatttatgtttaaggatagaagggtggttgaggggtaaaataggaagaaatttaaatgtgatgtgattgatgggacaagtattactaggagtgataagtattggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagccattgtgggacaaaatttgaatggtagaaggataactaatttgggacggaggaagtatcaaagtggcaagataagagcaggtacaatagcagactataagccaactataaccacatatcgagaagaaaagagaaagagagagagaaagcgggctatagatttggtagccaagctgccacacgggactccaaaatgtatttgtgtataagatgtgggaccgggtattaatggtgcag

SEQ ID NO: 31162 - DNA, 714 bp, Oryza sativa
agaaccccagagtccgcacatcctcaaatacaaagcacttacctagttagatgtaggttagacttcccgttcgagaaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgct

SEQ ID NO: 31163 - DNA, 1003 bp, Oryza sativa
ccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaccacataaagctagcatgccaacggtatacagcgagtcgctctttgtggaggtgacgattgcttaacaatcggtcgattcgtttgatgtgatgttttgttctcgctttggtcggcaggttacgcccaagttcggtaagagtaaaagttttacagtcaagtaaggcgtggcaagccaacgttcagctgttgagtcgttttaagtgtaattcggggcagaattggtaaagagagtcgtgtaaaatatcgagttcgca

SEQ ID NO: 31164 - DNA, 8475 bp, Oryza sativa
ccagaataagatctccacttaacaacaaatttatgaattcaagaaggaaaaccttaggtactaatttcatctggtagagaatgttttaataacttcaaaatcacataatcctatagtagctatgcgtgtaccttgacagtttccattctacagatgtttcgcacagctcaaacaatccgtatcacatattaacatataactttcagggcacatgttggctatgaacctataactttagacttgatagttgaatagtcgatacaaccttacacttacaaagttcaggtaacatattttgactaatggatctaagtgaccaaaaaaattccggaagacttaatattaaggataaattaaagtgaaaacagttatattataaaaaggatggcccatgcatgtatatcttttttatacatcacatagtatttgaaggtttctgaacaaaatgatatgaactcactggaacagatgcaggtttgcaaactgtaacaacatcagcttcattttgaaggattgtaatatcaccacccaaaactggaggttcatgcctgtcagagtgacaaccatgaagaatttgacaattaattgtaattgaaagtatgtttctttctttttttacaaagaataaagagcttcagtagttagagagctaacgaaaccatgcaagcagaacgtctacacctagcatgggaaaataaaaactatagacaacattagagctgactcaggaaccaatcaagctattgtttctgtgcattttacagttcccatcaccattaaattaaaacccgatctattactattaacttagaagccaaagtatcagtaataactgcaaaaactgatgaagtaagtggagaaattatataagagatggttgtaattggttgagatgagggagtaggtggaaaggtagccatattttgggatgaagggagtaatatttttgtcaaatgaccatctcaatgtacctttgaaactgatgaagttgactcacctgtgcaagaaatggcttatcttttgtgatgattgcacaacatagtctgcgtgaaccatttggtcatccacctgaagcctcccacacttcactgcatgaacctagaattttgttttttttttaaatcaattctagatacatcagaattttgttttttttaaatcaattctagatacatcattgtagataatgccaaagaaccaagagagcttatctagttccaaacgtgcaagggttgaatcataagattaatttgcaattctaaatggcggaatacataaaacaggacgaaccacattcagaacccaagttttgtgtgtgtatttctacagttaggacccgatgactccatatgcaaaggtaaatcataataaagaaaaaggaacttataggacacatggtaatattcaaaagagatactggtggcatacataatattcacgaggccggcccttgaactcatcggtgaagaggtcaacaatggtcttcccagcccatctgtttttcacctgcaaaccaaatgaaaaaataaactactccctccgatcttgaaaacatgtcgtcttggaacattaatatctttttgcatatttaggttggatgcatgagaagcatatctatagaattgtttcaaaaaactactttcataaaattaaaatatcttcaggctacataaaccaatggtcaaaggtgtattttaaagaccatctccatgtccaaaatgacatgtttccaagactagagggtatggatttggttgaagtaaaactcgacaggatcgcttggagataatagaaacataacccaaattgccccataatgcagagtgacagcttttgtatattgcgcagtggtgtagaggaaagggagaacttggaggtgccaataagttacagcttgcaattaagtagtaatatatttgatggagcagataaaagattaagaaaaaatgttaggccaaaacccagtaacatctgattctatagattttcagtgcacaatatatttattctcgaaacaacaattttcagtagacattataactaataacaagcaggaatcacctgatccaagcaactaaaaaaacctatgttcccaacataaatatgtaataaaatgcaggcaaaaccgaggaggttggttacatgggagatgaactcgaagtagtagggcctcacgtagcgccgccctgcgaagcaaaatggggggggaataaccaaccgcgtcagtccggggcctccggggagggggtttggcgggcagaaagaaagatgcgcgcgttggggacgagacggaggccgggctgcgggttgctactaccgtcgcggaagatgtagtcctgccgctccggcgggttcgccggcgtctgccacacgatccccgccggccccgccgccatatatatatatcccgggcgagacacccctcgatcgggcttgtggcggcggaggagggggcggcggggcggctgctcagctcggcggttcagcgcccgaggagaggaaggaggatgggcggcggcggcggcggcggtgggcgaggagaggacggagtggttcggcggcgcgactggctcggcagtggaggattttagtgagggtgtgcttccgagggcgtatgaccgtaggatccacatctaacgttcgtgggctcctggcattgtcgtgctcgaatcgtttcggcccatttgcagcgttactcacctgcttatccgtatcacttatattggtaaatagtaaatcatttgtgagtgtaaataatgtaaaataaactatgatgaaaaataaatttaaaattaaattctaaaatttaaattttagctttataagtataagcataagtggcccttgaagtatttaaagaatttaagttcactgtaagagcatgcatagtgatttagacggtacccatctatataatcttatcattttcctggcaatatgtccgtatattacaacggacttgtacctatcttcgaagcttttactgtttttcccaaagaagagcgtgctacactcaagggagagagaacggatggacaactctcctttttaaatagtagagatgtgtagacggcacatagacaactttaaattaggttgtctatttagttagctatattagattgtacaatttcgctatgtaattttataccagctaattgaattggatttgttatacaactcctagtttatatttcaatatatgtaattatattgtatgtataatagatactaaaagtagggttgaatttaatatacaactctaactcttttcttcttcctcttatgtacagttgtatttcgtatataaattttgatatcaatctacactataatttagttccataacaatctaatggcttatattttttttagtaatgtaataatttttagcccttaaaaaacaaacatagtatcatctttatgattcaatacatctatactttttataaagttatagtccactaagtctaaagctcagcatgcaaccatgccacatcatcacccgctagcaataattacatatttaatctcatgcaagcataaaacatcatctacaatttatttaatgtacaaatcaacatgcaagcatgtccaatcatcacccctcgcatcatttgcacaatattttaacaactctatctattattcttataatatttaacatatacttatcaatatgtttcacattaaagcgcgggtatcatttgattggttcatgataaatagtgataaaccctgatgttcattattttttttctttttactcctagcttgattgtaaaaaaatatatattgagaattggttagtgcagggaatcacctagtttaataatatgacattatttaaaatgaactccatagaggacgccagatccagtaactcgaggaatgctcgatgacgccttgcttctgaattccaatccccctccctcttgctcgaacggcggcgagtggccagccagcctaaacacgtcaagatcctctgtagtattgcatgtgcactactacggaggtcccccaaactactcaatgtggtgatgaggctaccactattctctttttctttcttgtcttttagaaacaccctacaagtgtaatgcttgcaacatgcacacttgcccttataaacacacacatataccctacatctatgagcaccttcaaaagaccagaccgacatatcttaaaattaatgaagtcactacgagcgccatactatccacacatgtatgttgtctaccactgaaatactgtaataattagccgtaaatactagcatacatgccaagtctatgacttagcttgggtgggcaaattctaccacaaagaacctagcggctagttgcgctcacttcgattttttttttgtttttttgttactaggtcagatgcaacaaaatgattttataaagtgatatattagagctaaaggttagttccaattagtacataagttttattataatagaatattttgaaactacacagtatttctatatatgagatataaatgcaagcctcgccattgaaaaacgatcaaacaaacaaaatcccatctgtacagatgtttatatcaggccaccaaacaacattctgcattatccaagcttaactaaggctgagttcgtttggatgtttggaggtggcaaccttgtggcaggtaaacaagacaagtcattagtgtgtgtgtatatgattaattaagcattaattattataatataaaaaaatatgtttatttaatttttaagaagcaatttaggaaacatactaactgctatggctaagttcttatccctatttttctaactcacctccttctttttctgcgcatacgctttttaaactgctaaatgaggtgtgttttaaaattttctacatggaagatactttaaacaatcatattaatctattttttaaatttatttttattaatacttacttaattatgtgctaaaccctgcttcgttttacgtgctagggagtgagggttagtctacatgactaaacaggccctacatctcgtagcctaaatcgcttgtcaagcctttccttcaattgtggccgctaagcaaggcccgtgtacaccgcagaggcccagacctgcctaaataggcgggctctcctcgcctgcataattagctagcatcgatccacgcctctttgggctctctcgccgtgctgatacgatcgaccgacgacgcctcttgttgccacccacaagagccccggcccctggtagaggaccgaatcccggtgcgaagaatcgattgatgagatgcatggtcgacctagtagttctagtttgttctagctagggccctggaatctggatagctctgtgtctagggcctgtttgtttagttcacgaaatgataatttttaggtgtcacatcaaacgtttgatcggatgtcggaaggggtttttggacacgaatgaaaaaactaatttcataactcgcttgaaaaccacgaaatgaatcttttgagactaattaatccgtcattagcacatgtaggttactgtagcacttatggctaatcatagactaattaggctcaaaagattcgtctcgtgatttcttccctaactgtgcaattaattttttcttttaatctacatttaatgttttatgcatgtgtccaaatattcgatgtgatgtttttggggaaaaaattttaggaactaaagggggcctagtttgtagcagctacgttgtactacctctgttctaaaataagcgcactcgtgaatatccatatccaatgtttgaccgtccgttttatttgaaaaattataaaaattagtcacacataaaatactatttatgttttatcatctaataacaacaaaaaaatactaatcatatttttttttaaataagacggatggtcaaatgttacacataaacagcgtaaaactacacttcttttaggacggtgggagtacttggtactatttcatatgcttcggttctattgttgtggtgtcgcggatcgacagccctaacacgttggccaagacgtatagtacgtcccatttaatatttgtagttcttttatttcttttgatatatagtactttcttcactataaaaatgatttttagagatacccttttaatttctacagaccggctaaaataatatttatatgcaaaatgattttaggtgtctaataaagacccgtctacaaaatttgatttttatatgcgggcgtattaagtggtctacctacgaaaatagggttatttttacagacatatctcttaaaaaatctatatgcaaaaatatagcaccgaccagtcacacatcatctctctaaccttgtggagctacccggaagatcgctggacgtttctcaattactctcctacctctctgcgtcttctcacttctctctaagtcctttctactctcactctctctcttctccctcatctccactactctccttcgagcggcatggacaagaggcggtggtggaggcgacaacggcgagcttctaccgacgactgcttcgggtggtggagacggaggccccctacggcttcaggcgatggtaatagcagaatcaattaatggtagtgtccacatattgaagtggcggatctggcttcaaggagctccacgatggaggatccgtcgctaggaaacttggtgatgacgggtgcaacattgggagctctgtggtggcgggtacaacattgagagctcggcaacggcgggtgcagccgctcaggagatcgaagatgacaaatccgacactcgggagctcagcggtggctgatccaacaacgctggcctcgggagaagcaaatctgccaccagcctccaaagctggagggccttagcgacagcgatgacgatggtggatccgagctcggcgacaacagatccgacggcgccggtctcgataggggtagatttgcgaacgacgaccttgggagctgtggggcctcagcaccaatgacaatggcagcggactacgacagtggcaatgacggactgcagtgacgaggatgatggcagtggcggttgatcagagctagctagggttttaattttgggggttttttttgaattttttcgcagacagttggtttaactgatcacttgtgaaaatcaattttcgagcatactcattttcataagcaactaagcaagtgtgctgcccgattagaaaaatgcatactcatttttactacactatgggaaacgagtcacctaaggttggatatcgagctagctcggctcagggtagctcgttaggataacgagctgctcggctcgactcgctatcttaacgaggtaaaaacccagcttggctcggctcgttgattagctcgagctcgctcgtttacctcgtgagcttgtgactaaaaaacatatatacatgcaaattagtgaatcaataagagtataatacgagtataagacagtcaatcaacaagaaacaactgccaagttccatccattcatacattacttcaagtttcagcacaaatcagtaccacttccacaagcacaagtgctccaacctttggttagttcagaagttcagaaatatgcagtacaaacgatggacataccatcagtaaatcatcaaaaatacacatcagcaggggcaatgcttagctaaacacttgccaagtgcaaaaacacacgccattcttaagtaattaatcaggaaacaacaaaaattaacaagtttgatggctgaaaacaaaagatctgtctcacacttacacatgcaaaagcaatcaagcacaaaatagtccaacaagaagcaatcaagcatgaaaaaccagaaagattagtggcaactaatcagccatggcacaacgtgcaatagctgtagcagcgggccgccgcgtggagtagtcgaccagaagaggatgggagcgcaagatctgcttggagacaacaacagcggcgtgtcgaggtctcgcggaagctcggcatgcatgtggcggcgcagcttggaggctcgtggatgtcgcgcggaggaccgtggaaggcgcagccggcggctggctgcctcgccgtcgccgccccctggccgattggatctaggatgagaaaggggatcaggagagtgaaagactgagctaggttttcttctcttcttatatatgaacggttaattgggccgcctaagtgggctgtatttcggccatgggctgagggggatacatgtgaggaaatatgtctgcaaacttgctctagctcgttaagctcacgagcagttcgcgagccagctcgagctggcttgttatctctaacaagctgaaatgacagctcggctcgttaggaaaatcaaacgagccgagccgaaccgagcttgttacgagccgagcgagctaacgagccacgagctttatgtccatccctatagtcacctagccgtttgcggaaatggattttagctgtttacaaaaatcatttctgttgcagtgcttttagcttgtca

SEQ ID NO: 31165 - DNA, 1997 bp, Oryza sativa
aatcatttaaaaatattttcacactgttgtatatttttaaatgattttacgtatatatgattaaagaaatgagaaacatgttcctattattagactatgatgtaaatgacaagctaaaatcactacaacagaaatatataattggtgccattttcacatgttaaatcttaatattacacgcgtgtgtgtgtgtgattgagcatggttttaaacatctattatttcagaatggaagaaatttctctgcagctctcggccggccggtcagccagaccagctaaaatttctatgcgttgctaccagtaatataaaggaaaaagtacgaattatcctctgaactaccgcggtcgaccgaattacatccctgaacccaaaaatcatatattgttcacccggaactttcaataccagacgaattacccccctcgaggttttgtcctacgtgacgtacgcgtggcaacctagtcagcattttctatttttaaaaatgtgagacccacatgcccttcccctcttcctctctcttcaatctctctctctcacggtcgtggggtggtgcaggggaggatgtgggcggcgacgcaagtggcagcggcggacgcggctggtggcgagcggcggagggcgacagcgccccggggcggtgggcggtggtgcacgggggcggacggggcggaagcgcgaggtgaggcggcgtcgcccgagacggcggcccgtggctcgcggtctgcccgtggcccgtggctcgtgtcggcggtcgagtacacgcagagccccgaggaggaggacgtggaggagaccgacgacgacgaggaggaggcggcggagctagagcccacgctcgccgtgggcaccgccgccagtgtcaagaagaggtacaaccgcgggcagagcttctcgtcgtcgtcgtcgatggagtccgacgtgctcgtcatcggcgcccgggatcggcaggcgcctcacggaggcgcgattgcggaagagccgtttgcatcacccgccgccggccacccatcggcgtccgctcctcgcccgcccgccgccagaagatgcctcgtcgcccgcccgccgctcgcaaccatccccgctgccgtcctcagctcctcgcccgccgcccgcacccgcctctgccccgcccagttgtcgtcatcggttcctcacccacctccgccccgccacctgcagctgcctccgcgcccgcccgccgcccgcgcccgcctccgcacccacccccagcgccgaccttagctcatcacgccccgccaatagcccgcgcccgctgccgcctcgcctccttcaccctcgccgccgcctccgctggtggcagtggctgcatgtagaacctctccttcaccggagggcggtggtggggggccgagcttgatgggcttggcggccttggcgagcgccgcctatgcgagggcgccgccggtgatcccggtggcgatgaggttgagcatggcgcggcggccggtctggacgtcggcggcggcgacggccctaacaggtgcggcctctcatggaacactgatgaagagagagagagagagagagtgagatattgggaaagagatagaagagagagaaactgacaggtgggggccacctatttttttataaatgaattgttgactggactgccatataggattaaaaccaccgcggattgagccaggggggttatttgtctggtttgcaaagttgggggtgaagaatgtccggttttgtggttcagggggtaattcggtcgaccgcgatagatttcgtactttttccaaatataaataatcgcgtttccttctccagttattcgagctactcctacttggcttctgagtcaaacatcatggaatttacggcctgtttacttcgcgaaaaggaaatttttgggtgtcacgtcggatgtttgaccggatgtcggaaggggtttttggacacgaatgaaaaaagtaatttcataactcgcctggaatccgcgagacgaatcttttgagcct

SEQ ID NO: 31166 - DNA, 9308 bp, Oryza sativa
gtctcgcaatttcccccctaactgtgtaattagtttttttaatttatctatatttaatactctatacatgcgtccaaagattcgatgttatgcttttgggaaaaaaagtttctgaactaaacaggcctaaagtctttttgccttacccatctctaattctatattctatatttctagatccatcgatgtgatgtaacatgttgaaaaatgcatatagcagtatgaaacaattgtaagatggtatgtacgcatagaagtattcaaatacaacacagctggttttttgaactgcgccaccggatttgcctcccaatactactcatgctggtggaggaattacatatactaaattacttacttgccgtttaaacagtggttggtgaatgaatctaccggattcccttcaagcagcaggggtggatctagcgtgaaggcagcggaggctcgagctttcactactggcaattggatcacgggagccctaattaatgaagtttgcactaattttcttttgtcatacatatatgatacatataaagggagggctatatatagttttatctagttattttttaaagattccttactattttttcttggatccttcacaatcacgtcaaactatagtagatttatggagcaacttggcatgttaattacacgtcaaaaccgtgcactagatgatgatgagtagccgttgtgcattttattttgatatattctagggacaataatgcgtgcatcccatggattttttttgaagtagttcgagctggaactaacgaatatgaaataatctccgttgggggcaaatgaataatactacctcgattaaatatcttgtttaacttatgatgtgtttcatttgcaccctgcacctttgggccgtcgcttataaagttataattaagagtttaatccattctacgtttgtcattgcaaagcacatgtcctacgatatatcactgataaagctcaattctataatatactattttgtcattgtgtggttagtcaatcattaatcaaactccgtttaaagagaaaatgacaattttacgaagggtaaaaatgagattctgcacaacgccgtgacttgtgaaataattttggatgataaaataaacaagcaattctatttttcgcgaatgagaaaaaaatatcccaataaatgaaatccatacgtaaacatggtactctaagagaaatgataattttctaccttaacagagttgactagcagttaataactaacagtggtggcatatatgaaagaaaacgaattgcttgatagtatatcatagaattctgcttcatcaatggcacatcctataattcatactttatcgatggcatatagtggattaaatcattaattaaactaaacaagtaataggccttaaatagctgaactgtacaatatattaaacatttcaatattctctttatgttcttactagtgtacggcaaaatacctggtttaattaccgcaccggatatattaacccggtagaactgaaaaaataaaatatgccacatgaattgaaaataattcatggcaataacctatttttattttcatgtgagttttctaccctcatactgtagactttgatcaaatattgtgtcaaacactacaattttgttttgaatagatacattatgccaaaaaaaaaattcagattttaaattaaagtgctttcataaaatgttggtagtatatatacgattaatattaaaatattctatgaaaatttaatgaccaaagtttatttctcaaaattaaaataaaaacaaaaggaaggtggtggttatgatatcgagctagctagctaggggacaaacgtattgcagatttgcaatgaaaaaaccattatattcaaatatttccatattatcaaatagaagactggcatgtataactaatcagtcgtgcatcacatatatagtatcccaaaacgcactccaatgataagatagaatcatagttgactaacccctacacgatgaatgattgtttaaataatgccccgtttacttgcaacaaacagttgactactttgtcactccattcttttacacaatttgtgcttatccatttactggagatgtctgttcacaattattgccagctaggatatgagagcgtacttgcattgtctgtttttttctaaggaagagtgacatagttattgcaacatagatcatattccttagatcatattcctttctgcttattcgttctattattactggggattatttatttcatgttttttaaaacaaaatatttttactatattaattataccacttattctaaaccatataataacacgacagtcttcactattatatacccttattataataatccaataaaacaacatcatctttcccctcttgcatacactcttatgtaatgaaataatgaaagagcctcatcatcatacatatttaacacaatacaaacatagacacatatatacatatgtgcatttataacttatccatataaatgcacacatgtgtgcatactcattcctgtaaacgtacacacgcatactttactcctatatgaacctatccaaaaggcttgatcaccatatccttatcagcagagactaacccgcggagccataaatacaacaaaattgaaaccgattaatttctagataagattgacctgatttctttcaagtccaatcaactcccagttaacagatggtacttaactattcgatatccctcctcctgcatgcatcacgcatatggatgatcgatggcaacgtcgatcgttgtgtagcgtttggacccgtcgaccgggttggcgacgcccccggtcatccccggccgcatacaccgtcctctcctctccggctctccgtatccacgacacgccgccccgccccgctgacgcacgcccccggccttatgctagctagctagtagtacaatatagtatatggcaatccgccatgcaaacacatatacgtcggcaagctagaacctgtagcttagctactccctctgctccatccgtattagttactaattatatggtactttaggtttatcaaatagaatttaattaagtttgtagaaaatataacataacttctaataaaaataaattcactataaaacatatttagttatggatttagtggattaaatctatgtttgtagatgttgtcatgtttttttataagaggtgttctatgatattctctggtagaagtgtactgtttatttcttcttaatatagatgtcatgtatatttacgggggaatatccaatgaaaaccatcaaataagtaaaacccgtgaaaaccatatctaaaagttttgtaaattcataaaaaaattactagaggtaggtataggcatgaaatacattcataccagatctcaagtccaaacttaacttcatttgagagaaaaaaaaagacaaatttcgtatgaatagtgttatgttattattcacctcaaatttgtttttttgtttttcccaaatgaagttgagtttggacttgagatttggtatgaatgtactttatgtgtatacctatctcttataattttttcatgaatttaaaaacttttagatatggtttcacgggctttcacttatttgatggttttcaccggatatgtccccatatatttatactatcatatcaactactgatataaacgtagtagaatattttctttcattggtactacaacttagaaaataactaccaaaactatttctaagaccataatactggtataatatatagtaatacaagtagagtacttattatatcttaaagaagtttaattttaaaaaataaaaatacagtgtctaactacctagctgttgtatgctcacgagtatatacatggatccatttagcagagctacagctcttaaaaataacttcaagagcatacttagagtagaatttgtgaagcgcgccaaacccttgcttcacctagctctctagtttattttactgagatcagtaaagcctgctccacttctctcctttatatggatttaaaattgtttggttatgccacggctctagaaaagatggatctgaacctagatccggccatattatataggagtacgtagctagtactagcgtatacgtccttgccgcttagctcaaagtcgtcgccctcctccctctatttattcgccccacccctcgctcgagctcgctcgcacctttgccaccccccaccctcgatccagagacgcacgagccaaccttgctctcaaccgttaatttcctctctccacgactcgacgccgcacgacaaaccagcggaggcgctcgcgcgctcgccttctcctcgccctccatttgaacaaccccttcaattaactcctcctcgatcgctagctctctctctctcgttgcctcctcgatctccttgaatcgatcagcggcaaccagcctgatcgttgtttgctagttagttaatttccgtcgccgatgccgacgacgcctcgtcgcaaggagccatgaaccgctgcaccgacgtcgagatcaggaacgcgctgcgcctcctcgcgcccaagcccaccgaggacatgtcccgcctccaccaggcctacgaccgcggctagcttagcgagtagctgctactagcgttcataatcattctgtgttccatcgctcgagttcttgaacacgaagaggagcttagtagtttgtgtcagctgttagtttaatttgtgcatagttcgctgcgcgcggcgacgacgacgatgaaggaaggaggaggaggaggaggggagaggaggaacatcctggccaagacgatcgacaggtgccggtcgtcgctggggcaccggacaacgaggcgccccgcctccgccgccggcggcggcggctacggcggcgcggccgtgccggcggggttcttcgcggtgctggtggggccggagaaggagcggttcgcggtgcgggcgcggtgcgccaaccacccgctgttccgggctctgctggaccaggcggagacggagtacgggttcgccgggtgcgagggccccctcgagctcccctgcgacgtcgacgccttcatggacgtcatgtgggagatggagcaggccgaccccgccgcgtccccgcgctgcggcgcgcgcttcggcggtcccgccgccgccggcagcggcaggggctacgggggccacggccaccaccaccaacaccaggggtaccagatgatgagcaccccggcgaggctcctcgtcgccggccgctcgtgatcgatgtctcggcatctctcgcgacgccggccatcgccggcgatctcgtcgtgcccgtccttagttaatcaatttgctgtctgcttgtaagtactatagtaggcacgtgttgggcgcatgcagagagaggtttgttcacctgcttgcttgctttgctatgctatgactgtgatagggtaggggtgttcaagttcaactgttcatgtcaacgtttgtttccatgtcgcgttcgatgtatctctgtaatcgtagttttgtatgtgtgagtgatctcatgcgtgttcaaccaacccctaagtcgataaaagatcgatgcatgtacatgcatggtgttttgttcagtgttaactgtgaatcactatgaataaaaagactatagtgaatctcagttctgaatttcaactagttttactctatcttttgtggtgatgtgcgcccttttgcatctgatttcaagcaagctgccaaaaaaaaaactatttagaagctagctcttcatttgatgaatgcgtgcatcggttttttcttcttggatctcaaggtcaaccgtttggtgagcctccccggagtctgaactcgacaactcagcctcgaccaggagagactacgcaaaatgaaaggcttttcttgagctagccgtctcctactctgcttcgagagccaatagcaaaaaaaataatactaccaatatgaacaagtcaatatcacacgaaagtctaatctaaagacaacttgatccgtataaaatctgaagaccagttgatcatcttctgcggttgagttgggcctcgtgcatgaggcacaggttattctgacctgccacttgctgcccttggagatgctctggatttctaaaacggtagcaggacacaatcattgccattatgatacaataaaaatgacctcagcgttctctgtcctctacagaaatgtcagagacatcaacaaatcgtcatcgcaaacaagaggacaagtttgacaatgctcacagaaatacttctagcagggatctagtataaatggattcgggaaataagacaaggaattacaatatggcttggggcaagttgcggctgaggtcagattgcatgccgacctgaagaaaatccaggcctagcctgccgggattacatttccctgtgtacagtaatgatagcccacccaaccaaacaaccatgacgtctggacgccacaactcgacaggtgttaacttcagaggcatataagatggctacacaattatatcggcatcaactttttttgatggcaatatatctgcatcaatcaaacaattaaaaaaaggaacacaaatccaacataaagatgaatcagctcacatttaaatatgtgaaacagacaaattctcgatatacaatcagggttgaaggctggcactaacgttacagctacatacaccttgagtaaccctcgataccacttctggcaggtcaagccccatccaaacaggatgggacaatctagttctactgaacagcatgaaagagccaaaataaaaaatacagtacaatatggaaaactgcaagtgtactgctatacacccatttctgtacaatgtttgctgcactggtctatgtaagctggtcaaaatcagagatcaactatattatgtcaagttaactaatgtagtgataaacatcatctgacctctagaatccattggacaacatcctgaagcagctcgaacttttgactgaccgcaacatttaggaaaacccgcatcttgctgaggaattgcgatgattcttccttgcaccggaatgcacctccacaggagcactgctcagataagtgtgccgctttcacttgcctgcagcggaggcagaccaaatcctgcaagtgatagagcctctctcgctgacggactacctgtagaagtgcattttccatctgttcacgatggtatggctgcccgcactgcggcacagcacacctccactcctgaccttggagtgttgaatcacggcagagatcaagatcccgacaatcattgcaatagctgcaaacacgatgttgttacgtaagaattagtaacatcaagggttgatgaaaactagtgcttattcaccagcccaatacttacaaacttgtgaattttacgaattggaataagccatggtaggcaggtagtacaaaatagtagctagtacatgattacatatagtcaaaagcatgccatattttggaaaaaataattttgacctagtttattttccttcttccaaaacattaccatgttttcaataatattgttatccataactttctttgactcttaaaaaaatggcaatcaataatgcttttacagcaaatggcatcacctacacctgacctaagtgaatcggtcacagttgtatccatagacgtatgtttacatcttaaaatgttgattatatggaaatcaaataaacagtttctacaatttatcttagaggtaatacctgcaaatcacattggggagagtgaatgaggcacatggatcttggaactgtgcttctggagcaaactcctttacacgaactaactttaacaagttcttcctcattctctgtcagatatttttcaagtcaggtcgtggcacagttttcttagaatttagatacttcaattttgtaataaaaactgtcaaaaatcaaggcaggaaactcctatgttttgaagagatagaaatatgggtgtgaaaagatatacatgcagttccacaaaaccacaacatatattttgaacagtggatcctcatttagcacatcagtgaaagaaaatattatatttttggatacaagttctacagtaaaagcagttaccatcagttcacaatggattaagaggcgaattaccagaatatcatgctgaacattctgatcaagagcaagaacagcacatatatgcttaatgaactctaatgcagcatctcccttatgtgtgtgaggatcaggttctctgtttgtaagttcaactgattcggacttgccttttcctttgaaatgatgaagtatatcacttacaatcctgagaagcttgtctgcaaagtaattacttatctgcaatatcagatatggaattcagattaaagttgtgtatgttagtcgcactagatgataatcccagtcccaatgttaatatatactccctccgtcccaaaacataacaacttttagccttcaggacttgtcccaaaatataacttcttcaccaacattctctccgcaaccaatcacaaccctccaccattcaattttgccacctacctccacttctcatccaatcacattgtgtgtttaatggcgcttccccatgcttggccgatgtcctccgagacatcgctaatgagggcgctctttggtgcctagcaggagctgctaggcttcgtgatctctttactaggacttggctgctattgcactagtttgtgtttttttttcctttgggtgtatggtattctgttgtatccttgatgggtgggtgtcagagtttttctctaacaccgtacaccttttcttctctatcttaatgaagtgatacgcagatctcctgcatgttctaaaaaaaaccatgtccaaccctaaaaatccttatattctaggacggaggtagtatatactttgacattgagcaacatgcatttcaaatttgaactttttaacagactattaagattgaccttggatagtttcatcataacccatcatatatatttcttataacctttgactaacaaattgttataaaaactatctgaattacccacactagatactgcagtatttacattttattttttatacaactctaattgctatgattgaaaatatatttcaactgaaacagatcagatgtcaaaatctgaccaattttcaaataatctagatttttctcctttttttttccaattgacataacagttttaacctctcagaattgaatgtggtagctcctaccaagtcattttcatttaactgggagatggttactggttaccaatttaagattgcactatagagccacaaaatcacctgatc

SEQ ID NO: 31167 - DNA, 1265 bp, Oryza sativa
gaacaaacctggtccatgaaaagtaaggagtgccaataatgcaaaggttccagctccacccactcaaaaatatccctaaaacaaataactttagtttcacctaagagataccccattcaaatttgcagggggaggtcaaacagtaccttgtctgcaatgttttcagtaagctatcacagtatgcacgtgctgacaacaggtcaacttttccagtatctattattatcttagaaaagttcgcaaagatgacattagctccaagctttcgaaactctgccaacatgagagcaaagaccttcttcatgacctgattaagtttgataatccaaaagagaagacatgataagaaaagttagacaagaaaactaataaaggtaagatgattatgaatagaaaaagatatttattgtaaccagaacgacaagaagattcgcaatatcaacaaaagaaaggacagtgcacttagttacatagcttacattatgaagaagatgatggagagctgggtcatgaagtttcgatcgtgggctgaaaaaacacacacatcaacatgctaagaacacataaagttaaaaaaaaaattcactccctctggtcatgaatacatttcatattcagtatcaacgcagtatccaaagtccaactttcataactaattgatattgtatacattcataaaacccaataaaatcataatatttttagagactaatctctagatatgatttttcgtgtttctagcttaaatatttaagatattgatactcaaagtttcaaaagtacagctgcatgtttgttcaaatggcatgcattttttactagagggaataataactggtccagtgcaaacacataaataattacctgcaaagccaacggtagagatgttgcaatattgcatcagcaaacacatttccagaagatactgcatctgaaatgcatcgctgaatgagttgcttcagcacttggaaagcaggtagacataaggtagcatcatcgaattcagtttcagtgccatttggaccagcaggcatgtcatttgcaaagctaccgatcggccctccttccatttcatctacttgactgctctttaggagagaattgacagccaaatgatggatctggggaagaaatatgtgcacatgtaattcaattgccagaagatacaaaataagcatgccatactttattgtatgttgaaaaggcttaccttaagctcaacagcaactcgtctatacgcaccaggataagtaagagcaggctgg

SEQ ID NO: 31168 - DNA, 265 bp, Oryza sativa
acagtagctcatcaactcatacttgatatatgggtggtttgaattggaaacccggactatagtgaatctctcttatttccacctggcacaagagaggaaacaccccctgatgtgtaaacggtacctcttacaaaacacatgcagtggtggtcaatccgttccgcaataaagagctatccccatcatttcttgaaaagcaatatcgagatgcttgtcaagctcttggctctctgcatgaaaacatcactttccttggaagaatgaa

SEQ ID NO: 31169 - DNA, 6496 bp, Oryza sativa
  unsure (1)..(6496): unsure at all n locations
aagggaggggtggggggatggttggcggaggcgaggacgggaggaggaggaggtaggaggaggtaggtgggtgtggggttggggttcgtgggaggtggtgtttggatttcgttacttaacttttatttcatggagttagacactaatttagaggattaaatatggactacttacgaaactaattatataaatgaaagctaattcgcgagataaactttttaaacctaattaatttataattagagaatgtttactgagcatcacatagactaattatgaattaattaggctcaataaattcgtctcgcgaattagttcaatattatgtctaagattatggatgagttttattaaaagtctatatttaatatttataattagtacctaaatatttaatatgatagggacttaaaacgtcccgacgtctcgtctcgtccggtagagaggccggcgtgagaaaactgcgaaaattgggggcggtagccggtaccaggaggacgttaggtgtgtcggggtttttcacttttttgctcccgtgttctcggcggaggtgaggtggcgcgggcgcacggcgtaccacggggttacggggttggtattgtggggtacggtgcggcgcgtggtgtgtggcgcgaggagggccgggagagcgtgaggctcgtcaccacggcacgcgtcagcttcggcctcgggtttgaggcgaggcggaaacgaatggccaggtccaggtctgaatagtttctgctaccgtcaactgagacaaaacacaagaggcaccaaaaacatgaaaagtgttttaaactcctgatgtctccgtttatttttttaaaattcttcgagtggatgccctctaatttattaaaacactatctaacatttatgatatagacataaactacttttaaaaaaatcaagtcaaaactcaacccacacgttaagatattatcaaatgtgtagattgaatttgaatatgatttttggtgtagtggtggactttaatatactcgttcttaaattatttaaaattatacttgagaaaaaaaattatatgagagcatattcccttgagagtgagagattagaatcatcccccctcaaataaaaaagtgctcctaccatgtgaacgacactagttttgctggtcgtgtaagggtattagttactccatccgtcccaaaataagtgcagttttacactatttatctccaacgtttgactgttcgtcttatttgaaatttttttatgattattatttttattgttattagatgataaaacatgaatagtactttatgtgtgactaatttttttaaaaaaatttaaatcaaatagacggtcaaacgttggacacggatttctactgctgcacttattttaggacggaggtagtactagtccacgaaacttaatttaagttaaaataaactatgaacctgttctattttgacttataaattagttcataggttagccgctacacccctacaactgtgtaccactccatgtttgtcgttaggattggcttttttagacataggggtacggattaagaagcaactagtctaacacaacggaatctatactactagtagtgctagtaggccattagctgtgcaaacactatgtttagtttatgtgctaatttttttaagtatatagacacacatttaaagtactaaacatagactaatgacaaaacaaattacagattccgtctgtaaactgcgagacgaatatattaagcctaattaattcgttattaacaaatgtttactatagcaccacattgttaaatcatggcgtaattatgctcaaaagattcgtctcgcgatttacatgcaaactgtgcaattagttttttttctgtccatatttaatgttctatgtatgtgtccaagcattcgatgtgatggaaaagttgaaagcttgaagataaaagtttgaatctaagggtgtgtttagttcatgctaaaattgaaagtttggttgaaattggaatgatgtgacggaaatattggaaatttatgtgtgcaggaaagttttgataggttgaaaaagttataagtttgaagaaatggttaaaagttaaaagttaaactcggcctaaacacggccaatatgtaaaagcatggcatcctgacgatatccgccgcttcaaacgtgggaaggttgtccctgtcacgacgacttggcagccggtcgtgcaagtggggattctacgacgtttttgcactcccttcttctcaggcacggcagagtttatctagttctagaaagcggcatttcaacatcagcaacaccaacactgccggagcatttcttttttttttttggggtcttcccttcttattttccctgagcgtagaaaattctgtggtttccagttttccacggaagtaaattccaattttccaatagatgtacgtcaaccctttgcttcctctccagctgcagagttgcaggtttgacgaatgcagcttatctacaaaattcccatcagagggaacacagttacagaagaactaggggaagtacagattgcanatccataaggatcttctttagaaccgtatacgtaaagggcttcatggattggccactatatatgggtgtcaccctcaatcgtgaatctgcaaggtcagatatcagtatatcaaatgcagattgcctcattgcagattgctgtggattgttcaggttccgggttagcccagtcaccagtcttcactgacattagcccgctgtggttacatcagatagtaacaagctccttcatcatttcggaattcagtcggtggtaaggcatcggaaatggcatcaaaacaactcttgctgcctacctgaatgtatcacgcagggacagattatattaagtttgtggtccacttgccaattaaacgaacgcctcattataagtgaaaagctcacctttcagctatccgtgctgccatcatcgtcatcttcatccccagaagcttcataacgtggctgatcatacttctcacgaagctgcttgataggaatgaagtccccagcagtgtcctcgccaaaaaacagaaattcaatataggggtgatcaaatcttccctatttataaacggggacagcattagttcaatttgaccaaaaatgaaaaccaccaagcaaatgaagaactcaaactcactttctctgatatttcagcttctgcaagattttcttctgcaactgaaattacacagacataacatgtctcaaaatggcgcagcataggcataaaacagtaagtgaagatggatttgatcaattgactactgcatagcctactatcttgccttcttctgccattttacacaaaacaagattgctcattaaaagttacagatctcaagatagaatttccaccagtggtcatgtctatcaaaatagtggaaaagaaaaatcaataccatatgcaacaaggagttctggatcagcatatacatcaacaaggacctgcaagatttcagcaatgaatcacagaggatcactaagcatctcaattctcaaaagactaaattatgcaaacacatcagtaattcagtatgcatgggcactatcgtccaaaagaaagcattaattgcatagagaaacagtcaattgcaggctaataaaattgcatcatgaacggcctgattatacccaaaaaatccaaaagggaggagaaaaaggcaatgatgaatatcaccatctcaactccataagtgagtttgcaaattaagaacaagaacaggtaggtattattacacataatcgccatccatgatagataagtcacaactgatgctacatgaaggaaatgatatttctatgaactatgggcattgaggaactactaaatcggaataagtcaagcagcatttacttgataaaaaggttgattcggtcctttggacaagttttccacatttgctgtctccatccatgacttggattcacagcacacaggatccatgccacaaatcacagctctatatccttcagcaggtgatgttatcatgtaaaattaagaagagaaactaaagtgtgttcactgaagttaatatttgatataaagtgtgcttcaacacatgcaaatgttccatttaaggataatggcaattatgaaaaattaacttttcatataaagtttgaaaagaaattgtagtagttatccattttctgaacagcttcagaaataatgtgtgaacaacaatacgaagtaggtagtatagcagtactcaccgtgtaccttatgacgtactttctgccctagtcgaaatgcatattccacattttgatatgcaagggccttagcggagactgccagagactctgtctacatgatgtttgaagttaatatgttattaacacattaccatcacatggtcggtgcactacagttttgttgtacctcaagtttagcaatttcatcacgcagtgcagctgccaaagcataattttcactgtcaacagccttttgcaaatccgcactgaaacaaatggataaagctaagtgatctactgatctctcaaatgaaccaatgctacataacactggaacatcatggagaaatggaaactattaacataccgcacgcgtaaaaggtttatagctttgtcctgagcttcagtctttgatgagcctcttttagcttcacgttgcctaattatctctgtttcaatctagacgaggatattttctttagcaagcctcatacaatgaattcatttatcttcaagtgaaatcatttggtacctctgtgagtttttccctcaattgttttgccacatcaaattgctctatattcaatgcatactggtaagaaccaagaaattaatagttaggctggacgtgcatagataagtatcaaacatttgcatggaccagtagccagcaactaagaatgatgcaattatcatgatggtagatttcattagccgattgctactagtctatggaattgatccgtgaaaaaagaatcgttgccggctggattggtaactttatttgctttagaaaatgatggtaaggaagcaacaactcacctgtattcgggtttgtaggtccaattggaagtagaagattaagatgtcttcgttagcagactcactgcgttccagccttgcattactactgctacggtcatctcctccaaatagccatttagcgttagttctcactgtagtacccatttgccttctattggtcctcatatgtagttttttcacacaccaacgccatgagtacgctccacatgttattgaatttattttgtaaaacaacctcagatcatccactgcaagacaagctggtctaaaacatgatccatggggcgaggaaattgaaccacatgcaaaaatgccttgcattgtattggtatgagatttgaccagttcaattcccacaactgatgtagtccaatcaccacactgacagttgcaatcagcaagccagtggcatctccagctgcgcagagaacaaaaacattttgcttaaaactagtacaaaatgcactaggtaactaagaaaggctttgaattgtggcatctaaataattacaaactactattaactaacaaactaacaagtagtgcctggaaccctaccatatcgtaaatgtgcaataaacattttactatcttcttttttttttgtccgtagatactgatcaatctattctgaattattgaaggtaaatcgcacctaacgtggtccaggcgagtaagcaaagaaaccctcaaactctttggaaataataaagtgctagaacctaccagtacgctttgtttcgagtaatatctatcagtgctctctactatcacgcaaaaaaacaaaatcctcaaaaactaatgggttatacgggagaggtaaggggttgcccgcagcaagataaaacgccagaaaaaaaaaaaagctacgaaaccaatcaaagaagccacagttcatcaccaaccgaagaaacgaaaccaatccaacccttttcagaaggaagaaatcctaatgggactccggtctacgccgccggccatgtagcgagcgtggagagaaggatagataccttttctggccgaggcggcgcgcgcttcggtgggaggaggaggcggggaagcgtcgacgagtctcggcgaacggggaagaaagggggagggccgcgcgcttctcggccgtaactaccactggctcaaagtgtggcggtcgtcgacgggataccggatagaatgtgtgacctggatcaggagtgcatcgactgcaggttaagcacttgggtgaaactgaccgtccaagaaccagcgaacgtttaggattctctgacctcgccttctccttcccttcccttcatcaagatttggttacaattttggggcaattgcatctacgcccccactttcaaacccaattgctgttttatcttcactttttagggacatgtataccctctgcatccagcaatatcgtgcaggggaggacctggaacaagggacggggaggagggcg

SEQ ID NO: 31170 - DNA, 7593 bp, Oryza sativa
tcgcatgctgctaggattattatcacacaggtttgctgtgtgtatcagtgtatagtcttgttcctgacagctagctagtacctagcatgcctaagtcatgcctttgatactagcctagctggttgttgtgcatgccaaatccctgtaatagctactagtagacctgtaccctagctatgtagggtacttattatggaggagcctagtagcctagctatgtgtctaagatgggttgcatctatttgttgtatcctataccatgcacggattagaccggacaaataattacctagattatacatggatacaatggattattctaattagatatgtcatgttgggctcttggttataccacatcttagaaactctagtatgtgatacatagatgctagattatcatatatgatatccaggtattgggtcgaatacctaggtaccaagtatgaaacctataaatacaagatctgatgctgagttatttggcatgatacctataagtaccggatctgataactaggtatggtgtctgatacctatgagtaccagattggatacccgggtatcgggtatctgatctcatacctatgagtatttgttccaatacctatatgtaacgggtcggatacccaggtaccgagtatgatacttatgaataccaagtctgatacctaagtatcgggtctgatacctatgagtaccggattcaatacctaggtcaggtttgatacttatgagtatcggatccggtatcgcgcatgatacctatgagtattagatcggatacccgggtatcgggtatctgatcttatacctatgagtactggatccaatacctagataccgggttgatacatattagtagaggatctgataccaaatatagggtgtgatgatacgagacttcagatgtgataccactaattctaatatttatgggttatatacttctattcaacagtcaaataaaaagatggaccatgcatagctaggccagaaagtacagccaaacttgctcacgtgctgctgacatgctttgtttaggctaatgctactagctctagtgcttaattctaactttactagttgaagcaggtgttagacccatatggacctaaagaggtgtagaagtagtgctgtattagagtatttcatagctattttgtattgtaggagaaaagagacctctcgtcagtcatcactagtcggtagcctccatgtgaaaggacagcacacgacacgctttcagagagaaaaagaatcggtgagtgattagtaagtataaattataaactataccgttgagacggtacaccatcccatagtttttctcgatccttatccattcattgaagggtacaacagtaaattaatatttcataaaaagaaatttctatttctctttgtgggacccagtgccaccgaacaggcccatttttaacccaaaactgtgggacccatctaacggggctaaaagtgagggcaaacggtgggttcatgttcaaaaagatgaggcaaaattgcaaactctaaaaagtaggagtaaaacagcagttgaggttcaaagtgagggcatggatgcaattatccctacaatttttggcccaaaaggaggaacgcggttccccgctcatctcgtcgcctgttcttcacactcgtcgggcactcgagcacaggcgcacggctgtcagatatggcaacggaccaccgatttggcattagggacacgggcacacgggcccgacgttagtgtctagcactccagcgtagatgtgcaccgagtgaccgaggccacagagatgcgctgactgcgttgtgctggtgcgcctggtgcctcgtacatacaatacaatagttttgagaccctcatacaatacattactccctccgttccaaaaaaaaacccattcgttgctttaggaagggtcacgttcccttctagattaagtttttttttttttaagaatagagtgtggttgttatgtcttttttttttcttattcgtgtgcagtactgtaatgcattagtactgtaatgcattaggtacaaaatgtctgatgttgttcgagggatgagttcatgagtacaaagaaggtggatccttcttttgcgacaagtagggcgacatcgtttggctgattataagcataagcaaatgacatattagcaaataaaaataatttgtgaatataacgtttatatacgtattcttaacgatttaaaaagcaaagcctacaaaataaactacgatgaaaaaaatcccaaaataaacttcatatttaaggttgaaatgcatattttggctgataacatataagcataagctaaaagataaggccggtagtatctatttgaactttgtgaacatctatttcatttgctacggcacaaagtgtatgtgctagaacatatttttctttatttcttcattaatttcttatggcacagtggcatgatagatatctttgagccctcgttcttgacagtactcaaaaccatatagtttttcctctctttctgcttgaaaatgccatcgatcgatctattgtagccgtttgttctcaccagcccttcgaacggcaatttgaagccttggttcaagatttttcaatagttcttcctgtttaaagttgaattcgaaaacatggaatgagcgtttgacatgtttcataatattagtttggagataagaacataacaaagaaaaggaatagcattttttcagtttataagtataccaattcatattctaaatattataaatagtgatttgatcttttttgtgtgtactacatctcatcttaactcagttcatctaaaaaatatatatattgttctattgctaacctctaaacatcataattttcccattcgttttttttatagcgtgtacatcttttcaaattcattgatgtgtacacaaccatcccgtagcaatgcaagggtatcagttagtttttattgtttctagcaggttttatccaatatcacatgtatatattacaattaagagtagtttaatttacacacacaagaatatatgtaagctataggggtaaacttaccatcaagagggacctatctttcaccacactcaaaatatatacagacaaccaacaaaaatctccaacttgcatgcatttgtattcaaccaacctcgggccatcctggcttaactaattcagacaagcaaacagtgcctgttggatgtggctagccaggctaagctcattcaggataaggcatacagcctaggctgggtcattcggtagcagaacaagcttccggcagcaattttttttttcggaaaaaaaaagattcttttttatgccatgaacgtagagaactttttccaccaacataatgtaacgggataaatggcgaatcattcttgtgtttctgaggtcaaatggtcaagtgaacttccagcaaacaaaataaggttacttattataatgtcgtaggactgttacttgtagcataacaccgagctctgcctcattgtctgctatgagattcagcaataataaccccatgaatcatttgacaggtgatcagctcatagcttcacaatcgtcctacaataatggtgataaaatatttgccaatggatgcttactcccgaaaatgataggccaagaattctatctggaagatcgtatgacggttccaagccaatcttctgagctcgtgtccccttttaaggctctcagtgaatgttctgtaccaacctgcatcagaagtcacacggaaaaaggaaaaaaaagggtcattgaaaattttatatacacaaagtcatgaggggaggaaaaagttaccagacctttgtaatatacacatcaactccaagcctagctatcgcagcagcttccaatattttggtctccattccgccagtggtgtcatgtgcagctacagatatctccactgcaatgcatatcagattatctttgttaggattacacaagctacaacatacagtttatctttattatgctggtcaaaagaacagtgtgtctttatcatgaatttcattagcccctggcttaaaagattatagctttgatcccaatactcatatttcaaactgtcactcctccataagtatagtatttgatccaaatcattgagacttccaattttctctgcataatgcgtaagaacaaatgatgtatttgttcattagaagttattaattgaaaaatcgtcaccggtagctacttaatcatgtgcctgttacgatctgataattttttatgtacttgaacttgttacaacgaaaatagttgcatcagttactcagtacaactgctatgagtaactcaaccaccagcgtacacatggaaggaagacataaattatacctcctttcttgttgcctttcaatgctggttttacaatcgaccagctgccattttcatccaccgctgtttaaacaggcaaacaacacaggtcagcctaagacagaaagcaaatggtaattgcatatcttttacttttcgtgtgctccctacaatttctgatgcatatcaaacaggaattccagtaggtgagtactgaatgctaacctatctctctgagaagtactgcattcgggtctgatggaggacgatcaaatactccatggacatctgtctacatctcaattttcagagtgctatgcaaaagcaactataatgaaggatgggcaacatatgcaaagagtggtgcacagaaatgtgatagaacaaggcctgtctgataagtgataacagcaatacgaacttcaagtattagaataaagacatttcatccatgtaaataatttgatgcacgcaccatctcacatacataatataaattgtcaagtcatggcaaaggtgagaaggcagcaataccagaaatacaacatattttggactcagaagctgtgcaagatggcgtataatgacatccccactcaaaatggtgcagtcctggtcatttaattataccacataagtcttgagaagtacacaaaatgtgtcatagtccagagagacctctatgtaagtgtaaattaggacatgggcgtgattcaatccaaaagctcaccagcaattcatcaagaacagcatctccatgcaaaacctggaagaaattttttatgttctttttaatgtagatgaagaaaacataagtagagctgtggaagtatgcaatgctttccctattcttgaaacatttcctgaacaaaagtttactcatagtatgttcaaatatctgaactaattcattatttaccagtacaaaatctcagctaagttggtatagaaaatgtattgcaaaataggatgcaacttagaagaattaccagtgcacataacatgtgtaatgaatatgttacatactacataaatattccagaaacgccatatttttcttacaatatggatacataagaagtgacccatataactacattacttaatataaaactttagtcgttgtaaattctagagaaataattattcaagattatgaagtacaataacttacagggacaaagccaacatggagtgatagcatgatttgagaagcatccactgattcaagctgtaagtgcaaaactggaaggtaaaaaatcaaagggcatctctgttgataggattagacatagatcttcaagaactttgcaatgtcaagtccatgtccaaagaaacagaagaaatttagttaattgtttgctttctcacatttctttgcttagtagaccatccacaagcaaacggtgacatcccaacagacggtattccttctacagaatcatacacagttcaaaaaagacatttacttaattattagctactgatgataaaccgacagcaatagactgaagcaatgcatcaagatcatataaaagatggatacatatagtggttagttcaggattaagattacataggaaaattgttcataacaaatgacaatggatccttggatggcacaacgggttaagtgaagaccgcacagtaaaattccagacaaaacacatatattctctagattataatggagcatgagtttatgacaaagtaacaaaaatgaccacatagatatcctgatagcacgaaagaaacatgattgtgattcaaatatgaagagtggtccttcatctcaatgttgtgtacctcttgcaagagctctaacaatctcctggttgagagaagtgacctgaattgtaatatgcagatcataagaattatttttcaagcatgcgcatcaaagaagcactacatatgttgacgatatactgggcaacaaagatatatctctgaaagtaagatggagaaaaaaaatatagattataatatgaacgtgaaaggagaacttcaaaaactagccttactgaaattcttgtagccacaaagccagccttcacaagtgttgaatgaagaccccctttatggactccagatctacttgcttggaagtgaccaaaagaccctgaggtagcagatgtaggtagtcagctattacaccaccaaaatcgtgggctgtatcctttaaactacaacaggccaattatagtcggccagtattacaggcatcatgaagtgtgagctattttctttattctcccctggttgcctaggactacattttcaaatcaaatctttattgatgcagtggaaagtcctaagcaggaaggatgctgagaagctggaggccatggctagcaaacttatggaagcagtctcctcccttggtcctcccagagctggagtagggtaagcactgatgctttttctgtggtgctgttggttagctgttatctgttgagttgtttagaggtgcctgagttgtcttttgcttttggtcgcttagcttcaacccctttgtatcccttggcatggtttggtttctgccctgtttctgtgtttttgtgctgaactcttgtaagtgggtctcccccaccactgtgccgcttctggctttctataaaagccgggcccgatggtctatgatctaaaactatattttcagggtgtctaccaatcaaaacagatttattcaaatatattccacgaaggtcagctacgttccgaatatagaccggttaagcaggtcgtgaacaatgtttacaattgcttgtcattgatacacattgagaatggtacttggttcacagtttcgcaccaaattttcacttagccgtagtagtattctgaaaccaaaatacagcaatcaagctgatcctatcgtctccagatcccaaccgaccaccgatcccccagttctgctcatgaactcatcagcaatacaaaatgacagataggcacagttgttagttcagatgaggagccatgcataccggcaccatggacgacgacgaagttggagtcgagccccaagcctcccatctccgacaagccctccacatccacgaccgggccggtcggatcgccgggccgtctgctccagtccatccccacaaccttccccgccgcgccgccgtgggacatggcctgccgcagctgcgcgcacgccgaccgcaagctcgccgcgtcgatgctctccagctctcccttgttcgtgatggccgctccacctgcgccatcgaagctgctaaag

SEQ ID NO: 31171 - DNA, 9857 bp, Oryza sativa
tccggcccatcaaagcttttccatccgctcgcggatattctcggcccaaacctgctcggcccgatccgtcgccaacaagagcaaggcacgaaaccgcaacccttccgacctcaccgtctcaccgccgcatcccgctcgccggtcaccggctagacgccgccgtcgcgcgggctcctgggttgccgtgtctccatcgcttccttgttggcctgttcctgcgagcttcgccctctggcttcctccctgttcgggatccgggatcgtgtgtctgcctctcggctcgctgcgccgccgccgccgccggctcgtcccgtctgtgtgtgtgtttgtgcaggtcagtgttattttgtaattttactacgagctcagattcgtatacgttttaattttgtgtgtatgtgctactattcaacttgcatctgttcaagcgggtgacagtgttatgctgttgtacattagcattgtgcatttatgcatgcattttgtttgagcattaatttgtgcccgattcagtactagttttcctgttagtatttaccttttgtctctgactgttctaggattctggcttaaaagggataatctatgccgtcgaaatcgtggcatcagttgtcattcaattcaatccccttgttgattcatgtgcttgcagttgaaattggagtaaatatacaatgaggctgttgaaagcggatcagttgttcaggaaagtcattgacggcgggtggagaaagcaatctcgactgcttgggcttgacgttggtagtaagtatgttgggctggctgtttccgacgacaaaaataggatcgcattgcctctaaggtatgcacttcaaactattgtagctgaatattgtgttccttgatccaaaggtttcactgagatagtgagatgtttccagaacatatttagcacaagtgattccagtgtgtccataaaaattagaacatcactttctatgtgatgatttaaatgcaggcggttctatattccattcctctcatggattagtaggaatgttgagtttccaactcacatggattagtaggaatgttgagtttccaactcatttcaatggatcggcattttttgttgtacttcattcaaatcattatcatgttggattggaatcttccaactatcagaatttgtttcagtttgtatggtctctggcttttgtaagacagtctattattgtgctgtgtctgttgtattaggtccttctctttgattaattcgactatactaaacttcggtttgttagaaaataactgtagttgccttcaaactttaaggaaaattatttgcaatttacaatatatcgatacacaagatcttatccctactatcatagtgtacctttattatttttaaaaatattagtctttaacatatttaagccttataaggcttttcttcacgagaaattcttcacttaccattgttaagatggacggactgcacttggctaaagctgatatccttttacctacctaagcactcagacagagtggatctagatttgctgaagtatgcgtttatctagaattttgtggtcattgtctgcactgctagcataaggttatctcaggataacacccctgttttatcagatattgactctcttgaatttgcaacaatccacctgcctacctggttttttgtggccaatactatgatagtttagtgatgggatatatgatctgcatgcattcccttaaagaaatggattttcctattgggattaacaattgcattgtctcctacagtgtattgagcaggacaaagacaaacatcagcttgatggcggatgatttcgtaactttggtatgctgaatatgtttactgacatttaaattctggagtaatcagattgtagaatcacttaccaaaagatcgagttcttaatatgccatgtaacatcatcctacatcagatcgagtgcttaatgtgccatgtcacatcatcctgcatggctgcatcgcatgcctgcatactgcacaagcaattttgtagcatgtgtgttgaggttacgatgcatttatggaagccagggttacaggccttctctaatatgctgttctttactgctcaatttactcatgtcatttacatttccaaaatactcgagggtgacattgtccacaaagaaatcataaatgatttagcaatagaagttacagacagctcatgatgcatatattctttcattttagattctggtgaacatttaaaagcactcatgttttgctatttttcatacatggaagccaattccttttctttgtttttgtgaataggtctcaaaatactcccttgcaggctttgttgtcggctatccgttcaacttgcagggtcaatctagtccaaatgtaaagtgctcttgtgctgggagcctgggatagtgcacctcattttctcactatatgtttggtgatgtttcctttttctattaagcaggcattacaagtaaggcttcttgttggagagctctgtaaaactgggaaacttgatgatatgagttacacctattgggatgaaaattttacctcgaaggtgatggtacttttttgcccattatctctcaaacatgaaactacatattagcatggggtgcattactcatgtgaccattttatcctacttttcaagtacttttttatggtgaagtgttttgattgatctgtttatgtctccagtgtgtagaagcccttttacatcctctgaaactacatgacccagttgaaaccaaaacaatgacagataaatttgctgcggtttgcatactccaggtacatacaacaaataccaaatgacgtcattgtagacttcgttgtttcgattatgtaattattattgaaaaccagtactcatagttcatttagctgaacatctgcttagtgacattgactatcatactttgttttcctaaaaagatttttactttctgtgcagcgctacctagataatatgaacagagaattgagatctgcagataattctggaaaacagggtgacacctgagttccacaatgcatatattattctgttcggtgcacactaaaccaaagacaacggaatcagcatctgttcggtgtactgctgccttagtgtactgctgccttatgaaaaaggctgtgcagttcattgagacatgtacaaaactctgagtttatgctctcgtatacgcctgataagttttgtagatgcagacttgcagagctgacaattcgtcagctagcaagggcagcttccctgcctgcctgctagaggcaatttgttgtaggtgatgcacaagtactaggaatcttttcccccttcctttattttcttgcttatgaggccattggcaccgaaatgcctgcttatgcgcagcttgaacaatctcttccaatatgattgccgagcatgcgcgtgtgtatatgagcctctattgtgtttcgggaaaaaaaatgattgccgagccaagaagatgcaatcaggctgtcgagtcaaatcaggttgataatggcgtgctgcagccagattccatttcctatgtctgcatgcgcatgcttagacaaaattcaccgtgatgttaacaactcatgtcattcgacgacgggcagcttttgatcattgtcacatccctgatacttgtaaatcctcaataatgtttcctcagttgtgcatatccgtggcctgcaatgctccgtgcaattgttgaatctgtttccagaactgatagcgtaaggaattgtatgaccatgatccttgctgtctggttgcaaaagattgaaaattctactctacaaagcaagttaggctgacagagaatcttgtggatgggatgaggtaagttcacttatccaattagtttactactctataggagacaataggtgaagaaataggcacaagagctaatgtgcagacttgtgctgctgagatcgtttcagacttggacaaacaatgctatgtggtttacatggactgcgagtctgcaacagataaaatcaccaatctacagctgtaatctgcattgtccgtttcctagggttagcgtaaggaattttccgatgtttctcccaggatctcagtctcagtggctgagatcgctgctactacctacacatgcaaaagatcataaaattcgattctatcaagtaagttaggctcatgaggaagtttcagaatacaggtaactacacaaaggagttaaacacatcacacagcacaaaagaggagaaaaaagagagaaaattctgaggtggtaggcacatcacagcacagcaattaagcatgaaacataaggggagcaagcaggtcggcgcagccacttgtcaagttaacatagctctcacgtatgcctgcctgcttccatgccaaaagtctactacactacagctcaagctactatgtatctgcctatctcaagagcaggagacagtggtgagcacagcacgaaaccaaggtagccgaaccatgcaaagtcaacacagttgacaaccagcaatagctttgtgcaaaagagatttggcagccaaggaaagacaggtcaggagctcacatcaccattggaagtcagccactgatcgtaccgttgttatttttagggagccgtactgtctaatcagggggagaagagctgatgaaggtgtatactggcacgttggagatggcttgaaggtaaagaagacggctggttcacggtaggtgattcggtcgagcagccaacggttttggaccggaatgcacgagctagctcgatcggcattctcccttttattgtttatatattttcccggttgtttgtttgtttgttattccggcgatttcttgaccagagataagcagtcgtttatttcaaggtctgagtctttgacaatttgtttgtgtgttgattttgttttggaaattgtagactttgactgaaaagaacgaggttaattaatctcgtaatccagtcagagatgagtaattggcatagcgacggcttgcatgaaattagaagttttgttaatttcatattagcaactaatacgatctcctgcctgtttgcactttgcaggaggaaaattcagcaagagtaggaattggaggcagaagttaagcacaatgtagcatatatggagttatggatcaggaacacgtactctccaaaatgatattcagccacatatgcatagtttgtcctatttaagcttccatgaatactaaatataatatattttttcggtgcctacgaaaataatcaaataacgacccctgttggagtattagacaaaactcatacgtggttagtccatactacgtgcgcattattggctgatggccatagcaatagcagaacatgtccatacactgtacatgaaaatcgtgatcgaactctgttccctttactgttgggcacctgcagctgcagtatctactataccaccaaacagtactacccgtctgcatccaacgtgcaaacttcggtttgtccaccaccgggacatgtacctcgtgtgacagcgacaccaccaagcgatcgatcgagagcacgcttgcggtgaggacgtgaggtcgctcgcccggatgagtacaggggctcgaggccaaggagggggggaaccaaacgtgtgacgggaacagcaacgtctcgtgggggcagccccggtcgagccgaggcgcgctggcgctagctagagtccgtagcgtttggtgatcgatccgacggcctgtctccccgcgcccacgtcgtcacgcggtgagacgcgggcgctcggtccacacacgcgcgcgcgtacgtgcgtgcgccatggccaccatcgatcgcggccaccggctgggtgatagccggtgcgaggggaaatatccggaaggaggctacttcctctgtttcataatgtaagtcattttagcatttttcatatttatattgatggtaatgaatctagatagatatatatgtctagattcattaccatcaatataaatgtgggaaatgctagaataacttacattgtgaaacggaggaagtactatattacgagatctcattcgagataatatcagatatattgatacgatgttaaatctagtatcccatactgaaccatacccgttaggtctcagttgataccttattagtaacagaccgacacctatcgatactaaactttttacccattggtataaaccaatacccattagctatcagatctagccgagagaaatgagagaagaaaggatggagatggtagaactatgatgctctccatcctccctcaacacgaaatgaatatgacaacgatgtttcccatcatctctctgcggagggcccgccatagacgaggccgacacggagcgacctcccgtccgattcacccaccatccctcatccccccccccaccctccccccatttcccctcccactcgaagagcaacgcgtatagcagagaaggtgttcggtgcaacgtaaaaattgggtggcgaccaaggcgagcacgtggcgtcatggagcgagggcatgaggaggatgagtggggtggagcgaatcgtcacgcgaaggataccttcctatttcctaatgcatgggtacataatcccaatatatagcttcatttgttttttttttctcccaaaacaaattgagtctggatttgaaattttgtcttagcaacttaggaagaaggaacttgaggtttttcaattcttctctcgcatgtccatgcagtattcgaatcgatcaagcttaaaggtcggttgtggtcaagcgtaggcgtcgctcatctaggagtcttgttgggaggatcgtagtactcttttgatactttgccagtttcggtcaatggtttcggagtctttactccctttagagttttcttcttccctagtcgtttccttgtgttcccttaacaattgtctctggctgttgtattgtgtaactgaatttcggctttattctaatatattgacgtgtatttttttcgcgtttgcgaaagaaacgacttgaaattttgtggatgttattttaataggaactttttaaaattttagagagcttttataacatggtccacggagtttttcatttattcgatactccgtattattttttaccggatattttcccgggaggagaccctcgcgggcttttgtcatgccgctgtcccttggtcccgaggccgcagagccgtgctgtcccctccctccgatccctctaagatcgatcggtcgctcgaggccggctacgttagtctcgcctcgatcgatcggtacgggtacactcactggctcaccccactgcaaaaaagtcaggattcgacgcttcggccgattatcaccttgcgatcgatcgacaactcgggggttgtttcacgtgtacgtgttgagtccccgttcacgcgtggactagtcaggaacaggatacactacgtactacgtacactcagtggccttgacaatcagagacaatgtactaagccattcgatcacacctgcatgctgatcagcgagtcgatctacgactctctcgcccgttcgtcgtcgtgaccatggtggattaattagacgtgcaaattaataaggcgtcgctgtccagggtgccgggtgtcgacggcgacccgtggggacgagcggtcgtaccggagagagaccgtgccgcgcgctccgctccgcgcggagcgtggcgtggcgtgctgccgtccatgcacacggcgacgacgacgataggtgcatgcacgcacgcacgcacgcgagaggcgctaagctatagcccgctgctgcgaacatcgcgcgcgctcccgcggcggcggcgcggtggtattcggtcttcacgtcatggtcgatcgcgcgcccgacaccgccacgtgaacgatacgtcctgccgcgttccgtgtgtccatctctcgtacgtagcgccagcgtgcgcgtgcgtagcataggcggcggtagacggcgtacgtcgccgtatagcagcgcgcccgctcgcgcgtctcgcgtacgtcgcctcatcgcgtgcgtgtgtggatttagctagtctcggtagctcgatcggtctcgcgccgaatcaatcggagtcgtagcgtggcgcgtcacgcacgtagcggtagccgtgtgtctgggtccatcggacacgatcgatcacacgatatatgctactatagagaagctagatgcggacggtcgggctcggccatctttcgttttcacggggcgtcgttttgatcaggattcggttcggacctgacgacatgggctagctactacacagtagccgctaggcgtggatcgaaggatatctttgatggatgctataccgtgctacgagctagcgataggattgggggagttgtgatgggcaggaatgaaaagggcgtcttctttgagcgtagaggaatcaggcgtgtctgccgacagggtccaagcttgatctttgttaatgcgacctcaaattgtagcctgtagaggctggttcgtcttgctaatgttaactgagacatgcaggacgcgatagcatttgccgatttgcgtgcatcggtgcatgacaatacctctctctggtctggcttcgctggcaatgcttggctattgacgttaccaacgccctaacgataaggatgctctcttaattctttacactttgagatagagtacaatttttttttagaacatgagatagagtacatgacttctcaatgtaagactctgttcaagataagttcatctgacattagacggatgatgggtagagcgtcacctcaacttacaaccagggttttaaatctctcgttatagctgtcgctatctcccgctatagctgtttgagaagggttctagctatttactctcatgtacaatttagccgctatatctttatttagcccgctatagctgccgctatagctatttgagaagctaatcactaaatgccttagcctgctatttaaaacattgcttacaacacgttctttgaggactcgatgtcttccccctgcgtctacaacccggagctttttccttgcgctttagcggcggccaaccaaaaatgtgcaaccgtgaaataggcagttacaccgtactatgtgttatgtctacagagagattgaaaacaaatcaccatatcttgtcggagtacaagataggactggcctccctctcaccctgtcagaagcttcgtttcaagtatggtgagagtcctctcgcggcggttacagttaagatcaaaattggaaagggttcaaccccttcgttctggtggtactggcaccaattgttggaaataaacactggcgtatttgaggggatgtttttcacggtgaacactatggtcaatcacatcgtgcaagaagggaagctttggttgtagcgaaacctagtcccttatgaattccttttggcagttagaattccttatgaattctctttttccttgttgctttaagctgatcggttgcctttctttcttagttagcctagtgtgctcttcccctctcccggtaaggcggtaacccctaggacttgacttagtgggtggcagttataaaaactgttttttcttgctaatatatcgttgtgcaagccttgtacgggtttaaagaaatactccctccatttattttttatagtcatatttcgaaatctgaaaattttatttttgattggcatatttcaatccaacaacctatcctcttaatgattttgtcaaatttaatgcgtgactctccattcttccacacatgattggctatatgagcattgagaaatgtaaatattaattaatcgcttgtttacgaggaatgactagtagcatgtttaaatggatgataagtagaattacttattcttggtctatgtgtcagatgaaatatgactatcaaaagtagatgg

SEQ ID NO: 31172 - DNA, 9651 bp, Oryza sativa
aggctcatttttctatttctttaataatataatagattttataaattaatcctttaacttctcaatattaaaaacaagcaaatgtaaatggataagcacatataaaattgaattggggttgatattctctatagcaaaagagaatgggtaacacattttgtgaaaaatatatttttatttatttcagatagtataatttctttcatccttagcaaagtacaggaattcagctagtcataaaaaaagactcaaaatttatacaaacaaattactgttatatacttgttgttgacggatcgttcggaaagggcccacctatcccgtaccgaataagaagagaagagataaaatttgctcgtgtgacacaaacaatttttttctttttaccaaatcaccgagggatagagttttcccacctgaattcattccaaacgcgagaccaagagttacgaaggtttacatagggattacatcataattaagagtggaggggggtaggagaaaatggcgttgatggtgtcgttcaatgccacaaacagattttgattttaaatatgagataaacccttgagtcctacttgaataaaagggataaatcacagaggagagaggacatttgcgataaaacccaaaatctaatcactcgatcaattaatgtctagccagtgttgatagcgctacgagggacttaatatctccagccagtgtcgatggcggacttcgctaccctaacagaaacggtaaatctaattgaagaggcctctccaattagtcttaaccagagacacccacgtgttaatactttatgagttttggttattattaatccattaagcaagtaggggaaatattcctatcatctatgcttcaaataaaattttctcttaaattaatcatccgatttacaatccgattacatcattgtgttcgtaataattaaatctttacaataaaatctcacatgattatactttgatgaaaaatcataaattacttttatgatatgtctaacttacttttagatttcagtaagttacttcttagacatataaaagtaaatttagtaaagcctaaaagtaatttacctaaattatagaagtaacttataacagaaagaaagtaactttaattaatgcctttttttcattgaacaaattatcatatatatatatatatatatatatacttttagatttgattaaaatacttcctatacattcataatgctctgaggtgattacttttattattattttagttaattccataatttgtgctgattaatttattttctagatagagtcatgtttttatctctacaacggatttacttcaaatgacatgctaaagttacctttattttgttctaagttacttttataatatatgtaaattaattttaggttttactgaatttacttttatatatctaagaagtaacttagtgaaatctaaaagtaatttagacatatcataaaagtaatttgttatttttcatcaaaatataatcatgtgagatcttgttgtaaagatttaattgttacgaacacaacggtataatcggatcgtagatcggatgagtagtttaagagaaaattatatttgaagtataggtggatggtgcctctatatagagtggtagctggtttagacaaatcagctgcgaccagcgcgcgacctcaagtcgatcaatgtgcgacctcaagtcgatcaagctggtagcctagctggtacccccgtttttcctatacggtgtaactaatggaagaataaagatcgcggcttcagtagcttcacaagaaaactagttagatcaatttcgttttagcagagatgatcgtgtaagactaaggctaaatcaaagtgaattggactcttaacacttccatccgagcgtgcaaacggcaaacatcagcagattggagggccaccagaaaggcacatttaaccccatccctttctccccttctttgttccttgcttgccgaccgagaactctgatcgtgacggggccagaacaaaccggcacgtacgtacactgaccggccgcttggactcggatgagctaattaatcaatcaatcagtccgatcgagagtttttattttcaattaattcctatcttccgttggactttgacgctttgattagaaattaatcgagtttgttaatttgccacgatcggatccgcggttgctttcagtgtggaacacacggcgctaattaagacttaaaaccagtagtagatattaattagaaggtgctttaattagcttagccactccagctccaatgcctagcttaaccacaattgttctgatcacgtcattgctgcagctagctagtactacgcctgatgcctcccaggctcccacccctctactgtgttctgccaccgttgacacgggacatagcccaataaaccaacgaccagatacatagttaattagaagttaatttttttttaagacagagacaaagtatgtatctatcttgacgaaacatgtgccacttaatccttgattggagaacacatcaaaatgggcaaaataaacgtacatgcgtacgtacgttgagatagctagtgtcggtgacatggggccgggggtatcgtgactagaggcttgggtagccgcggtcacccacgtggcctgaccccctcggggggggggggggggggtcgggtccgagggtgacgtggccacccctccctctgtctccccgaggggtcgggccgctcccgtttcggccccgagggctggggcgccccgacccactgtggttttggcgccacgtgtgtgggttaggtgagcacagggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtgccaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcccttcttaggcagcaggaggcccatgtggtgaccccggaccagataaaaaggaggcccaggcctaaaaagagagagaaaagaagaagaagggaagggggttgggactctggcgaaggggttctagagcctgaactctctctcgctctccggctctctgtattcattcacgcacagatccaccagaacacaggagtagggtgttacgcttctcagcggcccgaacctgtctacgtcgcccgtgtcttgtgcacttcctctctcgctgacgtttcttagatcgagggcgaagaacctcacttagcgtccccggccgaatcggcaaaggggggcctgcgcggtctcccggtgaggagccccacgctccgtcatctggcgcgccaggtgaggggcgcgcgtgtctttctaagccctcgtcctctttcgtgtgcgccaagcttctcccgctcagcccaatggccgaacgggcagtggcgcacagcctctctccgaacgctagcggcgacgacggggagcagaacccgcgccgtcgggctcgcaccccaccgtccccctctcgccgaaatcttgggcggggggaggcgctcggggaggtcgaaggatccgcgaattcgccgcccgcgggcgacgggggaggacggcgagacggggcgcgtcgccgcctcgtctacggcgatggcggcacgccccagggcgcgctccaggctacgggcgcgctcctgcgtcacccgcccgtcgtccccgatccagagactccagcccgacgttggctggatgacgtggccgacttggtcatgacggcgcagcagcgcctaggcgccagcgggcggtcctccgccaccgaggcctctggcgctgccgccgccggctccatgtcgtcaaggcggagggcgcggcgagcggcggccgttacccgccgttcgtccgccattccctcgtcaacgcctccaacccaagaagatgtgcgtggggggctggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaatcgtcaaccccgccgagtttctccagatctacacgaccgggatcgaggccaccgggggtgacgacagggtcatggcgaatttcttccccatggccctgaagggtcaggcgcggggttggctaatgaacttaccacccgcgtcggtccactcttgggaggatttgtgccagcagttcaccacgaacttccagggcatatatccgcgcccaggcgaagaagcggacttgtatgcggtacaacgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtgagggcgcttcgcgggccccccgaaaggggaggcctgcgagcgacaaaaagaaggaggccggcgctcccagcagggagcgcccgaccggcaagtggtgtactgtgcacaacacctccctccacgacctcgcggactctgccgcgcggtcaaaagtttggctgagcggacgaggaagtgggaggaggagaagaggcaggagcgccgtgagggcaagaccccggcggacatgcccggggtccccagggaggtgattgagcaccgtcttgccgtgcggccgggcgcaaggccggtccgacagaaagtgcggcggcaggccccggaacgtcaagccttcatccgcaaggaggtggcgcgacttctggaggccggattcatccgtgagatcatccatccggagtggctggcgaacccggtcgtcgttcccaaggcgaacgacaagcttcggatgtgcatcgactacaccgaccttaacaaggcatgtcctaaggacccttaccccctgccacgcatagattagattgtcgactccaccgcggggtgcgaccttttgtgttttctagatgcatactctggttgtcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactaccctatttaagctcctcaaacgctccgggccgtttacctggacggaggaggctgagcgggccttcactcagttgaaggcgtacctcagttctcccccagtcctggtcaccccggagccagatgagccgttgctactctacctggcggcaaccccgcaggtggtcagcgcggcattggtcgtggagcgcgacgaggacaaccctcactccgcgtatccccaccctgtgtcgactcgacccgggagagagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtacgccccgcgtggcctctcggacgaagagcgccctagagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtagttacgtcttaccccctcggccaaattttgcataaccgagagggtactggacgggtggtgagatgggcaatcgaactctctgaattcgatttgcgctttgaaccacgccacgcgatcaagagccaggccctcgccgactttgtggcggagtggaccccagctgccgagcccgtctccgcacccgaggccagctcgggcccctcgcaggtgcctcacaccgcctactgagtgatgcagttcgacggctccctgtctcttcagggcgccggtgcgggggtcacgttgacctcgccgagcggagacgccctcagatacctggtccgcctcgactttcgggcgaccaacaatatggcggagtacgagggactccttgcaggactcagagtggcagctggactggggatccgccgcctcctggtgttaggcgactcccagttggtcgttaaccaggtctgtaaggagtaccagtgctctgacccgcagatgaacgcttacgtgcgccaggtgcggcgtatggaacgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagtgctacgtgctggtggaagggaccctctatcggcgcacggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcaataagcactctgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggagaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccacgcgctaccagcagagcctgcggcgctaccatcagcgccacgtccgggcccgatcactctacgtcgacgacctcgtcctacgccgcgtccaaacgcgtgctggactgagcaagctctcaccaatgtgggagggtccgtatcgagtgatcggcatcccccggccgggctccgttcggctggccacgggcgacggcacagagctgcctaacccgtggaacatcgaacaccttcgccgcttctacccctagtgggggtcgggtgtcatgtctcgggctcgggccaaccctgcaccccccctcccgggcgtgcagggttggccgggggctaccacatgcatatacttaccttttttctcttccgtatttcaataaaagcattttcgatttcctgaggactgtgtctgtgccatcatttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgtgctcccggcctggccagtctcgacacgaggatctccccaggcactagccccgacccgcgccgtttgaggctgggacctgggcacgagcccttgttcaagccaagacacagaaggaccgcggcacagaccatcctcgtctcatacacacaacaaacagaactgacgcagaaatttcctctttacttgattgcagattaaatcagtctatacaagaagggggcccgaaagcctcggaagaagaaggaaaagttattaagattggcgggggcctgggggctcactccgacgcgcccgggtcgtcggcctcgtcgtcgctgtcgtccgcaccgtcatcaccgccctcctcgtcggagtcgagcgcgaacgcgagccgaggggccgtaccctcgaagctgtggacgatgtggtcggcggcgtcccggacctgcgcgcgcgccgtcctcggttccgggagggaactcttccagcgctgcccacggggagaagtcagggtccctggcctggtagcttgccagtacgagctccaccgccccccgggtgaggtccctcgaggatgacttgatcgtctcctcgagctcc

SEQ ID NO: 31173 - DNA, 1335 bp, Oryza sativa
agctcagcggcccgctgatccagtgcggccctctcggcgcgggcgccttccagattgcggcgcgcctgctcctcccgcgctgcctcgcggaggaacaggctgtccgccagccgctgcgccgtggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttctcgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctctagctgtgaggcgtgccggcggtgtgccttgcggaccgcctccaccatggcctccaccgagcgccgcccctcctcgacgcgcgcccacgccgcgtcgagctccgcccgctccgcctgcagggcctccatctgggcacttaacccgtccagcaccgtactgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggtgcgcccgcggcctcgtcgtgggtggcctcggaagtcatcgtcgcctcgggcggagtcgggtcgggggtttggcaggccgcctggtgtgcgcgcgccgcctctgcctcccggacggactcccaggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccgaccggacttggaatggcgggggggggcgcgacgggatctcgctgaggcagaagaaaaaccagaagacaaaaagaaacgggtgagtgaaaactcgccttgggagatgggagaatgaatacgcccgcggtgggcgcgg

SEQ ID NO: 31174 - DNA, 1405 bp, Oryza sativa
gacgccccgaccacctgcatgatggccaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggtgacaccggctgtacggtgaagaaccaccggaatagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctaccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttccttggcgtctttacacccttgccaacgctatgcccggctcctcgcttcccgcgcccactacctcgccccctcgtttctcgcgcccacgcctccactaaccccactcgcccgtttgcggcgcacgcggaagatgtgcggccgtggcggttgagatggggcagatcgtgcgcgcattaactacgcccgccaaccgtgaaaagcgtcatcatcatgtctccaggcgaaacgaaccggctcgtcccgattcgcgcgctgctcgagtaatgtagcggtcttaaagaggccgctcattattgtcgtcggttttcccttgccgatgcgcgcgatttgcgaccgccgggtttctgcccgcctgtagggacc

SEQ ID NO: 31175 - DNA, 1358 bp, Oryza sativa
agggggttggtactatggcgaagggattctagagcctgaactctctctcgctctccggctctatgtattccttcacgcacagatccaccagaacacaggagtagggtgttacgcttctcagcggccggaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcagctaggtaggcagctagcaacctactccctccgtcccaaaaaaaaaacaaacccttatttccgtgcccaacgtttgactatccgtcttatttaaaaaaattatgaaaaaaattaaaaagacaagtcacgcataaaatattaatcatgttttatcatctaacaataatgaaaatacgaattataaaaaaaatttatataagacggacggttaaagttggacacgaaaacccaggatttgtattttttttttttggacggagggagtagctacatctatgttccgtaacatggtaacgattgattaatagacaagggaatcgctcgctgctccggtcccatccggctaaccattggtttcgccggcttaaaaaaaaatctcctgattatagcgtagttaacttgtttaggaggttggggattcccccctatctaactcgaggctaactaagcagagcttagcttaaattagctcgtattacttctagttgcaagttgcacatacgtactccttgcttatgcagcagagagaacaggcaaccggcagcctcgcgtagctcgtcgtcctctgccaatcgcccacacgcattgtgtttaggcagacagagcatctttgtctcagatctccccccgagtaaactaattgccactgggattactgggagaagccaccacctacctgttcagacttcagcgtcacctgtgtgtcatggatgatgcattcatgcttgcatatgtatatgctctgtaccctgaatcgtgagacatacgtggtgcacaaaatgcaacatggatggatcatggatggatacatggttggatgcatgcatgtcgtactggcttggatttgcatgtgtgcgtccaggtgctggcatatacttccagcagcagctagctacgtgtatagaattgaataatgtttgtagattttgacttggtgtagagaagacggacgagagccagctagctgcaaattccaacagacaccaggtgcagtgggaaaatactagtgtttggttcaggcagagcgatcgatcgatcgctcatgacgccgttcctgctagataggtatcgtcctcttgtct

SEQ ID NO: 31176 - DNA, 7746 bp, Oryza sativa
tgttccacatcaaagaccatgccgtattccgttgcaaagacagcaatagcatggcttgataaagaaacatattcaccaatcaccagtactgcccgtctctgaatttcagagtcgaaagccaaaaggtaagctactcgattgactgtatccacagttccacaccctgctgttccccgcgagaacaagtagtacagtattgcccatgcattcgcggtgcgggagttccgtgcgcgcgcgcgctccgtgtacgcgcgcaaaaagaacggcggctctcgaggcttggcacgttggcacgcacgcgcgcgccatatgggcttgctcgatcgcgcggccccgatcacgtacgtgcgactgtgcgagcgaccgagcgagaaccacgcgtgccccggccgcccaccccgcgagtccacggcacactcgcctgagaaaaaagtgccaatatcgctgatccatccgtgggtctgcgccggctaaggttatggttgggtcaattcgtaaacatacttatacggttttttaataataaacatacttatacgataaatttacagatacaagattctttgcaatattactcatacaatagcagtgaataacatgtgagtccgagtctaatatcagtgtctgctactttatcaacagtactgtagacatttccactagcaaatttaccatttatttttagtagtagtacaaggctgcacgatattgctgatactatagcagctatcgtgtaatgacagtacccaacacgtagtatagtagtgttgttaattgttttatatcctaaaatataataatttagtgtgggatgtaacataaagtattttagtaattacgaatgaatatttatattttatattagattgttatattttaggacatgacttatggagagttcgcgtatttgggatatacaacgacgtagatcgatcggtctgtgaagtgaacgtacgactcgtcggtctctatcgatctcggggtcaagactgacgttctgacaagggaaacctgaatgacctgttaaattggacgtggtgtactgtacacttggccagaaggggttgcgtacttgtgtacgtatttcagtatttctgctctcgatctctctctctctctctttcgctagttagctttgtcctttatattataggttgatgtgttgttccattccctgtacggctgagggtgcaaacgcccgctcttgttcctgtcaccatgtcccattcgatcgttttcctcctagtacagtggacacgcagatttactgtagatcctcgaaatggaccggcgcggtaacaccgatcgtaaatttctcagtgaaaaaaaaatgcaatgtaaaatcagttaaaacatgtggccaaaagatcagactctgctaattacagccttacaggggggctcagaaccaaacaaaaccatctctagccaccaaaattgactcacgagaggttaaaacttgattgaaaggaacaactcgatcgacagatcgatccgattgatcgatcgtatcctagctattagctagctagctactacttcatgagacgcgttaattgaaccgatgttaacgaaaataattgggtgtactagctagcacaagtcaagacacgggaaatagtgatcgtttctacgcctcgacccgatcgatggatgattcgatggacgacacgtaaaacacgtttggctcttcgcgatcacagaaaggggatagataggccgacacgcgcggtacaagctggattagtacattattgtctccacatgtatatatgataatatgattattgctgtagcccgtaggtctatccagccgtacaagtaccactatgtatatatacgtacgtaccctgtggatcaaccacaaattatttttgtgacgtgctaattttataaagaggttttggaaggatttgctaattatattctaacgagcttatatgcaagatgagtcgacaaatgcagccaacacgttcacatgattaattacgtccagcccggcagtctatatttcgacgtgaagttaattagctagcagaagatcctatttgtgggtcgtgtgtgattagtaaactgtctgtgtgtgtgtgtgtgtgtgtgtgtgtgtgtgtgtatgtatgtatatgtatatgtaatactgaacacattttaaatggatttttagttagagccgtgttagattttaaatggatattttggaacactagcccgtcgtcagtcatcactttactaatttgaactgatgtcgatcgtgaaaaattttaaaccgatgaaagggtagaattcctagcataaagaaacttttcaaacttacattacattactttaacttgcaaataaaaaattctacaatgctaaaatgtcaaatattcttgtggaaattctcttgtccgtcaatgccccgcttgttccatgcatgcatctccagctgccggctcacttgtattaaggaagaaaaatcccatttctcctttcagtccctgtccacttaccatttccttaataccctcacactagcacataattctctctgatgatctggtcaggtgtggcgctgcacactactgtgtcgacacatacccaagcagcaacaaaacaccccctctcctggatttccattttcttttcgtccaaccttgataatacatttttataaacctattcatgtcgtatattacttattaatttctccatcagatgagaaattgccgttgattaatccggagacgaacaactacacaacccgaccggtcgggtaattaaaaccaatttagctctcgttcgtcagcgccgatggctaagctcgctgccggggcgcgccggccgcgcgtcccgtcgcggggcccgggcgtccgacgtggccgaccaggcgggcccacgtgccccctcctcgctcgggcagtgacgcccgtgtgggccacgccctgcctccccagtccccaccctcaccggcccgcctcgctcgcccgcgcgcgcgcgcgcgacgtgcatggcgcgcggcctcctccccccctcccgccgctatatatacccctcccttgcaaccgcctcctctcatcgcacactccaagctaagcctaagcgagcgagaaaaaatagcaaaagctagccggcaagcaacgccaactaattaggggagagagatattcatggctccggcggcggtggctgcggcggaggcggggtcgaaggcggcggcggtggcggggaaggccgtggcggcgtgcgagcgcgacgcggagaagctggagttcatcgaggagatgacgagggggttcgacgcggtgcaggagcgggtgctggcggcgatcctggcgcggaacaacggcgccgagtacctccgccgccacggcatggaagggcgcaccgaccgggaggcgttcaaggcgcgcgtccccgtcgtcacctacgaggacctccgcccggagatcgagcgcatcgccaacggcgaccgctccaacatcatctcctcccaccccatcaccgagttcctcaccaggtgtgtatagtagtgctagctaacccaaacaatttcttttttcaattaatccggcctttcatttgccggctcggctccgccattgactccaactaattgtttgattagtttttggtcgttgcttggttgatcgttcttgcttactaattggcgtgcgtgtgcatccagctcggggacttcggcgggggagaggaagctaatgccgacgatagaagatgagctggacaggaggcagatgctctacagcctcctcatgcccgtcatgaacttgtgggtgatccatctctgaatctctggccattatcctactttagccatctaactgttttctttttctcaccatgcctttgattgggacgttttcttgactcccggcaacagttgaagctacctagctaagatacaagtagccgtattaatttctagcatgcaatttttaatcttcttttaataaaaaagaaagaaatgatttcttaatctagtgtcattgatcgatgcattagtttaaggcctaattaatctaatctacagagacaaacctaaacctaaccgttttccgtttaaactttaccatcgaccgatcaagaaacagtacgtttaatttttcatatgctaaatataatacttgggaaatgtaatgaccggggcgagcgagtcatgcgtttgtagccttggtgacctcacaagggtttggctaagaaacaccgcaacttgcgagaggtgtggctaattaatcattcacgttgagcctaaaatataatgtgtttgtgtcttagacgctagaggtgctgctgccttgggtgtctctctactttttaggcaccgagattccttttctaatttgtaagacatctaacgatagctagctagcttcctaaaataagattatgtagcagctcaaagtcgctcgcatacgtaaccaggaagttggagtgtaaccttacaaacaaagcgacaaatcggctaccggccttgttgcgctaaaataagctaagagaaagggagttttcagaaccattcaattagcttgaagcttgaataaacacacacgtaaattaatggtactaacgctcatgctcataaaattttatcagcattattacgtgccctgtgtcaatcccacattaatgtatcccagctgaaaggaatggtgcaaccaccggtgtatctctgttaattagccatcacaatgctaaatctttcgtacatctgatatcttatcataggttatgtcaacatcggcctgaatctttaattaatccggcatgcagaactcagcatcagtgggccatcaattacactgcatgatcattgttgatcccttcctgcttaacgattcaacgacataaccaaccagctgctagctgactgaatgactgtagtagtaaactagtattatagctagatagtactgtactagtgattaatatgtttatctcagattaaattaactaaaggtaattaaataaaaaaatgacaggtacgtgccagggctggacaagggcaaggggctctacttcctgttcatcaagtcggagacgaagacgcccggcgggctgccggcgaggccggtgctgaccagctactacaagagcgatcacttcaagcaccgccccttcgacccctacaacgtgtacacgagcccgacggcggccatcctgtgcaccgacgcgttccagtccatgtacgcgcagatgctgtgcggcctcgtggcgcgcgccgaggtgctccgcgtcggcgccgtcttcgcctcgggcctcctccgcgccatccgcttcctccagctccactggagggagctcgcccacgacatcaggaccgggacgctgagcgccaaggtgacggagccgtccatccgcgacgccgtggcggaggtgctcgcggcgcccgacgccgagctcgccgcgttcgtggaggccgagtgcgggaaggacaagtgggaggggatcatcaccaggatgtggcccaacaccaagtacctcgacgtgatcgtcacgggcgccatggcgcagtacatccccacgctcaagttctacagcggtgggctccccatggcgtgcaccatgtacgcgtcgtccgagtgctacttcggcctcaacctgcgccccatgtgcgacccgtcggaggtgtcgtacaccatcatgcccaacatgggctacttcgagcttatgccgcacgacccggacgcgccgccgctgccccgcgacgcgccgccgccgcggctcgtcgacctggccgacgccgaggtcgggagggagtacgagctggtgatcaccacctacgcggggctctgccgctaccgcgtgggcgacatcctgcaggtgaccgggttccacaacgcggcgccgcagttccggttcgtccgccgcaagaacgtgctcctcagcatcgactccgacaagacggacgaggcggagctgcaggccgcggtggagcgcgcgtccgcgctgctgtccccctacggcgccagcatcgtggagtacacgagccaggcggacgcgaccaccatcccggggcactacgtggtgtactgggagctgatggtgcgggagggcggcgcgtggccgccgccggcggaggaggagggccgcggcgtgttcgaacggtgctgcctcgagatggaggaggcgctcaacgccgtgtacaggcagggacgcaacggcgaggccatcgggccgctcgagatccgggtggtgcgcgccggcacgttcgaggaggtgatggactacgccatctcccgcggcgcctccatcaaccagtacaaggcgccgcgctgcgtctccttcggccccatcatcgagctgctcaactcgcgcgtcatctccaagcacttcagcccggcttgccccaaatacagcccgcacaagaagtgatcactcactacactacacggtccagttgagctagacgacacaacgatatatagccttctactacaactactactaccagcactcagtcccagtgcttatacagtcggtgtcagtgtcagtgcgtgtgtaatttctcgtgtttaaggcagagggcatcagggccatactcctggatgcctgcttctttgatcttagatcatgctgtccagtggtagttaccatgtaatcatgtgtgagatgttatttctgaagtggaaatggcgagtgtttgtgatggggtaagctggtaacgtcattcttggccgaataacataataggccttgttggagtatctaccaactacttctgttgacccatatgtacttttttctgcttgtgcaaaaatgggagtgaactagtgacactgacaccccaggaattcaaccccactcatgttcctccatgagagtatgtctgttggtacagcgtcacccatgtctgctaggatacactacttatagtggagtatatgtttaaatcgctcttattattctattactacagcatgatcctttctgctaaagttttcaacacagacgtagctccctattttgtaatgcatgactctaaaataaacagtgtttttgggagggaaaaagttctgtaacttgctacactagtacactgcttacagcctagcccgggtttggtacaacatataattcccaacagacaaaagtatcaccttatgtttagatttgaacttttgatatagagaaatacgcaacacttcctgcataaattgaatcctacctgaactcatccaacttgcaacctctcacagaacattaatttaccagtttcaatcgttaaattattcatgaatattgtagtaggtacaagtgattctaattatggggctaaaactgctatagcttgcacataaaaggaaacatggcattgccactgccaatgacttgtgcaaaaacctatcgattccaatctaccacagctccactctcccatgtctgcttgtcacagaattcagtactaattaacagtcaaataagatatttttcttttttaaaaaaaaaactaaaagacgagctgcttgcactcatggcccgtttggttagggggagtttttaggagggattggaagtttagagggatgaggctattaaatgttttgtttggttaggagacatggaaattttggtgggatggggatggggaattgaggaatgaactccctccttttcaatacctgggtagggggtcctttacttcgcctaaacaaatctcagccatccgttttcattaatgacctaatctccaactaaactccctatcaatttctaccacctctaccaaacaagagactaggatgaaaa

SEQ ID NO: 31177 - DNA, 8836 bp, Oryza sativa
  unsure (1)..(8836): unsure at all n locations
gtgacccacattatggattacactagatagatgttggaataataaatatgattatttagatttataattactaatcatatagtggattgtgaatatgaccacgcattttgcagtagttaaggtgcctttgtaccgcttgggtcctgtgtaacaggaaggtgtccatcggacgagcatctcaaaacatctggaagccttctcaactttggtccttgtttcccactcaggcgttttggttttacatcctagccaaccattcaaatgtcacatactgaagttctaaaataaaattatcctacttaaaaagatctttatgaaggaaatattgtagactctagtgacttgcccaaaaaaaaaaaacctccattatttttagatcagaatgaatagcagctggattattgctagttcttactgcaatatgttaataaggttaaccaaagcataactacaaatgatatgttttttatctgtgtgccttgtgtatcctagttcttgtgatttgacctcagtagtaagtcagaaatcatcaggggagttctattttacgctgttttgagtctcttctatcactgagtcacgggtaatttgattattcaagcccatcacgaagtgtaaccaaccttaatcagaaagattactctataattgaatagagagcattatgggtagattataaatctaatcttcctaggccatcagccttaaatgccttgatggttacacaggagtttcaagtgtctaccaggaatgatatcgatttgttctgaacttgtaatacatggagagtactcattcacaattaattgttagcctatcttacatagttagatctaagatcagaccaaaggaacaagttataattgtgtcagtctagttctattactccctggttccctctagtaaaaaaaatttgacgttccaacatcaattaattttgactggagggagtatgatatattttgtaactaaataattacagattggtaacagatattctgagtaagggaaattgtgttcggttgttggcaccaaacctggtcaaatattgctgtagggatggcaagagttgccactgcattaggggagtctactattccagatatcctaccctcacatgggcagcatgatagcaaaaggtatacctgtatataatccgttaatatctgattttaggataatgttcagatcacataatattagcaggataaccaaaaatcctgtgtctacctgctccttggagtacccaaatctggaaaggtactcaatggcattgaggacagcacgcttgtaggcaactgatgcatcaagaaaatgctgcttcccagactcgtctacactgatgccctcaaagactaaccagtctgagaaacgtggttccactggacctatatcaaagataggattcacatgaagtggtgttggacctattggagtcaagtattccttcatcccacctcttatgatctcacacctacacaaaatgtaagaatgaaatcagttggttttcacaagaacacgagaagcaaatcttcatgatcagattattcacaagcactcagcatctcttgcacagtcaagtggaaatgtagtttctcaagtacgatataactatgatgcatgatttaggaataactggtgctatatgcattagtggagcgattctgatttccacaaccaaaagtgatgcaaaccaacacaatgtctcaattagaaatcattagagcattttaacttacattgatgacagaaaagaagcataaactactgcagtgccatggagatggaatattacagaccatcacaattgacttggtgagtggtgacagcagtgctccttgatccttaaattaacattcttgatgtgcccattcagatgaaaagtctcaagcaagcagctatgtctatgtggatgatctatgcaggtgttcaagtctagtatatttataggaattgtgaaaaacctaacaatacaaggattagttacattagtgttagtggattttgttcacctttaagtagttgtttgggtgcatcttaacaagtactcagaattatagacaagaaaaaatgtaattacttgagctcaagaaatccactcatttctattgctccacagaatgagacttcgccgtcaccctgggaaaaatgcatgtcaccagtactcagatttgctccatcaacaaataccgggagataaaccttggaacctctacttagattcttgatgtcacaattccctccattctcccttccaggaatagttcttgctgcttcatttgcgattttctgccaatcagcagtcccttcttgaatctgaatcatgcaacaagcattatagacatggtttgttcctttaaaaaaaatacaaacagggctctttaaccaataaccatgtcttagattgatatctatatgtaaaattgctgcactgacagtctggaccagatgaaaataataattgtaggtactgcaacaaacaatgtttcatttaatccttgcactgaagtaaaaccactaatctggcagaaggtcatacctttccaagtaaacagttctcaggggttggtaagttggcaagaggcctctgatgtagaacttcacagattttgattgactcatgatttgtctcagccaatattttttccctctcattccatatattgagaagctcagcagatggtgcagtccccactataccaggatgagttaatcctggaaatcggacacctgatatacacacaatggaactattgaggtatcctaaattgaaaagcttcatttagaacaacaccaaaaaaaaaattctacctggtatttgaggggagtatgcataaattccttcaaaataccaaatcgcctttcttgcactagggaagtggtcggttaagaatccaccaccattctccctttcaaatatggcagtatatccccattcgtcaccgggaagtggaccaaggttgcagatctctacagcaagaagatcaccaggtgcagctggaaccccttcagcatcaactattcttaagggcccactaagataatgagtctgtgggaatcaatagtcagtttcgctgatatcttgttttgtaataagcgctgtgataaaaaaaattaaacggcatctcttgcaggagcgatatatatacttacaattgtgagatccaggaatttgatgtcatctgcggagttatcatcactgactcttcctccagtccaatcgaccatctcaacacggaacaattccccttcagttacatctgcaacaggagggatatctggatgccagcggttatggagagggactttttgctcccatggcttcttgctcacatctataggaactaccaatcttggtgttggaagagccatgttctgttgcagggagggaagggatcagaggttcatccttccggaagctcatgcttctatataatgatagcatatccatagcaatgagtcaggcaaaaaacgacaaaatgagcaaagacaaaggaatcccaggaaggaatggtttcaaatatacactccatctcgaaagtgcactgaaaaataagtgataaatcctcttattaaaatatttccaagaaactaagcaaatcttaacctagcaattattttatatgtttggaagtacttaagatagtggtcacaatcaagtaagaattgtcctgctggtccctcatatctctataggccactcagagcttagatgatgagatattttctagttcagaaatcagaagtggtaccaaccaacttgggccgtcatattcatcggtgttttccacaggcacttcatgcatcacttatgctaccaaacatgcacatagttaggtttttgtgataaatattcaaatataatctgaaggagcccatgtccccaataggctccaattcaggctaacttgtccatgtccccaataccaggaacagtctaactttatcttcttttgcatcacatttacaactagacagctggatatttattcttcaaggcaatgtctaactaacaggggcattgagttctattggttctattttcatttaacagtattaaacaaccttgcaaaaccttcctgttacaagctaaaatattactccctccgtttcatattatatgtcgtttttacttttttccaggtcaaacttttaaagtttgaccaaattcaacacaaaacaaacatattatcaaaatatattcaacattacatttaatgaaactaattcagtgtcgtagatgttgctaattttttttctataaacttgatcaaaccagaagaagtttgactagaaaaaagtcaaagcgacttttgactagaaaaaagtcaaaacgacttataatatgaaacggagggagtataatggaaacactagtacaaatagaaactatacacaagggtaagaaagtcattcctgaagtagtactacagaaggcaagaaaagtcattgttgaagaatatcgcttagtcaaaatttccattaacattttgcctaaggaccataacctgtacaattagtcaattacctccaacaaaaaatggaaatagattgtatgaaatgggagttgcggaattgtctgatttccaccaaaattaaccactctttgttaatgatggcattgaattaatagagcattatcaattttgcttcccaagtatagaccccacatctcatgaagtgcatgtgccaaaagcactcatcaatctatctgtgaccaataaaaccgttatcttagtaaagaagcacctttctacaattcctgctcccgaatcaacttacatgatcacatccaaactcagaaggaaagcaaaggcatgattctctacatggtatatattgaattaccttccaatgttgttcctcactcaacatactccaacaaacatccatcagtagtatacttctttgacttgtcctctaacattcgaaggctccagcctgcatctttcctcagtcccttcttcttcatccaatgcaagatcccctgagcttcctgccacctccctgtctcagcatacaaatttgataacagaacataatgcgatgcattctcaggttccaactccaccagcctcattgtcacatgctcactcaaccatgagtcgccacgggccctgcagcctcttaatagcaagccccatatcactgcatttggctgtgatggcattgtctcaacaaccctaaaggcatcatcgaggtgtccagagcgactaagaaggtcaaccatgcacccaaagtgcttgatcccaggttgaaacccatactcaccttgtatggccaggttaaatattttcctcccaatgtcaacaaacccggcatgtgcacaggcacaaagaacacaaataagtgtgacttcatctggctggacaccatcattctgcatccgagagaaccactgcaatgccgtcttgccatcctgtgcaagagcaagtgctccaatgatagagttccaagtatagacattcctcttggccatctttgagaacacatgcattccatctgagacttttccacacttcccatacatgtctaccagcgctgtgcccagtacaacatccatctcccatccctgcttctgcacgtactcgtgaatccagatgccagtgtcgaccgcacaatgggccgcgcaagcgccaagagcagcaaccatggtaacgcggttgggtgcaacatgagcagcaagcatccgccggaaggtcgccagagcgtgaaaggtgcggcctcggttcctgtatgaggtgatcatagtggtccacgcgacaacctccggtcggggcatttcgtcgaacatctgctcggcgtgcgccaggtcagggtcgcagtccgcgtagcgcgcgaggagggcgttgcggacgtggaggtcgggcccgaacccggacttgaccacctggcaatgcacggccctcaggtcggcgagggaggacagggaggtgagcaggagagggaaggtgaagcggttggggcggacgccgcggcatcggaggaagtggcggaagagcgggagcggggagcgggcgggggcgcggccgagggagcggaggagcgagttgaagacgaacacgtgggggcgcgggtggcaggcgaagagggagagcgccgggtcgaggtggcggagacggccgcaggcgaggaagaaggcggagacgacggcggtggagcggaggagcgcgcggtccccgaggatggcgccgcggatgggcgcgagcgcggcggcggtggtgcaggtgttgatcgcgtgcagcgcgcgcgtgacggagggcggcggcggcgcggtggacgggcggagaggcggcgggaggccgccggtcatcacggctgccggtgcgtggggcgtggaagcgcggccgccttgaacaaccctggatgtcctgggttgatgggttcgtcctccgcggccgatttgtccgttaacggcccagaaggcccgttgcgcaagcaagagttgcccgtaaatggagtatatttgtcaccgttgtaaggcaccgttgcaactttgatcacggaaaataatttttagatgattagattatgatgataaataaaactttaaaacttatgtttaagtatgtaatacactttgataatttgacatctatttaaatatttagattatttttataaaatagacgaatggtcaatgtttaaatatagattgtgcttagcaacaaatataaaggaactgagagagtacataaattgttccagaatccagacacgattttaagcaacacataatttgtttgaacttaaatcaataggtcaaacaaattgtaatgttgttggaagaagtatatatatacgctgtgtttagatctaaagtttgaatccaaacttcagtccttttctatcacatcaacctgtcatatacacaacttttcagtcacatcatcttcaatttcaaccaaaatctaaattttgcgctgaactaaacacagccataatttgttttgatgatctagtagtctcacggattacaagtttacaacaagacggtcaacagcaccccggaggatatggcaatcgatgacgttgaatgactgacaagcatttgttctttgatgccatgatcaacagaaatcttacacataaccgcacagtaaaggtatatgtagataaggagacaacaaacaaagataagatcagctaaatatacttgctgcgttcattgaaggctcaccgtttcgaggctcctgaaacttgattggtatttgtgacatctgtggttggtgtttcctaacctgccatgaagcataagaacgtatgtaactcattccaacacagtataaccatattcatataggtcaatcctacaaacctttacaccagccattgataacaacttgtgcgaggctacgtaaacataatcagagttgtcaatccttttctctacaaaatatatgacttcagatacacctgactgcaagaaagataagtattatagttagtgttgaaccaatttcttcaagtgaaaaggcgcggtttactagtaaattattaataaaatgcaatgtgtttgtatacattaactaaagtttaaccggcaaagcatgcagtaaatatgaaacttttaagctaaaatgtgccgttaggttttatgaagtgtatgattgagatatatggtgttataatgcatttcctcaaagtgagagtaatttaaataggtgatgacaaaaatacattttaactttaagatactgattctatccagaaacaaacctggataataatcttagcacactcattgcaggggaacatggtaacatataatttctgcaaagagaagataacacaagattattcttagcttataaaggcaaattaatgagatgctttaagtttgtaggagattagaagtccaaacctgtccagccgctgaagcatggtttgtatttaaaatagcattaacctcagcatgaacaacatagctgtcagggtgaaagatgacggtcacaattagggacttagaattcaacatctaagccttgctataggagactatttttgtattcaaggaatgcatatgtagtgtagcacagtgtaaagcttagaggaattaacaccagggcttctcacacaaattttacgcaactggattgggtacaagctaactaaagtctaagagcatctttcccatccttgaggaggtactacgaggtaccatgagatacgaggtactatgaggtacgaggtaccatgaggtaccaatttaatctaaccgttgatttaggaggggtatgatcgggctaaacaaatttagggtggcgctaatccctcaccctcttgatggcgttttgcttgcttgctcgtggtggctcaaagggacccaaccatgtccgccgccgccggcggcaagagctgcacgggaggaggcgaggaggcgattgccgggctcctcgacagcggcagcggcgtccggcgagtacacgctcgtgacgacgagggcgacaagatactcgtcggcgacgtgccatgaatgaatgaatctctcgtattctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31178 - DNA, 5909 bp, Oryza sativa
gcatatagcatcttcgtctgtgcgatttgtgcattagtgctttgcgaatcgagaccgggttagcgttatgctttaattgatggattcatgaatcgtatactatccgattcgaggtggtctctggttcggaagaaaaatgaggaatggtttgatgtcgagttgatggttgagaattggtctcctacttgggaaatattttctctcaaatgatttcttaacaacatggagttgattgtgctaatgattgtgcttgccagctttgacttaaagccatactgtagttttgagttttgattagttgaatccatattatggttttaatcattgtgtgatgccaaggatgcttaaacatgtaaatttcatgcaaggtattttgccatttcgaccaaaaatcgtgggcagctggtgacttgaccaaagtctttgtgtagaaaactcaacaaagggtgaattatttttcttgtacgactgctgtagtatcaatccctgaatcgcagcaaaactttctagataaacatgtgcaccttttaaaagggaattgacttggaaaccaaagaactttttttttctttgcaagggacaaataacatattgataacctggttaagtcattatggcactcctacaaaacctttttgtgttacatcaaagaaattaatacttttctcttgtactttttgcagggaggagaaacagaggatagatcaaagtgaaatactgaccttggacaacattagaacctccttggttaggcaagaagacagcatcatattcagcctcttagagagagcacagttttgctacaatgctgatatatatgataaaaatgctttccatgtggatggatttgatggctctttggttgaattcatggttagagaaaccgaaaaactacatcaacaggtagagcagggttgtaactagcaatataattgttcattgtatgccaaaaattgcaaaatgttgatggttctggccatcttgtgtaggttgggagatacaagagccctgatgagcacccattctttccggaggatctgcctgaaccactgttgccacctctccagtatccaaaggtaatgcataaactcgtgttcttagacatctagttcttctctgtaggctttcagcattccttttgttagtataggcaaacatagtccttcattgactaatcactaatatatcaggttttattatttgggtttatgcttgcctctctctccctatctctctctctgaactgacagtagatgaattggttatgcatcttatgtattcgtagatgttgaattcttctgtgtgggcttgcgtagcttcttttgtcagtgaaggcaagcatgtacctttgttgactgaccactagtatatcggttctgtggtgggatatcgtgcttactgtccacctgcaacataatacaacttttgatacgaagtggagtaccatctattgagactcacattgctaattgattactgtgctgttgtattgttataagtaaatttggataaaattcatatttttgttcttgtcttttctaggttttgcatcctattgctgattctattaatatcaacaaggagatttggaaaatgtattttgatgagcttcttccaagattagtgaaagaaggaagtgatggtaattatggatccagtgctctttgtgacacgatctgcttgcaggtactacagttagtataccaaatgttctaataatctggcctcgtactgcttctggctactgtgctgtagctttcatttgctcaaaataatttagcattagcaaaataattcttgtaaaaccatttcttgttgtagtattgcttcaagatgttctgctgccagaattttcaccagatgtcattttcatagtattagtactatactgttgttcactggtgactcgtgcaattaggcatttttatattgggaaattatgctcacctgttcttgttttcctgttctatcatccaggcgctctccaaaagaattcactatggtaagtttgtggcagaggctaagtttcaagagtctcctgaagcttacatgcctgcgataatagcacaggtttgtgttctgttttgctgtataatctgtctttatcatgggaagcaaataaattccatgtgttttcttgtacattactttaggtacatatcaaagttgagtctattatgcaagcggctaattatttttatctgggaatttcaggactgcgatcaactaatgcacctcctcacctatgaaacggtggagcgtgctattgaacatagggtggaagctaaggctaagatctttggacaggaggtggatttaggcgctgaagacaacggcgctccaccaatgtacaagataaggcccagtttggtggctgaactgtacagctacaggatcatgccgctaaccaaggaggttcaagtagcctacttgctgaggagattggattgattgtttacgattgtaaactgccagcttcggtttcctggcatcaaagaataaattaggggaaagacaaccataggtatccattttgggacaactgaaagaaaatattttattcgggtttacactatattttgtggcaagaacaagcagaagcaggatatcacatgaaatgatatggagatgttgcatataatataatagatttataccatcttttttgcatcgtttttgtgtactggaattgtttatgtaatgatcggtcgcagccatcggttgcgatgatctggacatgcgcatctccgtaatgtggcagaaattcatcgcaggtttcctaaacttcaggccgtgcgcactcctgaaaattggtagggctccagcatgttgaacttgaaaactattattccttcatccaaaactatagcaacctaatcctgaattgaacatattctacaactaggatacgataagttgccatatttgggagtctccaaattcatagaatttcatataataatagtagtaggttatgttcaacagagggagtagtgatttaggattcatgcagtctttagtgggagagaactgaagcacttctgtgtatcgcctgggttgtacaaactacaaagatccttgagcacaggtaatttaagaagagtggtttaaccagagatcatagcatctcgctaaatatcaatacaaagacaaatatagtagtagggacgcttatagtacagaggatatgccattaaatatttgacgttttcgcatcatttttacatcccttctaatagccggcagcctgctggtctcatgtcttaccacaaaattgggagtttgggaccaacataggtcctacaggagtaagtaaaccctgacagcagtggtatcagcaaatggggcatgtaccaagaacatctgttgaaatgcataaagaggaaaaccaaaactcttcccgtagaaacctggggaactgaattcctgggatttggagaaagaattaactgctcttgttagctgtgaggtatacttggaaccagcagaataaataaactaacaaaaatgcatcccaggcagtataacacaaaagtaaagctatgaaagggagcttttacttcctttcaactaaggttagcatcaattgtgggaagtagagtgtgggttagcataacagtagggtgatgtgggtggatggctgtcaaagatgttggatagtgtgctctcaggacatcatgctggaatccttgataatttcgtataatgagatgacaatctcgataatcagcagtataatgacaccccactccagcaaatctgatcttctattctggagaacttcttgaagaaaatgaatgttgtgctgttgcaataataaagtgtaagcacgaatgggaactcaaaattttttaaaaaaatcagctaatacactgaaaatgaacacaaatcgaagaacttacctccacaaatttcaatttgaagtcgaggcttccaaaacgttggttcagctcatattcttcccgaagatactcaagtatttgagcataatttgaatttttccaagcgatttcagacctgaagaaaaagtcattcttttaaggggctgccataagatacgcaaggagaccgtatccacgatgtcgtaaaattccctttagatcagcttttatccatatttttttgtcatggtagtcttgggttcttatcaaaccatgtggatagttggcaaattccaagccttacaactggaaacagccagttgaggacaccaaaatgttttgcaattttcataagctaagcatgatatggaaagaggaattttattaaaaggtggagtattatggcaaatcagcattaactaatgagacttccgacaaaaaatgccaccttcactcggaatataaataatttatgttatagaagccatataattcttcctttccttcaattattcccttacttaaatggcaaatgagtatgcttccttaagtaaaatggcatttgcagagctagggttaatgcaaagcatcagggaaaacaataacataacatttgtataatgaacaaagtgcttttataacacagaactgtggcatgtaaactccaattttacagttcagagctaaaatgcattaaccttttaaacacaccagaaaagaatatcaaactacatgcctccttcccccacagcatagcttgtcacaatgcacgtaggattggtatacaatgagattacttccatacatgataaaaaagagaggaaattatgcaattgcaacggaagacatgaaccatctaaaaagggaatgtggtacttagattgtagaagagatacctgtcaaaaaggccaagtctgatgataacatcagcaaggttagaattagccttgccaacaagttggaacagcttctttctttgcatggtaaagttcccagtcttctccatgacacgattaatttcagtaaattcctcaaccatgtcatcgacctaccaaaattagtgttttttagaaccttaagaacaaaatttcaaggctaccaccacatggaaaaagcttgtcgaagttgccccttttcagtacctgccgtatgtaatgatcaagagcaatactttggccaagaacacttgcaatgatgcgaattccatctgtatctaggcttttaagaactatatagtcaagacctcctttcatccatgttgtcagggagggcttctcaactactgcataatctggtcattgtagaattgatatcatgtgaggatgtaatacaatcttaaattcttaaccttacacgctacttcactactttgcaaatgagccagttttgtcccagtgaaagaaaagcttttgcaactgtttagggggtagaaggggagctactcaactctaaatgacttcacatattaccagcctatgaatgcatcacgtccaatatcaatcagatgcatatggactctcttgtagttctatgggattttatcaaaatgtaattttcactaacatagaaggcaattgaattatatgctagtcgtacacacaatataatggaacagtgtgaagaaaactagaagtaccgagtaaaatgtctttgttcacaaggtaaaatatgacaagcaagatagtgaatagcatgtgtaataccatcttttctcatctccggaagccatcctgaagcatgtttcctgatgatatcaagatagtgctcagcctcatggtcagcaatgttgaaaagcacagccgaaccatattggaacacaaccacatagcgatagcaaaatctgttgtccttaactccaatgtcctacagaaatgttagccaatcattgcagagaagttaaattttgcagtgcagaaaaagagagatttcacaaaattgcgttcaacaaattaccaaggtggagttaataacttaaatttgttgattcaaaagcatttggaccaggaactatgtgatggtaaattggaa

SEQ ID NO: 31179 - DNA, 11045 bp, Oryza sativa
atgaggaggcctcgtcgcgaggaggcgaaggaggcgggtgcacgcgcgcagccgccccatcgaagcgttcggtgcgtgcgtgttttggtggtggtgtggtgcggcgccgcgagccgccaagggctctctccctccctcctctgcggcttccagtctcgtcttggacttggagaggaagaagggaggaacgtggtgggtgggcccataaactgcaacacggaggcctgcgccgcaagaaatgggccagtactcctcttctcggtgggcctgagtacgtacttagcctccattgatagatggcccattgggctcgatgacatttctcttccaaaaaaaggccaactgcatatttgtaacgattttgctatatctcactcgaaagatttttttcttatctcttactcgattttctcactcaaatttacggtgcattttcttgtaagttacagtgtaatttatgaaagttacactgtaacttttgtaagttacactgtaatttttaaatcttcgcatgtaaattttaaattttgtattggatttggtcttttgcttgaggatatggtaatttagtgtccattatagtgtttcttaattgctttttgctttttattatatctattggattttaattcaaagattaaaaatctatgtgatacgatcataaaaatctttcgaaaaatgtataggtaatctctatttgtaactgttttgaaccggtattttattaaatttacaacttaaaaaacgtaattacatgcttaccatcaaaactgttggcacccgtaaatccataatacttgccattggattcaaggccaggaataacacgattagaagatggatttttccaaaaattggtagaataggccatcctacatggtgattcagaaattgctgaccccttccccccaaccctaattggtggtacctcctccgtccaccattgttgctgctcttgctacaaccctaccaacttgctagcttgctgctgctcccaccgcgggcctatagcgagctgctgcacgcgatgctcccgatgcaggcatgttgcaattgctatcacgagcgacgcgggatcgcctccagcggctttcgtcgacttcctagcacctctagcaatattgctctagaaaggtgagatttttccattcttctaatttcttttttataaaaaatgatatttcttttaaaatttgactctaaacttttttaatccattcttctactttttaaatctgtactgaatgtgatatttctttttaataaaaattaatttaaacaaaaaatgtgttatttcttttaatgttttgacttgtatgccgtacattatgggttcaaatccttgacatatcaacattttttccattaattttgttcgttggccgatgttttctttcagtttggtgggtaatagggtgattagtaccgtatatatttttttcaaaaacagaaatcatcattaatcatttatatgtacgcacggagattgaagatttgaagaaaaaaaacaaggaaaaaaaacgaaaatggctgacctgggattcgaaccctagtcctaaggtacaccaggcaaaggaacttaccattgcagcagtacataactaattcattacaagacatcagtctgtttaccatgtataaggggtcagcgccaaatacatttgcgttggtgccatgccacgtcgctcctcgcccgccacgctggcgcaataccagcgccagtcctgttgacgctgacaggaacaacctcagcgctaacaactttggcgctgagccaacagcctatatctggatatagtttttggcaaagactaatttcgaaataagttttctacaaggatcaatttgtcaaaaaaaaaaacaaactttgtatacgtatgcgtatataaagtttgtatacacgtatacaaagttaaattgtatatacgtatacaacatatacatgtatgtagtttttatataggtaaaaaatgtatgcatatgaataaatttttatgtttattcgtatgtgtatacattcatttattgtatgtaggaatagtagtaggtatagtagtatagtagtgctagtatagtagtagtacagtagtactataggggcggactgaccgcgggcgcgcgcccagccgccgatcagccgcccccgcgcaacgggaagaaagatcaatgaggacgcacgcccgcatgcaatgcaagcggcagatacacgatcgatcgatcagtctagttgtgcagcgggttcggtccgctcggcacgacccgcttggacacgtcgtagcgcgcgtcgatctcctcgccggcgcggctgggcggcggcatcggcacccgccgccgcttgccgacgccgacgccgccgccgccaccgccgtggcgccgactcgcgtgcagctgctggcaccacgggagccgccgccgcgtggccccctgctgctggtcgcagagacggcccaagaactcctcgtctggcatcgccggtgcagtcttcgccgaggcggcgacggcgactaccaggaggagctgcagggaggccaccgccaccagcagggtacagacgccgacggaggaagacgaaggcttcatctttgctgctgttcttggagagcttgttgatccgagaacaatggaggcgcgcgcgtgtgagagatcgatcgagacgatgagaggctaggcgtgtctggagggtagtggggctttataacagggggatgagaggagatcgcgaaagcggctggaaaatcggagacggtcggggacggagagcttcactgcacggttgcacgcgacacgctctgaaactctgaagcgaacaacctgcagtgtacaagagagtagtgttttcgagcgaaatttgttgggatcaagggaagtttgctaacggatgacagttcgcggtgctactggattgttattagcggatcgaatgcgaattcgggcctaaagttgggcgtgtacgggccatggcccatggcttgcagccttattgtaggatgtagaagggctgaatctctccactaaacatctaaagcttaaatacaagcataatatttacttactagcactactagtatctccatgtaagcataccacatcaacccatcgaacatataaagctcaacatttaaacatatagtaattatgcctataaattattttattctaaaactaaacaaacacatgctaaatcatcattatcaaatcattgttataatatttcaatctaaatcatgttatcatttctccaatatgtaacatatatcagtagcaaaagcacgggacatcatgtagttattatttgcatgtgtgtgagggtttgaattgctcctataaaaaaagtgttgaattgtagtgggtaatgtttgagaagtacaagtatgcaggaatactagccaatagccagttagtcgcgtgactttggacgcctacaaaaaagtgggagggagggagagggagaggtgaggaaaaagatgagatgatgaaaatgttgttgacatgtgggttatatctgctaactgaataagtcagtcgtgatcatactgttacatcaacaaaaatcattttctaaaacattgcaggagtagatttacaccggtttttgaacatgatggagccgttatactcgattttatggttaagagagtgattcaatcaagagaaagaaagagatgagagttataaaacacacttattccaaaatacaatgttttgtcgatttgaagcttagatgggtttgtacaggccatatgcccctgcccttctttttgtgtgtgtgtgtgagagagagagagtaagtgttaattattgatgggcgatgggctgatgtttttatgtatatgtattcaggaacattgctgaagagagaaattgatactgtaataatatatactgctccctccgtcttaaaatataagcttttttttactttgacacagtcttcgaaatgttattttgacaaacaatgtctataaaaataagatgttttaaataaaaaagagttacatataatggcagtttgtttaatgataaatctactaacatcaattttatataattgattttttattttttttgttaatagttaaatttaaaaaggtttgacttggcactatgctaaaaatatttatattttgggacggagggagtatttcgcagaagtgcagtgctgggcgttgatcgttgactttagactattttgtggagtcaaccgcaacgaagctcatgccttacattacatcacatcggtagaaatatcgttattcaaattacttggtgctgtgtagtgtaccaagagtctcatcggttatccatattctctaataagctaaaatgacttattagtaaatataaaaattaacatgtaaaacttttatatatttgttcgtagcgacttaaaagccaatgttaaaaagaaattactttaaaaatattttaattttaagttaaaaaatttaaattttgatttatacttttacttattaggccaaccgatgaggcttgaagagtcaaggagcatctaaggaagagctcctagcagaagtaacttctcttatacgaatacgagtaacaaactgagcggtcaccgttaaaagagcatcccagggaagcttttctcttcattaatttattttctttcaacttattttttttctaacttgaaaataaattccttcctcttgtgttatgtgatcatgattcatttcggtaacacaaaatttactatagaacatccaaaaatagtgtaattcactataagacaccacaaatacgtgacactgtcgatggtcactataaaagttgtctaattggataaggcgataagcactttctaactctggactatcagtctacctctttaaaattttaatagcagcacatcacactaaccctattttacacaattaatattatttgaacttctaaaaacttttacaaattataatatgttatttgttctaatatcagttaggcacatatttgtgctgataatgttgcatgtgttggacttaatgaacattatttactccacgatgaaactttgtatatgaaaggagataaaacatggtatttgtttctattagaagtattgatggtttttatgttccgagaaatattgtttccatatttgtatccaatcatattcaattctaattatttatattcaagataacttgtatttaatttcgtatccgagttattcgtatttatttttatatctagctatatgaaaatgaatatgatattatcactatccggctgtatccgctgcagtcttaggacatccacaatattatatgcaaaatagtcttaaggaataaagcaatatttttttctacctttatgcattgggacaggagaaaacaaagaatattgctatggccaaacctaaaattaactctacatcataagaaataaaaaattagttcatgttttttgcaacatgcatggtgctttttcattcatgttgagtagaatttttttaggtcctagcttaagatcaagaaaagattatatgtaatatacatatagtatgtgttatatacaaaagaatataagaaagtggatcccatcttagagcgagtacaatagcaggctacaaatcagctataagcatatgtggatgagataagagaagagagagaaggaaagcgggctacagatttatagtcagctgcagcacgaactttaaaatattatgtatttaagatgtgcgatcatgtattaatggtgtagtatatatttataggtaactattatataaataagatattaaattaactatatatgatttggagctagtagttagctatactactccctccatctacttttgataggtatattttcaaatatgaaaaattttacttttgataggcatatttcaatccaaccacctatcctcttataactttctcggatttaatgcgtgactctctattcttccatacaagattagttacatgggcatcgagaaatgtaaatattaataaatcgtttgtttacgaggaataattagtagcatgtttaaatggatgataagtagaattatttatccttggttattgtgccaagatgaaatatgactatcaaaagtagatggatgaagtattaaacttgctcctattgctccagtgacattgaacaattaaggatgcctgttactatcatccaaccgatcacaggcgcagcagatcccaacacatgtgttggtttgtgacgttcgtcggtatgtcattcatgggacatcgacggttcgacggcgaccagcaagtgcaatgatttgtggaaccagtctgctagagcttgaaagagttggtgacaatattcgtctcgttaccaaaactgtcaaaatttcatgggaccaagtggaacatagggtgtgtttagttcacgtcaaaattaaaagtttgattgaaattgaaacgatgtgacggaaatgttagaagtttatgtgtagaaaaattttgacgtgatgaaaaagttaaaagtttgaagaaaaagtttgtaactaaactcggccatactaacttcaagtggcacagctgtacagagattcgttaattttggatatatatttttttttcaccttagaagcacagcacagtttgataaggtcacaaaatcaacataattcacatttatttgtctagccaaaatgtagtatcaccaacttaattattttgatgattaaggtccatctagacaccaataaaaaatgtccaaaactcagagggcagtctaattagtgagactaactactacttacaagttacaagtcgcaccaaagaacacttcattgaaatacggaccatacggtatataattagccaattagggccatggccgactgtctgaaactgattgctcactcttagtttccagctattagtttctttgtttatggaggttttgctgtctcaaagttttgaaaccaacaatggcactgtagatggtaacaacacttgcctacaatatgcaaaataataaaaaagattccttgtgttagctaggcccttagtagataacctgcaaaaattggattggttgctcgtcaggtagccaatcctgcttatgcttcaagcttagctctaccctttttcactttcaggttgcctttgtagccaccacacacattctattttccttctcgcgaaatgttaattttagaaagctcacgccgtcacgcgtagtgatcattgctatgctatcatgcaaaggaacatgttgatcagtgtagtacgcatttgctagcacgaatcatcgattattccctcatccattatctacaaacaagaacatcttttttccagattatagacgttgctggggtccccgattaatagtgaattgtcttagctcaactattagttacggagtagtattacagaaaaccgtttttcagaagatttaacatgtggatgaataattaattgctagattaggtgctggttaattggaatgtacatcagccatgatagctcgtgcatcttcggtcactgctgacatacatcgatcgcttgcgtcgacgactcgacgtcgttgaacggttcagaaccgtccaagctgaacgaccggatagttttcttggtatattgaacgttttcccatctgatgtttcacctaaaagttgtacatgcattctttttcatattacaggtagttaacttgtcatttgtcaaataagagcgacatttgtttaatcagattagaggataaatttatttgtctaattaagaaagccataatagagattccaagcttgttgaagaaaaaaaccaggaaaaataacaaggcagagcaaaatgaaaatgaagacaaaggaacaaactgcgacgtactagggcaattcatctctaggaaacttttctacagtactttttcaaaaaaaaaaaacaccaggacagttcatgccttaggctgtgttagtcacttgttattggtaactaatcatcgcgcacctaagacggaacgaatcattagcgtataattaattagttttagtaaattgatcaatatatttttaaagcaatttctatacataaaacttctaaaaaaatatgtaccgtttaacagttcgaaaaacatgcgtgtggaaaacgagaaagatgagttggaaacttcaactaaagaactcaaagagaccagagttaacctttgatccagatatagtgatagcatggaaaacaatgcatcatatgcttttacgagcccatcgcgatgagctagtaagagcaggtacaataggcgtccgattgctagcgatagcgattccacgtaggtttgatgatgcgttggaggagagagagcgcgtttgcgggcgactaattagtcgctgagcggcacgtgcgctccaagaaattgtgggcccagcaggtagcatacacgagctgcgagataagtcggttgatgcagtgtcgcgagtttgcaaccatgagtccacgagtcacccgccggccgccggggagctcgtccgatggtgattgatgttgtcgagctggggtcgccgtcatcaactgtgtggagctgggttgccgatggttcaccgcggtcggcgacgcttgtggccaccgcgctcgaggttggttcctcacttagatctggtaagcacctcttgaatccagctagtatctagcagtggtatgcacgggctcatgccatggcgatggaagcaaggtttgagagggcatgaccatggtccacggccagcaatggtgaaaggccttctcgccggcgctaccagccgaggtcggcttgttctcatgttgaacggcagctccttcccgtggcaacgatgcgtgattttattcatcacacaactcattcgtggtcttgcttgcttcgatttgattttttagacatcaagttttgatcttttgatcttagattgatctgatttcttgtgttgtcttggacgggctggtggagaagaagaacagagagagatatgtgggcccatgtggaataaaataaatgtgtgatgcgtcagattatagcccacttactgtatcatctgtctcttgagtttgataaaaatgacgtggaataaattggagtaatcaatagactatactattaaacttgctctaagtggtcttgcctctccacgttatacgttgggcgtaagcaggcgatctgcgcacgaaaccataggcaaggaacgacattgggcaagcgtgatgccacgcgtgtgtctcaagagataaaggagggaactggagtaacatacgatggtttatcaaacaacgacccaagcagatttattgccggcaacccctcaacgtcgtcacgctcctctatgccacaccgtctagcttctccaagtcccctgacatgtgtgaggtaaggaggggccgtgtcacatcccaatccggcaccaccgtacaacggcacctgatagaagcgtgtcgtagaaaaaacggcgcgaaccgcttccgacgaaaccgcgatctcggaaccagtcctaggacatagtgctggtacccacggtgacaaatatggactaaaataaatagagtacttatttaccttaacttaggttgcagctcagaacagcccgagaatgcaaccgacgacgcggacggggaaacaccaacaacagcagcagcagcggaaccaacggtctaacacccaacaccacaggcgacggctggggaccaggcgaaaaatcttcacttcactttatcttctcttcagggcggaggaactatatatatttatatagagcaagggtgagtactttcgtactcagcaagtcacgggaatttaggtgtttaatgcaagcttggaagagaggcaaggttgttttgcaaatcctttgtttgaaatcatttttgaaatcactaagtgatttatttctttttaattttgggtcgaaaggagacttgcgtctcgattcgacttaagagatgattttcaacaactcaaatggttatgtaccgacctcccgggtcagatcattacttatcggctcccagagccatttcacttgattaactggctcccagagcctttttcaatttctcgtactcctagagtctagctgcccagcagcacaacaatccgcttccactcgggaagactagtctatgatgcccgtagacatcccgaatcacacagattcgtttctgaccactcaggtcatccatctgccacataggctgattcttgttacgattcccaatccacaacaacttttcacaaagcacatgcaaacaaatctacgcaacgggaaccacctcacatccgcccatgaccgtgggcacggctgttcgaacagttagttaacctctgtagaggggtacactttacccacaagacacgaacttactccagacactggccggtgttagagattcgcgataaagcctttcccaagccgacccagggatacctcatgccacatagaaggatcaaatcctcacataaacataggccattttagacagtcacaaattatctccaaccatctcgatcggtaagttagcaagcttctcgttcttgccttaccaggaacccggtttggctccaaccgaccccaccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcaggttttgaaggcttcacaaacccatttcccaagttttcgacaatcaacggtgtatgtgggatatttggtacacgcgctcagagagcacggataccgaagtaccacaagggtggaccgacaaggaatcagggtagtacaacctacaggaattagtgcgactactgggtaggttcgtcggtttggcacgcaaaccgaggccaagcaaattaagtgtgtgattctaataatgcaagttgcaaaaaaaataataatgattttccaattataggagcaattggtcaaaggggg

SEQ ID NO: 31180 - DNA, 2340 bp, Oryza sativa
gatgggcccacgtgcaaccacatggcgcaccgtggtctacgcgcgcacgtagggggaagcgaggctagccggtttgactcggtctagccgagttggcaccgacgtggcgcctacgcagcggccacgtgggccggtaacaggaggaagaaagggggcccggccgaatggacggcggacggcggccgagttcaccggagcttgtcgcgatgattcgagagagagggagcacaccggaacgatgagatggaggagatagagtgcgccaccggctcggattcaccgaagggagaccggcgacgacgaattgcggcggcgctcgccggcggcgagaaaaggggcaaacggcggaggggcgacgaggattcaattcgaggcggtggaagcatctccggggttcaaggagtccgtttccggcgtcggatggggcggaagagcaccgaggagggccggcgacgagcagcggcctccaagagcgggcggcaacggcggcgaggccataccgggcggcggcgggtctaggggcgacgtctacgcgcgttcgggagtgccaccgagctatcacgcagactagagggggcgagggagagcaaggaaggggaacgggaggaggcactaccgagctgggcgggcagtgataggcggtcgacggcacggggcgagctctccggccttggacggggaaggggaagaagaggggtggctggagtcttattcggctcctcgcgcgccggcttctaggcacgcgcgatggcgaggaggcgaaagcgacgagcggcaacacggtaatggcgcgacggcagtggaggggcaagagcagagagagagcggggggcgggagtggcttggcttttataggcggagaagaggcggtttgggagggggaaccgacatagggcggtcaaggcggcaactggctctggtgctagggcgcggctggtggccacgggcggcagaaggagacagcggcagaggccgggaaaaggaaaaaagggtgaggaaaaggggactctgctccttgcccaaaactggatgagggacaaagggagagagagtgggggcaaggagggagaggagctctgcctccattgtttggaaggacgcggcttggagcagcggacagggggtgacgccggtggtgaccacggaggtctctgcctcccggttttggatgctagcggcgtgcagcggcagagcggcagcgtgcgatgcagctggagccagggcagtcggccaccgcgcaggagcgcgcgcgcggagcgcgggcgcgggttcaaattgcggcagcgggagttttggcgccgaggtgagaagagggagagagctcggctcggcgatggctcacgcgcacgcgcgtgtggcgcacgtgcggagcgagggaggagaaggctgagagagagaacgggccgagagagatgggccaaaggagggaattggtccatccaaaatagagggatgcaaaatagacttcttccaagaaactgatttggagaagatttgaacatggaatttgacttggacttctggattgggatctggatgagaggaagggtctaggaagagatcaaaaggggaaaatttggatatttttggggtcgggcgaaaatttggcgaggattcaaagagaggacttgaattttggaatttgatttggagacttgaatcggaattggaatcttgaggtggacgattttgatggcgacgagagtgaacaacaatggagattgaattgagatccatgacacgacttagactcacactcaaagaacgaaattttcgcaattagggttttgccgaattagtttttaacgtctcacgaaaagcggagcgttacaggccgcaagctcaccgccacctagcttctatctccgatccgtgctgtaaacttgccaccgagcttcacacgtcaccaaggaaaggggtagcaggtctggcgagctcgatggggcagtgggtgatatatggagatggcaacggtggttgtgaatcgagcgaaggagggagcgataacaacgatggattggctaggagtggtagactagttgtcagcagcgccgattccatggggaagaagagaggaggatgtggaatagaaagcgaagaaatgatgggtggatccacgtaggttgacataatcatatacaagatatttgtgggtggactcagggacgtgttttttatttggtttctagcaatgaagttctcattgtaaaatgtttcaacagaagtataaattaaaatagtttaggagctgatttgaaaaatatagtgttgaactggaggcaaaaaatggattatgagcccctagaaatactatgcaacgtgaaatgtgtatcttttcag

SEQ ID NO: 31181 - DNA, 3643 bp, Oryza sativa
atggccccacgctactatcaagctcggcaatgaggttgcccttttatggttacaaagaaggaaaaaaaaaagtggaacaaagcctcggaggccggaagcatctagactcgcggggccatttgaccaaccgaaactcgacggcccacccaccaaccaccaccaccaccaccacacccgctcctcctgctccaccgcactctgcagtccgcacccgcgcgaggcttccgctccgctcccctccgatccgtggcctcctcatcgcccctattaaacgggaacccagcccggcgtccccttctcggcttcctcctccaccatccatccatccgcgcgcggtgcgtagtagcgagaagagaagggggggagggcaaagcgatggctccgatgaagctgtacgggtcgacgctgtcgtggaacgtgacgaggtgcgtggcggtgctggaggaggccggcgccgagtacgagatcgtgccgctcgatttctccaaaggcgagcacaaggcccccgaccacctcgccaggaacgtacgtgcccaccgcccctcccctcgctcgctagttgtttcctttctttttgttacgatttccctcagtcgacgacgagatatgttgtttccatgccctcactttcagtcaacgggagcgattttgctgcggccgctaatatcttgggacttgggagttatcacccaataagaagtctaggagttctacgatgaggcgtttaggtttaagacgaaaataaaatatgtttaagaagtactgtgttccaagtagacatatgaaagaggtatatatagtttcttccggtaatccttcaataccacgaattttgggttctgtcatccacagcgtagacggtagtaatccttgcttcagcatcaaaccaccctttctccgcccccccccccccccccccacaaggctaacatcctcacttcctgcaaccaccaccgacgctgccacgtacacacagcactatggtatgtcatgatcatgctatattaggctaccattttgatgatgtcgtattcgtatagccctcaagtggaagatctgatctgtccatcttagatcgaatggctgatgttgacccaaagaaattatggtgtgcttctctgacttgctcctgggatttagacgatctccagttttctatttgagaggtttgtttggatggtgccctgacctgagcgctctcactggcatccaaccacaggccaccaaaatcggacgcctgttctcagggtgtgaaccaaacaggccttgatgataaatgtgcgcagctttaagttcaagagtatgtagcaagatttgggtgggtgaactggatcaaatgtggaaaagtttattgtttatatccgttcaaagaacagaaatttgtagttcttctaataaactgttcgagagaaggtgaactggatcaaatgtggaaaagtttattgtttatatccgttcgaagaacagaaatttgtagttcttctaataaactgttcaagagaattgctaataagaatcgatttcctgccatgttaatttgtgaactagttactcctgatctccaaatccatttgagagaaagggaaagggaaaagtgactggagtgaaggaagctataggtaggcaaagaacaaacaaatgcctccatttaattttctggggaacaaaggaggcgtgataattaggtgatgaggtttagaatttaaaaggaggtagtagatgaccacttgtcgctgccaggtgtttcctatagtaaatattgtctggtagaccgtacagtattgtttgaggagaaatttttttaatcaactctgcatgcttcatcagccttatcctgaccaatataaatttgctggctgtgctctattacttctaacattttcagtgtccaacttatggactttttgcctcttccaaccattgaacagaggaatagatgggaatgccatcttttacacgtttgttatacaactaaccagatgcccatgcattgtaatggtttctatttttctaataaatatgtcgtattttttaatttgagaactcctaaaataaatatagttttcaaccaaacatcaatccataaaggacattattaaaagtcacatgcacaaatatcaacttcttagataatcctggcaactcaaagaggtggtaggggctggcacatttcaccaccggcaccaccattagcttcctttatattactcatgtttgatggtgatatatttatatgtgtatgcttttagttggtttgtgatgtagcaatttaattttttacacttgttaccatatgtcacctttctggaatctgttatgtcgtgagtgaaggtccctatccataggattatctcaccagcataactttgacaataaatacatttgtcgcacttgggggataactatgacatttgtttgctaaactcattgtttcttgtgatatcctctgcagccctttggtcaggtgccggctttgcaagatggtgacttgttcctctggggtatgatgctatctcttggtgttgttttatccttttttccccctcgtaaataaagggaactgatgctttagctgatttttctttcaccgtggaaactatcatgcctcttttcctaacatatactaacaacgctagcacatcctcacatgaccttttttctggaagcacctgattcagtgttatggatattctttattaaaggataaatgagtccttttttttgccgggttggccaaaagaagcgaccaaccaattgcattaagattaaaaggaggtgtctacaaagataaaaggagtctgcgaaattcattaatacattatggtgaaaaatacaattaataaaaaaaaggaatagccaggaggaggctaggtatcttggaattaagaagaaaaggttcaagaaatccccgaggagaaaatttgccagattcaagattcaaacccaggtgggctgtgggaacaaccctgcaacaaaccacctcacccaatgaaaagtacaattcattgccatcgcgaactgtcattgtgttgtcagggttaaggtttttattggtaaagtattaagagtaaccaaactgagccttttagtcatgcaccatagtctcatggtcgggatggtctcaaactgatgaagcaataaatttcttttgaagaatatgatgaaacaatacatactattactgccaattacgagttcaagccaatgcctataaatcatgtttataattttaattcctacgacaggcatagtattgcagttttgggccagtctcttagagtaagagaccactgttgagcatatgcctgtagaatcttggtcatttacaaatgttgtttttttaaccataactgatagctctgtctaatttcttcttgttagaatcacgtgcaatttgcaagtatgtatgccgcaagaacaaaccagagctgttgaaggatggcgacctcaaggagtcagcaatggtggatgtgtggcttgaagtggagtccaaccagtacactcctgcactgaaccccattctttttcagtgcctaatccgtccgatgatgtttggggcaccccccgacgagaaagttgttgaggagaaccttgagaagctgaagaaggtgttggaggtgtacgaggcgcgcctgacgaagtg

SEQ ID NO: 31182 - DNA, 25461 bp, Oryza sativa
  unsure (1)..(25461): unsure at all n locations
tggagactacatcagtgtcgcggacctaagccatgtggctggcactgtatgcttgggggctactccccacgcatccgtgttggacgcatacccgcatgtgaaggcctggtggactgacctgatggcaaggccgtcttcccagaaggtggcttcactgatgaagcctcctgcttaaggtagttgttctaggcacaggtttgtcgtccatggtccacagaataagctgaggtgtgcccagttggttgctcgtttaaggatttgtgttattatgtgtgtcctggatgttgaatgttcaagcaatcaggattgtgttgttatgctgcatatgatccaacctaagtcttgtactgctatgagcattcttgtgctctggccttcgctcttgagaaccttataataaattctgcttttagtcacctagcccttggtaatttttcattcgtcgattcgttgatcatgtttatgaagttaaaattgatacaattctggagtttacagaatatcatcgggctttaacttaacaaagtgaaagtgcaagcaattgtgtgcgtttgtttgttgtggaattagataatctagaacaagggggaagagatttttcatgtgttacaatatactactccctccgtcccataatgttgcaacctagaatgggatgagactcatcccatcctaggttgcaacattatggagacatgtccagattcgtagttctaggatgggtctcatcccatcttaggttgcaacattatgggacgaaggaagtacatgattcttatgttggagatatttgccacatgaacaggcctggtgacttctgagttctgacttggttgagaactgataaaccaattagtgttcctccatcaatttctcgatcttggttttgtcactttgtgcatctgctggaaattagcagtccccgaatgtagtagtgcaaagcagcctgagctgaaaatacagatagaacagctgatgagtgatgattgacagacatcacacgcggacgttcaatttatcccagcatgtgcaggatacatgttaactccctaaccttttcctttttcttcaaaagaatgtgctactatataccatactgtgtgtatacataactttgcttttcgaaaaaaaaaaaggaggggggaaaaagctcaagattatctggtaagcactaccactcactgtccaccacgaagaacacaagtacagcaaagctgccagagcacggcacagcacacaggtgacggctttgcagctcgcgactttgcaattgcatgcctttactttgggcgacgccggctcgcaaacccggcctaaacagcgccgttcgtcgcgcggccggggcagcagctacgcgcaaaggcgacagctcgcggaatggtcggaaagcgcgatagaatcggaccagcccgtcggtgagtggtgacttgccgttttcgccaataaataaagagaatgagaagctagccaactactcctacaaccagcagcgcagttacacccaaaccagcagcatcgacgattcgccgagctaggggcagaggcagaagtgcagaacgtacacgcgtggtgagcagaggagcaatggcgactcggcttctgctgctgctgctgctcttgctcggcatgtcgctgaaaggatcaggtgagtgagcgatcgaaatggctagctacgtagcgggtatatcgttgtcacgggccgagctcacacgacgcgcgcgtgcggtgtgcaaagggggcgtggtgcgtgtgcaggccgaacgtggcggaggcggcgctgcagaaggcgctggactacgcgtgcgggcacggcgcggactgcgccccggtgacgccgagcgggtcgtgctacagcccaaacaacgtggcggcgcactgctcctacgccgccaacagctacttccagcggaattcccaggccaagggcgccacctgcgacttcggcggcgccgccaccctctcctccaccgaccccagtacgtttctcacctcaactctgctagtacctttgatcttcgatgtgtttacttaacacgatattattctgtttatgttgtgcaggctcaggaacctgcaaataccctgcaaccgcaaggtgattaaccttcaactttcaatggccaaactcaaactgaataaaattagcatctgtgcttggaagatgaacccatgattcatgaactgaagcattttccttttcacatgttcttgtgcagtgctgcagggacaagcaccggaaccggcacggcgggtgcaggcacaggcaccggtacaagcacgagcacgagcacgagcacttcttccccgggctcttcaactgcagccacgggtacgccgatcatgggagggaccttcgctacgccgatcggcggcggcgcgtctgggccgacgactagcgccttgaatcctgacagcagcgaagcaccgtccccgtcccttggacgtcatcttctcctcacgtgcattgcctccatgctgctctctaattttcttttggcgtagtaatttggccggaaagtaacgtgaactgaagcagcatactgtgggagaatggagatttggctttccttttctgctttggagcttgtcgcggcctgttctttttctttaccagaactgcaggtcctgggtgtttacacctgttgtaccagtgcccagtgaactggccgtttgcatcatggcatgtttagtatgttatcgtgctagtgtcagcacattctcactgatattattgaatttcctactcagtactcaagtaaatgccttgaaattacagtgaaatcatttcaaaaggagagatcatactaactaggttcgagcagatttggtccagcccaatttcagggcacaagttgggccgaaccactcccgagcagaaagttagtgggcttttttttgctggaccggcccatgaacccaagtcgtgtactcgtctgctggtgtttttcgcgcgatgaaagcgtggggaaaccccgcgtcgtcgctgccgggtcgccatgtccgagctccgcgtgtcgagagcacgagccacctccggactcgccgcgatccacttattcctcgctcccaatgctatgcatggccgcatgcttcttcttcttctccacgtccccggcctctcttctcgctctttctctcccctcgtttctctctccctctcttgatctgtgtgcgtcttgcgcgcgttgtttgggcgagagctctggcggctgcgcgcgcgggtgttctcttcgtggcgagatcggcgttgatgcgcggcgcggcgtggcggtggtgggcgtgcgtgcgatgaggaagctgtgcccgaacctggaccgcgacgactcgctggacaccgtgctggaggtgcccatccccgatgagatgctcatcaacgcgccaggcaccgacaagcgccgcggcgccggcggcgccaacatgcgcgcgtggctcaagaaccaggcgttcgaccgcgccaccgtcggcggccccgccaacgcaaccgccgagctccagctcttcctcaacgtcgtcggctcgccgctcatcccctgccccgtcccccacgaccgcgccttcagccgctccatccgcgactcctccatcgtaagccaccgctcccctgcccgcgtcgcgcgcgcgcgcgtccatgcatgctccgctgccgggtgggtcttgacgcgttcatccccctcctcgtgtgtgtgcgcgcgtgtgtggtcagcaagcgtcgacggccaagtacatcatgcagcagtacatcgcggcgacgggcgggcaggcggcgttgcaggggctgcagagcatgtacgccgtgggaaaggtgcggatgtgcgcgtcggagttccacctcggcgaccagaacgtgaccgccgcgcagggccgcgccgaggtcggcgggttcgtgctctggcagaagtgccccgaggtctggtacttcgagctcatcatggccggccacaagatgagcgccggcagcgacggcaaggtcgcctggcgccagtccgccgccgagaactcccacgcctcccgggccctccccgccccctccgccgctccctccaggtcgatcgcactttgctcgccgccgcgccgccgcttccctccctctcaacgagcttcgatatcacgatgcaggggctggacccgaggtcgaatcgcgaacctgttctccgacgcggtgtgcatcggcgagaagatcatcaccggggaggagtgcttcatcctgaagctggaggcgagcgcggcgacgctgcgcgcccggagcgcggcggcgttcgacatcatccaccacacggtgtggggctacttcagccagcgcacgggcctgctcatccagttggaggactcgcacctcctccgcatgaagtccggcaagggcgcccgccgcagcgagaacatcttctgggagaccaccatggagtccaccatctccgactaccgccacatcgatggcatcaacatcgcccacggcggccacaccgccgtcacgctcttccgctacggcgagggctccgtcaaccacaagcggaagctggaggagacgtggacggtggaggaggccgacttcaacctgtacggtctcaccaccgactacttcctgccgccctccgacctcaagaaggacatcgacgagaagcgcgccggctgacccgcccggctagaataagatcccatgcaggcctgaattttggtagaggtggccataggtgtatggggtttgttcttgattccttaacattttttttcttcttcttttcttgtctaattgcaaagtaattcaaccatgatccaggaataaaattacttaaaagggttcatttttttaggacaaagcatggctgctgcaaaaatataggtggataggagcttgactgtttctgtttttaaaagctattgtaagaactgtgatgccatttatcatttgaatgattcaaacgtttaattctggacaggtacagtgaagagtgcatacaatctgatcaccgggtcagcagcagcacactaatgttcagaaaattacacatttgcttataagattgttaaaagaacagttgtagcaaaaaaaaaactccatattagattactaaggcataatcatcctctgtaattcagatagttatgaaatacttcaagcagcagggaaaattgaactggttaacttcaggaaaacagcatataaaaataatcaccaactataccattttacttaatacaaaccaaatattacaactgcacatttcatcaagaataactgtgttttaagttctacactctgcaagctacaatgttttttgagctccttcaaaaagatcgagcaaaagtttctccaaatcctcaggcttatactttatgtatcgctctaggtgcctagtgccatcaaggcggctatagtatcgtcccgtgaaagtacgataggcctgtataattttcagggatatcgaaatcctgacatcttcacggagttggtcatctgggatagaccatcctgtttgagttcgataagcatcttcaaatgacagattgaaatttttgaatttctctttaatgattttacgagaagcaccatccccagcagcacacaagccatcatcactcagaaaagagagaacatgactccacgatgccctctcgtagctcatcgcttgctgctgaaacttccgattgtgcacccggatccagtcatcaccaagaaagattttaagctctgagtttttcactttctggaccatgtagtagatgttgttcatcataaagatgtttcgtaatcgatcatctctatataatctggacccagcttcaagattttcttctagaattgcagtaactgactgcaaatgcaatgcactgacagtaaaatgaggacattggtttgccatagactgaatgtcagtggagaaatgctggcatcttcgatctgtgtcctttagaagcgaatcaagagttttgctataagctgtgagagcttttatatagttcataacatactttgtaaggggatgcacttcaccacgggccattgcattggatgaagtgtaggactggacagcatacttgaattctgtaattgtttttcttactgattctcccagctgtagcaggacttcattatattcagtcaaaactatatcatcacatccttcttgaaacaagaattctacttcagggagtaaatcatttaagacctcatacatatcaagcagacggaaaagcttttctggtttaggaggtccaattgctacagattcataaaaggtcagaagttgcatgactgagctcaatgaaatctcataaaaacacaagtctgcggttgattctgaaagttcaccaaagacatgattgctaaggcgcttctcacttgtaaggtagacttggacaaagaccttcattgcacgattccacctctttatcaatgaacttaacttggtccagttggtgctcaaaagttcttccatgctgagcttgtcaatacgaagagacccaaggttctcatctactgcactctgtcgtgtgcttatgtaagcctgggaacactccttatcatattcactcagaaacatgaagttggcaatggacttgacagcagagagtgcaccatgttgaatcaaatcagtcgcaaaatattctgatcctccagtagtttcagtctgtgttgtcttaccgtcacattgttcctcattgaatgagctgcttgaaaaatcatccacactgccatcctctgtagaccggaaagaaacaagtccttgttctattggttgtttgtaatgcgtaagaagataaacaaattcctcttcaagccttgccattgccatatcaaaaaggtcgccagcatatactatgagctcattatgctctttggcttccccaacagggtgtaagctccctaacctttcagtcagctgccgaattttgtacagcacttccaagtactgaaatgagttttgcggatcatgaacacgcatggaattttcaaaatccaaagtaagaatcttcttccgcagtgccttgagtgcatgctcaatatcacataactcctgttcttctcacagggtgatgtttgaaaactgcttaattaactcagcagccatcattttgtagactatatattcaacgtcttctataaaatcagtggaggtgattttcttccctgcttcacatgttcaaacaaaagagcaagtcaacatcattccactttggagtttggaaatacagaaaagctaacgttcaaagatgaatacagcaatgattcacgactcacaagaatatcttgagaatttgagatgcaagtataaaataaagtcatgaaaatgaaacatgagtttcaaaaaattaagcataacaatatgcaagcaaacgtggaaacagaaagaattacactgtggaagtcacatcatggttgaagatcgattctccttttcccaaagcttttcattacccagccaattctcctttttctttgattttgtagaaaaaaagacaatagaaaagttccggtatatatatcttggattgtggaataaataagctccagtacatatgttgaatgtctgaacatgtattatctagctggatttgattagataagataccacgaaggctcatagtaagagcacatcttgccacttcttacaccaaaaccaaacaacttcaaagagtaaaaacttatttgatagaacttgttcagctgttccaattgaacaacaaatacagatgcaattagtactatatttattacaaaacaacttcttaaatctccataagagttgaggttaccataaaatcaagtcgcaatcgcctttttttcaatttttgtccacaaaagattactttttatatatattacagtattttttttactcgatggctattacacagacttagttcttccatagttcagtaattactcgattaggcccaaaaacaataacaaaaagaaacacctccaccattctttgcacgtttttgcctatctccaatcaagaaatctcatactcccaagaaatttttaaacccagctcatcatctaacacatcaagctctcagaacgaaaaaaaaaactcatgccagaaacagcccacctccatcatcagagctccagttctaaccgggccagaaattaacaaacacagaaatacacataccaaaaaaggtgttaagccctgaagcccccctatactactaagcaagagcagtaaagggaggagaagacgactcaccgcactccctccgcagcgaaaagccgcttcttcgccggtcccgaccgccgctgtgctcgagagccaccggaacccaggattggggatccgatcaaaccgccgtggtaaagaacctgacaaatccaagaggagagagatagagaggaggaagaagacggaaatggagtggtgaggcggagggcggggaggtgtatgtacaactacagagagaggacgaggaggaggaggagtcaagtcaacccgagggcgagcggggcgacggcgacggcgacggatggtgtggcagcgggtggaggaggggggaggatgtggacggtcaatggaaaggacgggactgaataaaagggaacgggaacggatgccgtgctgccggggtctcccgttgaaagggccgctgaccgttccgttcccgttcctgttctgacggccggcggccttctcttccgttctttctttcttttttttttccccttttttcttgcagttgcagccttccacagttgcactgcactgcagctcgtttgttgcgggttgcggcgacctgtggaatggtgagacgggagagaggagagcgtgctttcgtacagggtacagcacttggcttgcgctgacggctgaccgtgactgcttttagcatggctagactttctgtagactgcaggtgtataaaccaaactagcttttcaaacggatgattatcctagattatttatcgtttataaaataaattaaatataaaaaataaatttagcaaattagtactaagacctggtttagttcccaactttttcttcaaactttcaaatttttcatcacatcgaaactttcatacacataaactttcagtttttccgtcacatcattccattttcaatcaaacttctaattttaatatgaactaaacacaccctaactcagagcaagttgaaagtgctccaagaaacttatcgaagtattatattgaaattttgactatttatctttttaaaatactttctaaactgataaatagatgctcccttattgaagtgtatcgggtacatattaaacataagtatttaagtttcgttcgttataatctaaacatttaaaaattactaaaggtcaaaattacaacaatttttaatcgatggtgataattatatagtaatagagggagtataagaaaacatatttctagaaacgtagagcagattatatgaagtaaacagaaaagaattgtgacacgagagaacgacgagggacatcatttacgctacgagggacaatgacacaatgtgcccctttttttttctggacgaatgaattctacaggaatttcgcacgggttgaattttagtctctgtaaaattcttacttttcagagtagagtatcggttccgtagaattctaaatctgaaaaagataaatggtgtcgcgttgaagattactacgtacgtgtataaactatcactccacgtcgatcgcgcgttcattccattccacacaagaaccactctactccagctgaacctggtaccactgcacggagccgacctcgccgtcgatctccagctcgcagacggaccggacgaggtacgacacggcgtcgtcgacggtgtcgaacctcgcgaggtccggcggcagctcgccgccgggccaccgctccagccaccccctcagcctgccctccagctcctccttgctcacgaactcctcctcctcccctggctccatcagcacgtacgtctccgactggatgtccgccctcctccgccgagccgcgcagacgaccaccacctgaaacacacacgcacacacacacaaaaaccaagcagttcgccggtgagatcgatgagcccccacgctgaccgctacggtggttcaccggccggcggccggtagccgcagtgagactgacgactttacctggatcacgtggcgactgaaaatgatgcgagagcctgcaaatgctgcgattttctgctggcgatgcgcgcagcagcagagcgtagtgtctcgcgatcgcctcttgtggggtagaggcgctgaacttttgcctgtattggaaggaacaagcttttgacactgaaattattttgcctgtattggagggaacaagcttttgacactgaaaattgcaagatttcggtagtggtaggcagtgcaggcgactgaactgaaggagtagtagcagcaactgtaacagcaagacgcttttgactgttggtggaaaagctcgggagcatttgatatggaagtcgttatcaaaaataataaaagaagacatgggagttgattttttttttcttttcaaaaggttgttcgattcaaagatagactgatgcatggggcgccggtgctaaagttggggagaaaagagcaagctttttccaagatatttcagtatttactattataccgtgaggtgtgtacccatgatatttttcagtaagagtttttagtagtagtagtagtagtagtagtttggtaaagactctaggactgaactttagttagtggttgctgttccaaattccaagacatgtagtttatgcagtcatgttctacttgaactgcaggactggagcatattggttttgtttagctagattgtcctggtcaaagggggtgtgagaaagaaaagaaatattggctgcacttggcacgttatccttcaaagtcgtcgtccctagaactcaatattctattgccatgaacatattccttctctagaagttgattagatgaccaattcaagatactaataaaaaaaattctcagaaatcttatcacctaacactggagctcacagcacaatctactaatctagtactatcaaactgacccgggtcacaacgaagaagatcaaagtgttgcatcatggcattctcgtagcttttgacagaggacaggagtgggtagagctgcggttacctgtcaaaagttcgccggtggaggcagccgccgccgcttccatccttcctctgctcaagttgtgtggcctgaaatcttcccttcaaaagctttagctgaatgccttatccttcatggctcttctttactcactaccatctgcattgagattggtgagttgtaccagttatcaaaaggagaagacttggttcccttccagtgagaacagaaagggacttgaaatgcgactaccgaccacacatcggctgcctgatcactccggtctccgccactgcacaagtggcagaccggagacgactatttattatagcagaggtcagctgtgttcactgtcattactgatttccagtttgcatttcaactctcaataccaattccaacttcctgttgttgcttttcacatctgcactggtaggtatgcacacatcctgagttcctgacaacttgtccaaacagctccatctcaatgtacccatcaatgaactttgtttcaaggaactaatcagatacaactgttttaaagacaattattacaactgtagaaatttctccccgcaattcagggatttatagttatagaggtgtctacaatccgttctaactgctagccaccagaaaacaagtatttttttctttttttttttgttctgtaacattcaaggtcacccttgatcactaatgcgtgtatataagcatgtcgattaacggaaaaatggaaaacatgatcagaaaccttcatattgggagatcatttgagcaatttttactaggaggctgtttgcagtttcatccttcgcatgtggagctaccagttcctggtaacggtgcagggatccagtgaaatcagtgaacaatccatcgacccccatgctgtttatccagaaatcatactcagcataagggtcctgatggaagttgaggtgcaggaattggttctcgttcctgtatgtgtacgggtgtacctgcaatgacagcaagagtttaattatctagatacaaaattacctgccaattttgtcatgaagtatgcatgttatgggccaacaaaaggcaacataannnnnnnnnnnnnnnnnnnnnnnnnnnnnnnnntacagcagaaagttaatgcaccttaatgatgtacaaagagtcatgtgaaatttaaagacatgctatgcattttgttcaaatcattcagttactcaatgtgcaatactcattgcatgacacatgagaccaaaaagtggacaatgacgataatgtttccattcttctcgttattcaaatcaaccgtaatagatttaaacataaaatatgctgaaggtgttatgaaccctgaagtatggaaattaatgcataaaacttatcgcatcttgtacggattatatcacaagtaggcaatagctcatggaaacatgctattccaggtaactgtaaagaatataaacaaataccatacctgaagattatgagcatgtgctcttgcaacaagatcagtcggtgccatcgtatagtttttggctgctggaacaaccgtatctttccatggaccaaggccaacaacatagttactaatatatgctaggtagtcatcagaagtgatgtcccagtatgactgcatcagaaaaaaacatatgttatatgcattcagatgtagattatccagccagattcattatatttttgtaacattgaaaccaatggatatcaaccttttccagaataaagaaagaagtcaatggatatgaaacattttattaacaagattagtacctggtttgtatcttgtgttctcactgagaaatcgtcaatcaggaatatcttgggagagtctgtcaactttgatgcatgtacaagggaagtaggagcaaaagattgtataaacaacggctgcttcagccaattttctgacatatattggcctttatatccatacttcagtaaggtatccacaaatttgtcctcaaacttcttcccaccatcccacttgacctatcaagagtagaatacaaaattcctcacttatggcacatccgaaactggaaatttgttatgaataaagtttttttttgtgaattgtaaaccttatctaaaccaaattaaagtattttgaggtaaaaggcatatcagctgctgctgcgtcattattcacatgcaatatatattcttgcagacagaaaaatagcattaaatattaactcaagatttatgacaaaaagaaattcttgacagaactaaaacatgttttcttttgctgttcatgtgtaaaacactatgtttgttcctttggttttcttgcaaagccgggtaatgcaattacctattctcttaaaaataacagaactaaaacatgaaattcaaagcaatacattaaagtccacatgattcatattataattatttgattaacctgcaaaggtatgcagctagacatattaaaatcatttcacagaaaatttctgcataacatgtaagcacaaatttgtgctggaaaacacttgacaatgatgtgaattttaaatgttgcttcttgaggatgggggaccttacatgcttgttgataaaaactggatctttcatctctgggtatattccgacagttctgcttgcatccaaggcaatagaaatgaattcttcaaatgtgataattgaaaacttgcctgcaccatcagatagaaaaaaaatagtgttaatcctttattcacaattatatgccaccagaatgtgcactcttacaaacattggcagttaacttccacatctgtagaaagactggtaaagatgaagcccagcagtatcgcattatcaataaaaagaatgcacgtgaatgatctttaaaattataacaacatgacctatagaagagagtaatgatattgtgtctgacaatcatgataatacaaagagatacaaaagaaaaaagatactcaaagggtatatgaccgcataccattgtattgttggtctctgaatgggtatcgctgattgactttcagtgttttaagttcctcaagtgtgaagtccactgcatatcaacacatgtatatttaggatgaataatcaaaaagatatagcttcacaggtttatcatcctcatcagtcccaccctagcaatatgcagtttaaaaacatatatcaaccagtataacctttaactaatttagaaaaaggaaaggatatgacaaacataaaataaagggagaaaaagtaagtggaagaaataaatatggatatattctcccttgtgaatcacaaagataagatgatatacatgtttcctatgccaatcatgctactccctagttgtcattctaactttgtcctaagtcaaacacttctatctttgaccatcaaattttagaaattcaactagtttaacaacaaataaattatatatgaaaatatttctcatggtggatctaaaaacacaaatcttacgatgttaaacttacaaatttttagaaattgatgatcaaagatacaaatgtttgacttaggacaaagctaaaagcctaaaacgacaagtaattttaaaatggagggagtagcaaacaccagatagtttatggcattatctgaaaatggcacaataccagttgctaatgcaggcataacactacaggtaatgattttaagaaaatcttgcatgcactactttcaactgtaataagttcaagctaaggtctcaagaaataatcaaatggcatgcacaattagttcctatttctgacttttgatgctgcaaacatttacaagaacgagggatggaattaggtttggttgtaatgtgcaaacctacaaaccagccagtagcgttgaaccattccacctcgtaggttcttcttctattggaaaactccttgcggctggcaacgtcagttgtagcatccagtgttacatcatgaaagcagatcaaggccccatctttgctagcaaggatgtccgtttctataaaatccgcaccttcttcaatagccctctgcgaaagataaatattatttagtgctctattatttatatggtcctattctttttccaatggtgaaatattgcaggatagaaacatattggaatcaaatccaataaatttgcaatcgtaaacataggctattgcattccatgcaaatagaatagcatgaagtgttttgtattactaaatgcctatacttctgctatgaataaaaatgaagcaacatggcctaatattgttcaaaacaaataatgcttttttttatatatgcaccattcaaatgtttgtaacgacgaataattgaaattgttcacacaattataattgtaaaattagcttgtatacatagtgtgaaaatttagtcatcttagacctcttgtgttatattgtgaagaccaaacaaaagatagcaatatgttgatttttgaaggactatcaagtaatattgaagaactaggaagttcatagaaaatggatgcggaagaagtggggtatctgattcaccgccaccattgtcttcttttaaaaaggagtacatgtagcatatctctgagttgtaccaggtaagcagcagctgtttcctcaggaatttccccatttgagccacggtgagcaatgttatatggtcgaaaagtttgtaagggtctcttctctattccattactcttgcttggtagtggaaagagtggtctagaaaaaaccacatgtggaagtagcaaaagaagaaaatagatagtacctgccaatgatgacaagacaaataaatacaggaccaagctcatgtgcagaatgcaaatacaaacatattaaaaaggtcaacacaataagactataaattcaactaattcccaaacttttcattagtaaccatgtttggttatctcaggaatatttttcaatgtgtatatgtgataccatgccttaacatgttataagaaagttatctggtcaaagcagagattctatccaggaaaaggtaagtgttctcaatttaccatcagtgataagtacaaaagtcacagagtcctctgaataccagtaattaaattgttaaccatttaattttgttttaagggatcgtgtactgcagaaacctgaactcaaggttaaaaatggatagattcagacacattaccaaatataactttttaagacaaatactcctacaaaaatagcttacagcgcaaagatgtcatcatctgctcacgaatatggtctattgctggaaacaagtgctgcagtaatcgtatggttttcaggttggatgctacatggagaatataagatgaactagaaaattattgagctgctctcactggtttctgtttcttcattatatatctaagaacaattgtacgtgcacatccaggctatgaatacggccaatgaaagatttcttttttggacaaaggaaaaggaaagattcctttttgtccaaaagaagaaaaatcatcgccttttattttgtgtcaatttccatgctattgcattgtgggcctgtttagatcccctggcaaaattttttaccctgtcacattgaatgtttggacacatgcatggagtattaaatataaacgaaaaaaataactaattacacagattgcgtgtaaattgcgagacgaatcttttaagcctaattgctccatgatttgacaatgtggtgctacagtaaacatttgctaatgacggattacttaagcttaataaattcgtctcgcagtttacaagcggaatctgtaatttgttttgttattagactacgtttaatacttcaaatgtgtgtctgtatatccgatgtgacacgccaaaactttacacccatggatctaaacaccccctgtgttccaagattagaattcatgggactgaatctgaaagtttctaatactcattcggaacaacatacgtcacacctaagttgttctctactcccttatcccacaaaaactcaacctagtactagataatgtaggagcacatatcaaatgacaaaattagataacaactaacaactctataagaatttcccgcctccagggctccagtataaaaatagcagaatgttggtcaaatttgcctaaccaagccatcatttactcagttccatggcaaacaattgctaatatattggtctagttagaccgatcaatccacaattccacttgtaggagcagctgcgctaaatatagaagatatctcaactccatgttactatattcctttcacctagtcataaccaaaaataaataaatattcacacccggaaaagtactagtagtagtctactactccgtaccaacttgatcggatcaactggcacagagatacagaatcactcgtaagttcgtagtagtagtctactactccgtaccaacttaagtcgtaagagctaccgctaagcaattcagaagcaagttcgttggttactacagctcacttttgcataatttcacggttcttgcctcaacaaacagcaaccattgcctctaactccgtgtcaagaagacaaacaacccacctgaagaagcgccattcttgtgccaggcctttcgaatgcaacagatcgaaagatttcacaaccaatcgcaaatgcaaaatcacccaaggggccggcaaaatgaccaaaagagagagacgatctgtttccggtgaatcggagaaaaccggcggatcgatcggggaggagagagaggaggggacacttacggagcgaaggccgcatgctgccgcccgctgcttcggtgctccctctccctctcgatctctcgtccctctcggcctctcctctccacttcgctccccgcaccagcgagagctcgaggaggagggggagaacgagaaggcctgggggagcttggcttcaatggagaagaagacggcgcagcggcggattctcctctccactcctgcttttttttttcttttcgtcacgccattatttcctcacccttaccaagcacgctacgctatcccaaccaataatgaccttccacgacacggtagcgacacctacccgtcactgacatgtagggacacacctccgcgatgctgggacatggacccacctgtccgcgacactggaggcgttccgcttgttatacctggttccagccttgtggacggaatattcgtgggattacggcgggttttccgaggattttggatgggcgaacaatattcgtgctatacgctggctgacatgttggatagagcgatggccgttgccggtgctcgttttacatgcggaagggattagtttctttttttttttagggaaaccgaaactttatataactgatccagctaaatcactggtcaccagtcgttccatcccagtgctgtggctatcagaacggcaaaggagaagggtatggcgcgagttgaactggaaacagattccctgatgctgtgcaatgcactccagagtaactctttcaacttatcagtgatgggtggagtaatccttgagatcaagcatgtgattgctagctgtttttattctttctctattaattactgcccacgaaactgtaataaggtagcgcatgaattagctgctttgggttgtaaccttcaggacgtttcctcctggaaaggattagtttctaagatcaaagaacaaacacggtctcggtggtgttcatttcgacaggagagatggacaataataagctagatgatggaaaagaaatataaagtaaaaaaggaaactttttaagaaatttcggtaataatccataaacttagaccgagacatccatagacttataaaatatacaactaaatccctaatcttgatttaatatgtcacatgtggtccatcataaatagtcactttatgatggtcagaattttgtatttaggtctctccactgcaatatggcatttccagatccactctccgatttacatcccagttaaagtttatggaacgaccatgtattttatttgaaatataattatattcatgaaaacattaacaataagttttattatataaatcaaattctatttaaagcttattggtcttataaaatttcttatagctatttttgttgaacccacgcagattcgagggctcatttgatttgaagaaaattcatgggaatttcaaatgatagcaattcatatgaattatcgctatatatgttctttttaacaaaggattgcagcattccaaattcttttttttaactcataaagttttattgcatataaacagagtacatgggagggaacgacattccctgaaacatcgttttgcaagaaattgacaacaacaaacgttaaggaccatcttcctgaaagaaggtaaagattgaatgattaatgattgaatgaaggagcattcaaaattcctttgagatcaataggaaaaaagcacatgaactcaatcatctttttatcatttctttgagaagtccaatgcaacttttcccgtctctcttctctattaaagcacatccaaaatcctttgttatttttatgtgaaccatccaaacacgttactttttgaattcatgtgttttacgtttctatagaactagttgataccccgtgtttttgtcgcggaatatgtgaataaatgcatgttatacattataaaaataatatacgtatgaaaaatgatgtggggataatgatttgacattgattgcggtctcgttattttctccaacaagagttggatgaagattaagattttcgtggcacgttttccaaactgctaaacagtgcgtttcaagcgaaaactttctatatgaaagttgctctaaaatatcatattaatttatttttcaagtttataataattacgaagtaaaactcaataattatacgttaatatcacatcgttttgcctaaaaaaacttaatattcatctccatcttcaggagaaaaagaacaccacctgcatattgagttctaaaaacacaataagattgtaaatgttatgtcatatttgtatgatatttaaaatactcataataattgctagtgaatgatgatgtggcacacttgcatgtgatttaaaatactctagtgaagtgggtgatgatgtgacacacttgcatgttgagcgttagtggacatcaactttatagtaaaatataattcgcacctacgtgatatcctaacttcttctcattcttatggatcaatattttcgctttatgcttatgcttactagtcaaaatttgaattttcaatattaaatttagagttgatttgtttttttatcgaagtttattttttagcctttgcttttaaatcgctaagaacatatatataaaagttttatttacaaactatttttagtttgcaaatatgcagtttcgcttatccccaaataagcgaaatgttggggcctttatatttttgcaaaaaaaaacgcgagtgaatttcatgaacgattatgctttttcttcttgagcctttctacatcgatcagacggtccagaacgcgccacgtagcgcatcgaagagatccagcatcttctccacctcgctgtatccatcggccgcgttcttcgcatcggtcgatctccctcctctcctcctccgtcgcgccgcagacgccaaccccgatcccgatggccgcctccgcctccgccgccggcgccggcgccggcaagtcgctgttccagaccttccgcaagttcttcaagaagccgtgggagatcaccggcccgtgcgcctcccccgagtaccgcagcgcgctcccgggcgccctggagtaccgccaccgctgcccggccaccctgacgaaggacacgatggccgtcgtgcccacctccgagcccgagaccgtctacgacatcaagtactacacgcgcgaccgccgccgtgaccgcccgcccgtccgccgcaccctcctccgcaagcccgacctcgagcgctacatggccgccaagcagttcgaccccgccaaggacttccccgtgccttacgtgaacaccgccgtggaggaggactacgacgccgtcggcggcggctaccagaagtgatggtcgaggtgaggaaatcctttgctactttacctttctagatctaggattggacggacctagggttccgtatctcctcgttgtgttgccaaatttgccatacgaaaacagttgtgcgaaacgttaccatacaggcatacggtttcaatctccccgttgaatccatttgttttcctttatgattgaggatatgatttagatgcatgtagactggaacgaaaatgctgtgaaatgaactattgctagattgcaaaacagttactcaaatgtagcggctcttgaatttgcttgcaaaacagtgagaatcgtaataaaatcagaatgaatgattctgccgctgattttgaattctaacattttgattttattaggattttaattttatgggctttcattgtcaatttattatcttgttctcttttcatgattgctaagatgacaagtaaaaaatctacctaaaattattcttaaaattcaaaatcactttgcattagtccgtagcagaaacaagaagagccaccaaatgctgaccttgttactttgcctattgtttttatctttggactggatttggtggaatcttcttttgagtttttgatgcgtatagcgccttcaaatgttgttactacctctggatggaataatttgtcatttcagacagtgaaaatgacttgcacttagtagtatttggctgtctgaaatcctgacaggagggagtatgactaactagtcaattctcaatgacatctcaattaaaatgagacttatctgtcgggttgttctattttgtcggatattagtacagaataccagttctttgctagaaatacaactccctgcattctgaatatagtagcaactttttctttcattttgtgatctcatttggttagcttctttagagattatattgatacaaatttgatctagagataaaaattaaaattggtttcatattcatcagcttattttggaagtattttgttttcctcttaactgatagcaacaacatcagatgtctgcttgcaatagctagtgtttgcaaagtgcaacgatctgtgttcttaggccctgtttgtttcagcttaagattattgtaatctagattattgagccagattactataagctggattataataagccgacatagaataagctgttagctgtttgtttctctagattatttgctgtttgttagctgttagcaacccaataatctaaaaaaagcacctttagagtggattactagattatagtaatctggcttatagattgtaataatctattaaaataagctatctgtttgtttcagcttactactaataatccagattataataatcctaagctaaatcaaacagtgccttagtgtagctgccgcttagctaatatgaatcaggcacagtgcactcaacttaatttggccatttgacctgactcaagggttcactcacattctgctggacgcaacagagccacagaggtgtgtgccgcagcaggaaaaaaaaattctataaagatgtacacctgtgagtccataccacatacaatgtgttctcatagaagtttctttccctatcaaaagctttgcggtgctgctgctctattttcatggttaggccttgtaatgtgaggtctggtttaggttcttccctctagttgcagatgcaagcatatattttattctaaatttcaattgatctttttttacaataaaacaatagttagtcaccaaatattccgggtaagaaatggatcacttcccgctattgagttctatgacttctatcatctatgcacgatcaacattataaggaaatatatgccattgctagctaaaattgaaaagaatttccaatagctaaaattgaaaagaatttccaacttattgggatttatggacgattaaaccgattaaattaatattcaattatgagccattgctagctaaactttgtaagtattataattttgaggctaacacggtgaagataggtacctgaaatgactctggtttagaatgattggaccagggctattgtgttgcctgagctggttaggacttaggattggttatggaatttgtacttattgcggtgacatgttgtgatgtttgcgagcagggggccctagactagaagggcataggcgtgctcgacgggagggcgaggctgctcacctcgccgcctggagccgtgatggtggcgtcaagctagggttagtgatggtggtgatgggtaccgtcgagcaggtggtagaacgccagccacactttctcttccttcagcgtacacggccccctgtaaaattgctcgcagcggttgagaaaatgaatcgggtcacccttacgatcgaactttggaaagtcaagcttgtggtagcatggagggcggtcgccgtggcatccctcacctccgtgccccagggtgaagctgtcgctatctgcgtcacagccaccgtggtgtggagcgttgtcgttgccagcccgttccaggcgctggattgcgacgtggtgcgcttgttgttggttgttgaggtctgagatctggccgtggatggcattgaggcgttcgatcaccgcagcaagtcctgtcttccagtcgtcggccagcgacgttggtgacggtcgacatggcgcagcatcagcgagcatgaccgtggtctctagataccaagatgttgcgagcaggaggaggccctagactacgaaaggcgtaggcatgctcagggggaggtcaaggctgctcacctcaccgccctggagccgtgatggtggtgtcgagctagggttagagatatttcttggcttgctttattgattgaatgaactgcccatatataggcttacaaattgaactaatctgctgattgaagggaaatactaactactaacaactcatatctttaactaactaaaaacctaatttgattgcaagccgtaacaaccttcctacacgcattctgcttcttatccttccaccttcactgcttctgccacaggctgcctccgttgcatatacatacgttccaccataacatgtgacctggggtagattttttaaaatgcattaacaaaaatgtttatccactattttcttgtaaaatcacgtttctaagagggaaaaagttttcttgtatagagaaaactcagttgcatttgggtcactattatccagaccttcccttacagctgcttggctattgtagttttgagtgttgatactatgttgtacaacatatcatgcattaaagaataaagagaatgctgccttatattttctggctaggaagttttagataaccttgccatacaactaagaacccatgttgcctctttgtgcatggaagttcgacattttaaactgcccctaactgatttattttgtatgactaattcagtatcccatgtggactacaagttttctgttgcatttctgacttgtccagaagtactgacgctctccggtgctttgcagtatctgtttcacactgtatttataatctgacagctttcatgaaaataatcctcccagtgcctgtcctttttgtttgtccaacaagtgcattgcaaccccaattagtagcatctatttctgactctgtcatgcattttgtgtggcaaattgtgtccaagttactcccctccagtcaatattagttgacgttgggagaactgagttacgtcaaatattttttactggaaggagtatatgctagtactccatttataggcacaggtgcactactacgtttagaattgcatatactatttagtcatctctagatttctggtaccttcagttcaaaatgagatgcagcacttgaagcgactaggtggggtttgtgacttttaactacctaattccagacgtgaatctgaattcttgcttaattatttctgtcttcatgaattatcattgtaaaaaaggataatgattcgaccattcatcttttttttcaggtatctacctttcttgtgcttgcacttcgtcagaagttgcattgtcttcatttgtgcccttgaaatccattttgtatttcagaggaaaaaaaatctggttgtaagagatgatggcggcaataatatgacacctgtggactttgctgaatgtatctttcttgtaagttgtatcctaaaacttggaactacctgatgctgatgctttggtagtatggttcaatgaaagatgaaatgtttccttctgtaatggccgcatcatctactcttactgcaaaattattttgactgaacgaatcgattgaaaggttctcttaggctgtgtttagttccatgctaaaattgaaagtttaaagaaattggaacgatgtgatggaaaagttggaagtttgtgtgtgtagaaaaattcgatgtgacggaaagttggaagtt

SEQ ID NO: 31183 - DNA, 39766 bp, Oryza sativa
atcatatcgttccaattttaaccaaatttttaattttggtgtgaactaaacacacccatagtatatcagtatggctaacaagttttggcatacgaaactttttacacggttggctcaatcgtggcgaagaacttgccacatgaccagctagcagcaactggtaggccattactgaacctgcacttcgtggaattgtgcagatagccgaaaaaaattctctgccggcatgtgctgaattgtgtgttcagattaatgaatccagttaggcttaactactactgatcaggataaaggtgtcaggggtctcactgatttcatgccagtaataaggctgtctagtttgactattgctgccaatgttgctttgtggaatggcatgtgcactcatggttggtgctggaaatgcaaactgtttgctgtttggtcttgttaatcagcccagcatgtggaagaacatgaccaccatgtactgtcttgatgttttcctcttggatctactcgtggcaatgattactgagcaaaggtgggaaccaacatgtgccttgatctttgcttctgcttgcttgtggcctttagatttgctgatccttgaaagatttcttgtgacgatagattctcgagaaagtgctccttgctaaaggtctcctttagaatgtactccctctgtttcatctatcccatttattctaatatttattttaaagtaagtttatttttatcatttatctaccatcgttcgcaaattgaggaatttgattccttcaatacctttatccatctaccaatactaattttctattaatgagaaatattttggtattttttccagaaaaaaaattaaatctcaattataagaaatgaactttatgtttggatagatgaagtagtaattttacatggttttcattatttcataggaattaaacttattcatgtgaaagtcctcttaaattcctcttgttccaactaagagatctaaacaggaccagaaactgctatcataatccattgaccgaccattttttttttgaagttcatcactggtccctaaatttgtaccgctgtgtcattccggtccctaaattcgcaaatcgaccgctcaggtcctcaaactcgttcaattgtgtcatcccggttcctaaacttgcagatcactcgtttaggtcctccaacttattcagttgtgtcaccccggtctctaaacttggatttaaatatcatctgggtcaaatagaatggtctaaagactttatatttaaaaataattcataactttttcatgttaactctaatgaagacaaactttatatcaaacttgtagccatcgacgcgatctacaactttatagttgatttttttatttcaagtcatttttgtcccaatatgtaattttaaaattaaaatttcaaaatctataaacatgcaacaatattttgggaccctaaacaattttaattcaaaaacttttcaattacaaagttgtaggtcgcgtcgagggctacaattttgatataaagtttgtcttcattagagttcacatgaaaaggttatgaattattttttatataaagtttttagaccgtcctgtttagagaccggtgtgacacaactgaataagttagaagacttaaacgagtgatctgcaagtttagggaccgggatgacacggttgaacaagtttgaggactaaacggtcgatttgcgagtttatggaccgggatgacacagtggtacaagtttagggaccagtgatagactttattcttttattttttttttgataaactggcagacgcatcatattttgcttggacttccgacttcttacatggacggatgcatatgcagagtacttctccggcaggctaaaaattgtcgctcgatctatgtacgcaaagcacgacgatgaagtagtcgctactggcatcgctgtctcgtggaaaatgtcagttgttttgtctacagatcgttacgcattaactcatggccactagcagtcaaacgaccctctcaaaaatgggctgacagaggcaaggggaccccctgggttaactttgtcacgttgcttctgcaacagtagtccacggtaccaccaccaccaccacgccaaaatttcttcgcattggaagcagaaatatcttcgctttccaggcttagctacgttttttcgtcgatcccctttgaaaaaccgatccgaacgtgtctgtctagtgtataccctcgagaccttgagtttcccgtttttacggagcacggtacagtggcgaggactacgaccgtgcaccagaaggaaaaagaaaaaggaaaaaaaaaactccgtccgtatcgtgtcatcagatgtgctgtcagcttcgtgcgcccttgacccatctgtagttaagcgtgtgccgcagctttcatgctttcattcaagcagcatgaatgaatgcactgcatgcagcaggcagcaacaacatcaaagaaaaagaccgcgcgcgatgacgtcgaaacgcacaggagatgcatgtgttgatgattggtactggagacggctgaactcttctcgtctggccaccggccgcggcccggcccgcgacacatgcatgcagtcagccacggtcacacacacacctgatcgacctgccgcctgccgtctgcccgtctgccgcgcgctgcttctctctccgtccgatggcgcgtgcagtgcgtcccattgccccctcgttaattttttttttcccgctcgtctcgcgcgcgctacaaacgcgaacggtcccacggcggcgcgcgtacaggcgtggttaattcgcgcatgcatgatttgtaccacagtttgacggttagcctttgcccatactcgctctatcccaaaacggcacaacctaatttaatcttaagacaattattttattcggattaggtgtactagaatagatcacatcttattttagattaggtaattttttttaagacgaagcgagtataattttctctcagatcgaggatcgagctgctccttttgctgctatgttagtactttgggttagagactactccctccgtcccagaaaataaacatttttagagttggacacaattattaagaaagtatgtagaagtgaatggtggagggttgtgattggttaaatagtggtggtaggtgggaaaagtgaatggtgaagatttgtgattggttgggaagagaatgttggtggagaagttgttatattttgggataaatcttgagggctaaaagttattatattttgggacagatagagtagctagagggttcacggtcgatctgattgtactccctccgtcccataaaaaaccaatctagtactggatgtgacatatcctaatactataaatctggacatacctctgtctagatttgttgtactataatgtgtcacatctagtcctagattcgttttttcggaacggagagagtacgtagttaaagggggaagaaaggcgttaggctgatatgtatatatgtatatgtatgccatgctctaagaagacgcatgggtaggtgtgcttttgtttcagaagtactccctccgtctaaagaaaccaacctcgtactacgacgtgattaggatgcgtcacattctaatactaaggttgtatttttttttttgcggaggaagtatatggttcgactaatttctgtgataaggtagatttatgagtgcgatctgatcaggcgcaatggtgcacacacagttgttgcatacacatatatgtgtacgatggatatgccatgtggtgctgatggcgattcgtgtctcgatcgatctgtgccagggcctgcattgtgccggccggccggctgcagcgacgaccatgcgatgcagggcagaataagcgcctttggagcatgcaacctaactccagcttgcaaaaagggcgtggcgacaaaccgctagcggagatcgaacatgcaacatgaatgatcatgcgcgggggccatttcattgtttgatcgtgcgtgcatgcgcgcggttgcgcttggaccggccggccgagcgcctcctccacccatcgatcgctttctctgcagattggaagcagactttatattaatttgtccctccagggacatcacatcgttttatatatggcgttcaaaaataataataaaaataaaatatttatcaagatatatcaatatatgatatatcttttcgcaaacatacgagttaaattttgacttatacaattcaaaacaaaaataatatgaccgtgaattacacgttctattcgtagtcaaatttattatttttatttctacttatataagttgaatttgaattttttatatttatgaagtgacatataacatattaatttatcctactatatttttttcaattttttttataacctaaaaatggcccaaccatcatcacgctcatcagctcatgcattgtcgctcgataggtgcagttgggagacagtagtagagattcaggggaattgaaacaacatttacaaacaaattaagtgcaaactctaaataatgagatctgctttaattaacgaactactccagtatttaaccgtatgacgtcatacagtcgactgtgctagcgatattttgctagcggtgcttccatatttagccatatgactttgtgcatagttagggcaacgctctaaacagttaatggaggtatgtattattcatgccacgttttcaaaattgcgctttttgggtcaaacaaaattcctacatccacatttgttatatttataatatttaggacctgttttagatccctggcaagttttatcaccatgtcacatcgaatatttaaacacatgcttgaagtattaaatatagacaaaaaaaactagttacacagattgcgtgtaaattacgagacgaatcttttaagcataattgcttcataatttgacaatatggtgctacagtaaatatttgctaatgagggattaattaggcttaataaattcgtctcgcagtttacatgcggattctgtaatttgttttgttattaggctacgtttaatactacaaatgtatgtccgtatatccgatatgacacggcaaaaattttcacccctggatccaaacacagccttaatctaatttacccgtatatgagtaactttcatccagtcataattaataaatcaattcccagttagaagaagttggtagaatagtcgatcttagggtaaatttaagataagctgaatctatcgtcatttctttactcatttggcattctaagattataacttaacaaacaactgtttgagataacctagctaattacttcctccgttttataatgtaagtctttctaacattgtttacattcaatatatatgtgtgtctaaattcattaacatccatatgaatgtggacaatgttagaaagtcttacattatgaaacagagggagtatatgatttcaaacggtaatgctacataacgttatctcattccaaggcatggaatgagatgctcttatgctctttcctccgcaaatgcgagggaggggcacgccttgccgctgcatggttcaaccagcgaaaccgcctaccgccaacactattgcctcttgctcctcttcctcctccgcagatcctcgccaccgtccccatctccgcatgcgcagtcgcctccctatgtccgcctagcaccgccaaacaacgagtaatacacaatgtgacgatgagcctgagcggcatcctctagagtctagacattacggagcaggacaccaaaatgccttgctacagttagagagcttaatttgccaatgacttgatgtcctcctcctcttccacttgaaagaagtttgcgatggacatggtagccatgagcctcctggattgattttgatttgagtcgatgtatttgctacatcctcttgcttctagaatcaatatacttttcctagattccgagacaactgtatgggtacgtacttgtcattgttgcaaaactgggctaagtatgcaaggtggctatatcttgattcatcatggggtagtgctctcttgagaatttacacctgattccgagtttccgacatgtattaggcttgatacacctaggtatcgatcggcctgttaccggatgatatcatttttgtactgatgggtatcacttggtacaaagagggggtatcagatcgatctggtaccggattggcgagtagtactattcaagatgctctagcagtcccctgattcaattatgcagttagcttgtggaaacactaccaaactctcctcttttaaacatgatcgatgaagattcacacgcattattatttttgaacagtattagagcatctgaagctctgaacatgtatggttcatcttcatccgtagcaaatgcatgcacaggagttcagctacttccttatttacaccgttcctagctgtttgaagctgcaaatccggggctggcctgtatagtactacacatatacaccacttggtgtccattaatgtcgaagcatgcgtggcccatttgtctccgaccatgcatgcatgggtactaaccgtgctagcagaggtagattaatggaaaggccagtatatatagcagagtgtgcgtacacatgatcagacagaatgaatgcgtggtcggtctcgacgctgcgtgtagttcctttcaaagttaaaaatttaggttgaaattggtatgatgtactgagactgaaaagttgtgtataacatgttgatgtgatggaaaaagttgaagttttgatctaaagacagccggagcttaatttgcatgctcttcgctgtcacactactacacgtacgacctcgctgaacaaccttagaactgcatgtgatgaatatctagcgagccatcatgccagtactgtgtaccgtagcctgaatatatgcatgcatgcatgcctgacgagctgagtgatcgatcgatggcagcacgttgctgacagcaagcatgcatagacgagatgcatgcatgtgtgatcgatcgaggcgctagctgccgcggtgatagcgtgcatacatgcatgcagtagtgcagagtgcatgatcgaggtactcactccgtttcaaaggccaatatgaacattttcaggatttaaactttattaccacataatagcattttctaacacctaagacattaattccaatatacaaggtgatataatcgagggaaaccaagcaaatcaaaatttaaaatttaaccattaagatgactaatatagtacattttaagctttacctacgctaaacaatatagaggtgtttatatttagaaacggagggagtataagcatttataggatatatataaattttgtaaatactattaagtatttttgaaacattaatttcaatgcacgggattctaagcattttttaactaacaaaatacaagtgttcttaggggtgtttatgagggaacttaggcaattcaattttctttaacgaatcagcacagaccgtgccaatttcattaaatatagagggagtaaaaatttatgtacacgaagtgaaaaaaatatgagttgtacaaagatatgctagggcatcatcaatgattaaggtcgctaaaggaataaggtgggaaccaatagtcttttcttgatcttgagctaggacccactgataaaaaaaactctattcagtagaaataaaagagcatcatacatgttgcaaaggcgtgaactatttttttttattttttatgatctaaccttaagcttaagattgcccatagcaatattccttgctttgctactctcctaataatgcataaaggtagaacaaaaatactactttattccttaaggttactttgcatccagtattagcctgcaacattatagatgccctatgactcttgctttatggtattagctgcgctagccgatctttacaccaacgagcacccaagttttcccttcttccttgattttggctagaagcgatagcataaacaacctcttttgctaaaaaaattctcttgtttcactctttccagatttttagcaaccttatcatgtttgtctttaaatttgttcaacgcggtgactgaatattttcctttatccttaatttttggcaacctaatgatgctttatgttttgaaacgttgggagtagtagctactccctctgatcccataaaaaaccaaactaatatcggatgtgacacattctaatactacgaacttaaatatacatatgttcagatttatcgtactataatatgtcacatccgattctagattcgttttttataggacagatggagtacgtagcatgcaggatgcagccaagagaacccatccgtggccatcgctagatctatccattaatccatgcatggatcgatcgatcgattgtgcagaggctgcagacatgcgtacgatggcagaaggacacccaaattaattaagctcgcgcgcgcgatcgatcgacgatcgatcgctatagctactagctatgtggatgagagcagaaatcgataattaattatgacaattactactgggccggggacgaacagacacagagaaccacgcatatttgcagctcgatcgatcacactgatctgcatctgcatcgatcgcgatcaatcgatcgatcggcggacggcgtactgccacctgctgctgatcgaactgctgatatatgcgaggccattgcgcctacgtaccgcgacgcatcttatgcgttgtctaggctggtctcagctcaaatggggcgggagctactgtcttggcctcaggccctcagctgaaatggggcgggagctactgctagctgtgagggtagtagcttgattgctgctacggatagttcagatgatattgagactggcagccatgcatgctgctgctctgctccctgcatgcatgcccaagggctgcatacccctgcatgcctggccggcctgtatacatcgatctatccatatactacatgcatttccatttcagcttggtttccaggggcagcaggcaggagagggaggctgctggctgctgctgcagctagcgccactgcactgcacacacaaacttaaaggtggcctttcattcattgcccctcgctagtggccgctgtccccaacactgctcctctgcctgcctccatcctccccccccccccccaccacacacacccaaccacaggaccacctcttcgatctctctccctcctttttcagctgcaccagctgcaactctctcctctctctctctctcaccgagctgcattgccgcagtggtcactgctcagatcagagcggtgaagcatgcaattactggctgactagctagctgctgaaacgagctcaaaaggaaagagctgagctgagccgggcgcgcgggcgaggcagcatatgcatgcatgttttgtatgatgggcaatgaaacactgcaggggcaggcactagctacttgcttgactgtgcctgctcacaggcagctagctgtgcgagcctgcatgtcttctagtgtgcctcagcgaggaacagagatatggatattactcgtaaagagattggtcctagaaacagatcgatctgcatgcatgcctttcaaaccccaaaacaattgtttgcttgggttgcaaccatatggtggaaagctgtcatatatgctagtattgctcatgtatgtttttctcacatttgcagcaggatatcgcaggtgtttccatggccaatttctgtgtgtttcctacagcaattatggacttacagcaggtgtacatgtgcgtgacccagttcttttttaattccatcaccaccgccctcttcttatattcattcatccattaattcctgtgcttgctatccattggggaccttcagttagtttgggccctctgaatgagttgtcccaaggaacaatctataatgatgttctgatgactgccactgcatgttgtggtgtgtgtttgtcgccttgatgtgtctgtgcatgctagtagtagtagtatattgcaataaaccttttgcacacaagaaaggggagaatgctctgaggcgagacatggatgatactcctaccgaggaggatcatattcataggttttgtgcggtgcagtgcgtgctagcgcctgctgcaagcaggcatgtatcaagattcaagatatggcatgcaagatgctttgcacttttttactgtatctgggatgatactatatactcgtactatgcatgatcgattctcgcatcgcatgcatgcatgagcatgactttgccaatgggatgtcagtgatatatgcatggctagctcatcgcttctgggtattatgttgcagtgatgcagccttgcttgcacggcccaatgcaacggaaagatcagaatatactctctccatcctaaaagaatttctatcctggctatgaatctgaacacacaatatgtctaggtttctaagttaagattgattttttattggatatatcattgatctcctttcacatactcctacctactcctgaacaggcacaattaaaaatggtgagaaagaaagggcaagatcgcaagaggaaatgtcaattaactaaataaataaatatataatcatcagtgtcatattgtgtgtgtatgtgtgtaagaggaagataagggggagccgtggaggcacaggtgagaactgagaactatgctcgatctttgagaacgtgagaaacattgcaaatgatacactgctgattctgatgggtatcatcgtcactgggtggtagctactattcatatggccaccgtataaagcagctagctagggaacattgttctgatttatgacatgcaccagctagctagctagactgatatttactccatccatatatgttttcttcatccatcctaagatataaagctgctccctctatccgtgaatataagagattatactttttttttaagaattaaggaagtaagaaaatgacatgtgatgagataaaatgtgatgtgtgaaagaataaagtagtactctctccgtcctttaatataaaatcccttatattatgggacggagggagtataaaaattagtaggtgggagaataaattagtataaaagtagatggtagatgaataaattagtacaaaagttggagaacatgatgctgtcttggaattctaaaaccccttatattttggaacaaatttgataaaaaaatctcttatattcatgtatggagggagtatacctctgcagctcaatatacatatatatttcgtaagtacatataacatctctctaaaagtgttatatataaaagtttgatttattttaaataaagcaataataatattgtacgcttattgaggatacattcaaaattcatccttttgtgtcgaaatgacttcaattatatttactcctccgcttcatattatttattgttttagctttgtcctaagtcaaatattcctaagtactttagctatatattaattttagatattcatatagtttataatatatgaattatttatgtaatgaaagtatttatcatggtgaacctaaaacaatactaaattttataaatgttaaagtatataattttctaaaaaaaggtcaaagttagtaatatttggcatatataacaaagctaaaaacaacaaataatttgaaacggatggcataaagtattttaaaggcaaattattgggtaattaaaaatagtttgacttaacataacgggagagatattaattagtaattaggatagcttgagccagcattatgtatttgatactgctaattagctagagcaatgaacaatcaaaatcaaacaactgaactgacctattgctgacagttttctgtgagcatgagaagatgatactaatcccaaatccttttccttttcatagaaatgatcttatctgattatttctcccttttttgggtccaaatttatgtctttactgaggataaaagtaggtgtggtcctgctagctactagttgatgctcaaaagatggatggtccctagactaaactagcctcctagatttcgatgttgaaagatttgtaaaggtactgtattttagtgggaagaagaatattattcaacaatctaacaaaattcaaaatcaagtatacatactacctgccactaaatgttgatttttttagagaagggtatttatacccagcctctaaatccaaccggatatatgcagcctttttaatttagaaacttagccctcaaataatccaatctaaaatttgcttctacgaaaatttgaactcagcatcttgaagtgctacttagttcactgcaaccactagattacgtgccctttcacaccaaatgttttgatatataacatctaaggatcttcctttttgcaaacaactctcatcagctttcaagaccatactaattcaaagaaaaacaattaaaattccagctgatatagctatactcatggaacactaaaaactctttaattagttcaacctaattaattcaccagacgaagttagtgtaatccgaggaatagaaggtgttctatgaaattaagaagcatatctaggcattggcatccttgtatcttgctaatctaaccccatgttaatgctagtagcactttgatttgttgtccactgcacacagggggtgctagttgattaattaggtcaagcgtagtttatttcatcgtttgtttgatggcttatatatcaaccgcaacaaaatttaaattttaaaaattatttttaagttgatttaagttttttttactatagtttattttccagcgttgtctttaaattgttaattaggaaagttataaagagttttccctcaaaataatagttataaagagttttctcttaaaaaatagttataaatagttttatctataaactattttttattgcctagtcatagatcgagcaaacgatgcatgagaggtttagccaggtcaagtgtacatatgtaaatttaggaaagcatgtatatgcccgtatatacactccgctaacatatggcattgagcttaatgagcttatcagctcgccaggtcagctccgatcctctgctggccaaattgccaatatacgatctatacgatcgatcgatcagggagagtgaagtgagccgggggagcaacaagggagagagcatatggtggtaaaaggacagtgacgcgacagcgacgacgctgatcatttattcctcagtgtaaatacccaccacaaagcttcacaggtcgtcttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtaagtgtttctctctctgaatacatctggagccggtttgggtgtttgatttgttaattcttggcgattattctatggatttggggatcacaaaattatgtgtgtgtgtgccttttgagagtttttaatctccccagctttccgtggtccttgattaggattttatgctgtggatctgagcccagatttgttaattcttcttcaattattttctgtgagactgtacaattccctcttggatttctttcgtacctgagttccatttctttttccatggaaggtttcttctctgaacctgcagtactgggtcgccaaccaaataatctttgtttcaattgcaccggatcgcctctctctgatccttttgcttccggaacgacctggttgatcgatctgtcaatttaattatccattttgcccactgctcttcatttttttcctttttttttcctgaatatagtgttcagttctaggaatccccaactgagtaaattaatcctctgtcaagcctccaaaaaatttcacctttttcgctcgccacacaaatttcctccctcgatcgattggtttcaaagagcacaatttaaaagctaatgactgctacagttaaagactgggtgcatgctgcaggccctgcaggattagctagctagcaaaagctattcgtctcggcataaaggctagcactcaatacaaaccccccgacccagccttctcctgttcctcattcccatgggcaaatagtgatcctttgtacgatccaattcatagctcttcttcccaccggcgagacgaatcatgcatggctgctcgattcaatcatggaatcatatcattcccacacatagtgccactgctgatggctcgcatgcagctcacccagctagagctgcaagcgcagcagggaagagccggtctttcgatctcgatctcgctactagctactacctaggtagatcgattgataggagtagagatatagctagctgttgctcgcaaatacgcagcgaataaagctggctcgctttccccattccccaatggaacagtgacacaagcagagagagagagagagagagagagagagataatccgtcgagatcgggtggtagacccttccgtgcacaggagagatttatttaccccgggttaattactagtagtgctggttgattatggcgcgaaattttatgctaatcagtctgcatgcgatgttactcctaattaattaggtgttgttgtgtgtgtaatgattgggtagctagctagctaggtggatcgaggactgacgatgggaggatgagctcgaggaggcgttgataaggatgatactaggaagcaaccaagcggccgccgccgcggctgcggcagctgcggcggaggaggaggcggcggagctagcgaggaagcacacggcggcggtggcgacgtcgcggcaatggtcggcgcagacggagtcgcggatcgtgcgcgtgtcgcgggtgttcggcggcaaggaccggcacagcaaggtgaagacggtgaaggggctgcgcgaccggcgggtgcggctgtcggtgccgacggcgatccagctgtacgacctgcaggaccggctggggctcaaccagcccagcaaggtggtggactggctgctcaacgcggcgcgccacgagatcgacaagctgccgccgctgcagttcccgccgcaggaccacctctgcatgggacaccaccaccacctgccgtcggccatgccgctgatgcaccaccacggccaccaccaccacgccgacgacgataagtaccacgtcgcggcggcggcggccgcgctggccgcggagaaggaggcggcggcggccggcggcggaggaggaggagggggagacgacgtcgacggcgggggcggcggcggagcggcgcacatagtggggaggttccccgccggtggctaccaccggttcatggggctgaacaacccgctggggatggtcaacagcgccgccggcgccgccatgccgttccactacgccggtgagtcatggaataatggcagcgtgcaagacagcggcgccggctcgccgcaggtggccgccgccgcggctcaccacacctcgccgttcccttcactgctttccttggctccagggccgcatcatcagctggtgttctactcctccgaggccgagcagttcacagtagacaaccttggctcgcagggcttgtccctgagctcggcgagagctttccatgatcagacaggaagctaagcaagctcgatctacacagtacacacactggaacaacactcttcgatcgtcgacaaggtaaggatcgatgagctctaccaaaagaacaaatctaagctagctagtgcaagtgtgtgcattgctttgatctatgtattaatttctttcaagggaacaattaagcttgtgggttaagatttaagaaggaagatactgccagctagctggctgctaatttcttttgctctgaaactagggcaagaaatatgcagggctttgctgcatatgcctgtgtgcaatacggatttgttacttctttttatatgcaaagaagtaattgatgtattggcttgtgtaataattaataagttctgaattttgaacctttcagttctgcctagccttaattttctttattttttcaaaagggaaacttctttgtgtgtgtattcagttttctgacgccgttgctgcatcccaagcttcctggctgtacacaaaacattgggcaatgaatatctggttgacacactgcatactgaggaagtatgtccctttttccagttcattctgcgaaatataaatacactccctgcaaaatactaatttccttccaggtatatgtagactgaaccctgaagtatacattatttatattctaaatgtgaaacaaagaaacttacagtggatatttcttaatgttggaaaaaaaatgctggtttcttatgtgaaggaagcatatatatacacatgattatttttcttaactgtcccaataaattaaaatggtatttttaaattatttcagaaacatggaaatagtatagtgtgctttgatgtttaaccctatgcttgaatgtttttcgaggaattaaaacttataaagggctacaactcacacaaagtaaacaatttttcacctcatgcatatatgagcttgggtaatagtcaatccatgtgattccacaaggctattaattgcagtcataatatacataatgcaatgaaatatctatatatgggttaatggatatgtatgaataatacatacatgcgtcgtcattgtattaatttgagatctctaccagtacaattaatcttacgtgtacacatcttgttattttgaacgacacatgaggtcacatatatatagctagatatataccgtgccaaagtaacaagataaggttctatctgcaggttaatgtttattaacacccaaacatctttacaactcctacctagctaagtttaactagagaaggaacctctttacaactcttaccctagctagttcagtttagagtttaggccgcttagggacatggtccacatgaatatatagagttatgtaaaatagtaggcattcttccatgaaacacattgatagtacatgcctacaattatgaaaacggcaagcagctcactgaagcatgataggaagataaacataatctagctaagcatcatcttattgttgtacgtacgtgcaagtgtagcattatattgcctagtcacaaataaattaagaacttaatttagaagctagtagcaaagtaaattcgaagaggatgctgaagtacccaggaaaaagtatattgaggctaggaaaggatcagcacaacgttgcaattaattgtgaaattgtaaaaatgcagcaaaatgattttcgatccatttattaattaggtcaaagatacgtataaccgtaccaactgatcaaattgatgatcagattgacatgtgaaaaaggaggatcaataaattatactcctagtatatgtattggggcatatatgttttcacttgattgataagccggctaatcctatatagcttaagaaatcatcaattactatgttttctcatacgtattattgtcaaattaatatatatgtcaattaagttcccaaattaactttctcagtcaaattgatctgctcctcactaattaatttgccaatttgttatgaaaaaaatgcatatgctttacacttttcatttagtatataacatgattaaaggcagattttaccgaaataataaattaaactaggtacaggaaatcatatgactgacttgagttgatataaattcaaataaggaaatattggtcatgtttatttcttaaaatacggacatgtttaagcaaagattgtgcttatcacatggaagatggaacttccttcaagaaaaaaataattaaacttaattaatggtagagctgaaaatgcttttgaagttttatgcggcttgatcgatcccatagaaaaaaaagaaaacaatatgattgtatatatatatataccattctttcattactctatatactatatctggtttcaaataattgtcactttgagtcttcgatcatcaataaatttaatttaatagttagattatgatgtacaaaagtttcatgaatatatttaggatgcaacacactttgttcatatggaatacttctaagcatttaaaaattttcttaacaaaagatgaatggtcaaagtttgaaaatgaatacaatgacaagtatttgaatactcatgaagtatatactccctccgtctcaaaataagcgcaaccataaattttcgcgtacaattttgatcgtccgtcttatttgaaatttacgattagtatttttattgatattatattataaaacatgaacaatactttatacgtgacttatgtttttagtttttttttcaaaaaaattttaaataagacggacgattaaagttgggcacggaaactcatgattgcgcttattttgggacggaaggagtatatgggaaatatatacattcttcatttcatatgaatagatatgtgcacttctggaaagtcaaaatgacctcagatccacaccagttctacaaatataaatatttatatatagtagaaaagatgcccgtgcgttgcaacaggggaaggttttttcatcttattattgttatacagtttagttaaggtaaaatttactgtgcggattcgcttggatatatatattttttagaaaatcatgagctacagttaggatcgtctcaagttagcatgtgagtttttttaatgagatttcttatacgacgaattctgtatttccaaaagcgaacgaatttaaaaactgactcaaatacggatatgtatttttaaaaggaaacttaaaaaccaactcatacacagatgacgtaccaaaatactggtaaaaacattttaaatttttataatagtagagaagagttatacgtacttgtttttcggacaatccggttttcagagccagctagtacaaagtatttcagaagtcaagacctgtcctcagatgactacactcattatatattttgttcgtgcatgcagaatgcatttaattctagacgattgttggcgaaagaaagacaaactgagcagctcaaacactgttcacaccatacactcctacctgttgggactagctagctagttagatggtcacagctcacaaaacataatggtaaagtagcgatgtaaagagagcagtattaccgaccagctcgctagcacattcaactcgaccctgtactgatctgtcctctatctctctctctctggtagatctctgacccgtaaacatcatcctgcgtcacccccaccagcaacgggatgcccaaagaaaacaacaaaataagacacggtggacacactttgttggcgcagacccaccaactaacgcacagccagctagctgctagcttagcacaaacctaattaagctagaggctagtatagacaacatgcatgcatcaacataatatgcatatcacttttgtaaatggtaacatgcctagatagctagcttacctagctagctaaaagtaccaatcgtgtaaaaggaagatcatcagcagaaaggcatgcacagttacacgcaagaaattatctgttaatctaatcacgggtactgtatatgcatgacaattactacacaaccacctaacattcttaactaagaattatccgcagcagcagaagcagtggtaatatcctactccctccgtgtttaccattcgtcttattcaaaaaatttaagtaattattttttttttcatatcatttgatttattgttaaatatactttcatgtttacatatagttttgcatatttcacaattttttttgataagacgaacagtcaaacatgtgctaaaaagttaacggtgtcaaacattttgaaacggagggagtaattaactagtactatggatattccacaacgatctggagtagttgttttagacatatataggctgctccagtctatatagggcccatttggaatgtaatgtattatatatacaagaatttggatgcatgtcatgcatggctagtttaatcatacaagaattaaacatgaagaatcgtttaggcactgaaatttgcagaaattcttaaagaaaaagtctgcacaatttatcttagacacacacacacacacacagagatcagaaagatcagaatgctctgaaacatctcaaaggaaatgaaaatatgaggtctcagcatatgtttgaagtcatccaaaatatggaggaaggaaagggattccatggtaattttcaatctaaaaaaatccgataattcaaaaaggttctacaggaaatattctatatagtttaagcctatgaaaaaaactacacatgcatctcttaacaagtcctaagttttagaaatataatgttcctcattgttggattactactgtgtaataatgtaaagttttctaagaaaagcttctacacaccattcattaaattgagtgggtaatacacaaagacctagctaaccacaaaatttaacagtatggtgtacgttaagaagcaatggcaaccaacagaccacaaataaattaaaggagaagagaacaaaccgaacaagtgaacaacagctataagatctcgaggcacacatcaaagatctccatactgaccatatatatgtagccaaaaatggaggcaatgaacaactcccactgtactccaaattaacaccggagcagatcaacattctcgacaactttggaggattgattggtacgaccagtaaattatggtgaagacaccctctcatgctttaagataatcggtcccatatttgccaagcaaccttggtgaaaatcataattaagacgtactatcaactcgcactgaagttcttctttgaaaattctgtcttacatgttgagccaccaatatccatgaatggagaatcaccgtgcggcataagaaaatcattcctgagacaagaaagctagccactgagatactagaatacattgacaatgtgtatgtattagattaatattattcaagcaaacttaattaacccaacatgacagttattcttcttgttgtcagtcaccaccaatatttgaccgatcactaattggtaattaagtgagattattaattagcagaccaaacagcagctaagacctgcgtatcagcggttcattctgcgtgccatcatcctacccatttgaccaagaggaaagcgagcactgcgtacgtgggggtcactatctcatcttgcgtgccggatcgatcgattgagagcaatatatcagggctaggtagatctttttccctccacgtacgcacctttgccaaagctgaacccaaatcccaaagcgacctttcttttgtgcactgatctaacaagctatagctactcgatcatctgcacgtatatgtgcttctctgcttatttggggaaaaaagacgctgttcccctgccttagcagcggctactactagctagtagagccgaaaacatttcctgacaaaaacccttccaaacaactcctgctgtctaccgtggacaagaccctgcagggtcaaagacaagctaagagtaattaggactttgtttcaaaaagaaagccagggttttgaagatactacttcgtaattactaggacttgagccttaggagttaggctttagctccataatcctatttacatgctataaaaaatactatacaataattcaaaacataaattaagaagtagctaccaagggcacattagctctgctctaggttcagctctacacccctgaataaaacatgaatatctgcaaagacattgcccagctgagaaaagacagccttttggttgatttgtatatgtacacatgtatatacagaggcatatatacacacacacacaaccatgtcttatctttgaatggcatacctaaaacaaaaggacaagcatcttaagtttgcaaaaattttgtctccgtgaccaccaatcatctagcctagcagttccccaagaaaaaaagaaaaatcaagctgctatagctagcaagcagcaagcgaagggaagtgaccagtgagtggggttgatgagtagtaaaagaccagcagtggggctggctctgtggctggcctggcctggccggggggctggtctttggaggcgagctgagctaggccccctacggttaaagcgctctctctctctctctctctctctctctctctctctctctctctctctctctctctctctctctctctctctgcgtgcactgtgtctgcatagccctgtagctagggtttgcatgcatgcagcaagcagttagctaagcagatgtacccttcgtatcttttgccacggagagacatggaccaatatataccctttcacatgaatggtcccctgaggctaccacgattcctccccacatttttcctatcaaactcatcttcctttcatctttagtttcatccgtttgttaactttgagtatagctaactagcttagcaacaaaccggtaattagctagactagctgttctcatgctggaaaagtaacctagcctacgcatctagtaattatgtaattatatgcatgcacacacatgaaccgattttgatcaacaatgtagccaactagctagagcaatagattgcacgctggctatccttaggtgtgaatatatggtgtatggcagttaaggttgattattattaagggagatgatgatgaactgtgtagtgtgggctgtggcaaatggatgtgtcttgcatggtacgtgacagacgagcaaattggacacacgagcaatgatactctcgtaagattatgctttggagagcagtataggggagtggcctaccaaatgcatagcctgtaccatgcattatcctcatttcgttgatcactctttcgtttatctcttctgtagcatgactaattctatagtaggtacgtgcgctagccgctaggtacagatcgaaccgtgagtttcttaactagaaatggggagaaaagaaaatcagctaccttaactagctgctaccaacctaaattctgtaagcagatgcatgcatttcattaattaacaggatgcgatcgatgcatgcaaagggcggttgctcctcgcggtattttagtcgtcaaactgattctccccatgatctattgcatattttgagctatttttcaaaaaaaaaatcacaaaagcttaattaagtggaacacaaaaggcgaacatattgcaactgcgttaattcgttttttattaagaaggaaaaatcacttgaatgtcttctgaaggccgtcgtacgtccatatcgcgaaaaatcagtgtgttaaccgacggtcctgacgaattctacctgtgaaggaaaaaaaacggttccaatataatgtagtgattgcacgtgtacgtataactactgcagcatacagcagacccattgcatatgtacaattaacctggcgctacagtatgcacgggtattacttcctccatcccacaatataaacatttttagagttaaacatggttattaagaaaagtaggtacaattgaatagaggagagttgtaattcgataagtggaggtatgtggaaaatttgaatggtggagggttgtgattggttgagaagacaatgttagtgtaaaaattgttatatgttgggacaaattttagaggctataagttattatattttgggacggagggagtacctgacggaggattaattggaccttgttcctttgcagctgacgcatgtgtgtacaatcaacctgtcgccggcccttaagaggctggtacatctgtgtttgcagtggacttcgagctgggcctgcagcctgatgggccgacttataggctcatcaagagaacatgcatcgatggttccatccatgccaggcgaggcgactggcaaatggtaatactgatgcgtgacacagccggccgcacagcacaggtgtaccgcgtgtagcatcgcattatcattgcaggatagagcagtagtggcgagctaaaccctctccaacgcagtcggaccataataaaccaactgtgccatctgcttggagccttcgatcccgacctcccgttccctggcaacttctgagcttaattactacagtaccatctgtccagctaattatagcacccgcttgcacgcgagcagagacatttctgcatcacacatgttagtatgctattgacaaattgtgatgaccagccatgaaaatgcccttgcaatccaccacagggataaatgttattatgttaaggatggtttcctgccaatcagtcaacaatatctagtacgatgctaccgagatattctccaggaagtttttaagcattcctacatcagagacttggacgagtcgcatggtccatgagtaactcgtcaaatgacatgttgcaactatcagcccaccagatggagtacatgatcagatccaacccttcctgattcgagcccatgcaagagcagctattagggcaccacctaaatgagaagtacctgatacctgaccttgcctctaaaaaataaacagatatcagcctctgtacaactttttttggggaaaaggaagtatatatataaaaagcataaattagataaatgtaatcatcaagaagaaagatataaaacatagaatttcaactagccaggaaaggctagtacattctagaaacagaaacatcacatggaaaaatcagtaaaatattcctagccaccctaaatgtgaatatcaactttttaaaaaatatcaggttaatttaagaccagagctactgcaggcaggaacttcacagagtaagcgattcacaaaaatcccaaaattgaaataaaaatgaaagtagcagtgtccaacagctatactgtaatgcatctgctgaaccagcacactaccacagtcaaaactcatggaaaagcaacagggtagcaccaaaaaaccaaaaggagcacttattacattagcaaatccacatgaaaagaagtcacattttaagttactgcataccttcaccctcagcaaatcagcaccgatcaaaatagccccctgaaaagtcaaagagtttttgttttacatcatagcaaccatgcttaacagaaagttttgaagaaaaaaagcttctcaccataattgcagctggaataggaatgaagaagtaaagatagactagtttctttggatacaaaaagatgtcaagaaggataattgcattagcagcagcacttgcaccctgattcacatgaatataataggttatgttttgggtgtaacaagtaataacttagtactagtacaggtagagatggcaacgggtaatccccgctggggaatacaacccatccctatccctgcgggccacaaatttccccaccctcgtaaactgcaatcaggaacaattttcccatcccaccccacgcggggaattaatcctcatggagggcccgtttaaaacaacatatacatctcaaatcgaaatgtaattaacaaataatatccacactttatataaatatactagcatatatccactaatccacgtgacaacaacacaagatcttcatccactaattatggctcgattggacctttaggcctacataatttgcaatggacttggatccctatcccgatttttaatcgggtatcctcacgaaggacagggatgggcaacagaagatcatccccgcccatgctagacccaagggggcataagtttttccacatttaatttcccgtggagaatcagttgcaaccatccccgtcccctgtggaagaattccctgtgggggaacagggaacgaggctccactgacatctctgagtacagtagcaaataggatatccctttgttggctatatatacattaaattaaactatcatagcgattcaaatttgcagtactgctttttaattaattatttgggtgtataagatgaacacataataggtaggtgggaaaaaatcgctgccatcagactactgatgtgattatgtcataataatgcttgttttctgaataccagcgcgaaataaagtgaactgcaagaacaagaaatcaataaatcacatacaagcgcaggagttcttgaattgtcccatccgccataaaactgcaaaataaatattacatattagattagggagattattgcaaaatcataaatattgaacccttttcatgcaggatatgtcccacacgagtgccaataccaagaggctggttggcatctagtagctagcagcgaactaccaggtactagcattttcacaggttagcttttcttaactagaaatcacgttgacataggattttgtttcagaattggatgacataggacatcctggtccaggattagaaatcctggttccctgatgcataagaattcacatcatatccaggcttacctgtcttcgtggagctaggaaggctttctctagcaagaagaatgcagatccagcaagtgctcctgctacgtacaacttcagtagaaaagcaggaccaaacatgttggaaatctgattcacaaaggaaaaaaaaagcaattcagcacatgcaatataagtaataaatggccaatagaaaatcagagtacaatatatatactagtcccttcatttggagaacgaatcttaactacactaaacatgataaatagaaatactaaaattagaagggaatagttatatgctattgattttgtttttataaaatggataaaccgtatctagtacattcaaaccatggtagacattgaattcccatggcaaatcattgcaggatctctctacctagctggctatttcatcagacctgaaaaacagcctcacatcttctcctgcatggtgccttcatcagtcatcaatacgtacaactctgattggctcggttgaataactagcacaggaaatgtcaataacctctctgtgtgtctctggactgatggaggggggcttggcaatgaagtattataactcttcattacatgtgacctttgcaagaaactaatgaaacaaagaattgttttacaaacatcaagccaattttaattttttttactagagaaaaaatataatcaaaatttgattggtcaaattcaataatgtcaaaataaagaaaaattgctagatcaaattcaatactccactaccaaatatattactctttcttaattttacacggtcaagttcacccagcatgaatcatgccaacaagttgatggtaattcagacttgcttgaaatattcaacaaaagatgctggaattcagatgagcatatattatagcaacaagatcatgtcttggatcaagtgttagataatgtttttagtctacactcaacttatgattctttgactgatttgataattcaaaacagctataattcaggtgtttcagaaagcaaactagtaatagtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccataaggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcgatgtcgaagcggcagggtccccgaagcatcagaaccgctacgcgtggaagcccaacctcgggcagaagatcaacgagaccgtgagtcctcgagccgcctccctctccttctttatcctctttttttcaaggcctgagtctcacggctggaatcctcgccgctgcaggagcccggcggcaggttccgtcctttgtcggagatcaccggcgtctgccagcgctgcaaggaccaaatcgactggaagagaaggtcgggagtccccttctgtagtcgtcgttaatcttagctcgtaattttagcttcttggcctctcggtccgatctgtttgtctcttcttggcagatacgggaagtacaagcctatcgttgagccggcaaaatggtaccttctcttgccctttttcgtaattatcgcactcactcgattgatggaactatggaggagtgggcagtgatggatgctgatagttctcgtttggtttttgcagtcagaagtgtgggaaacggaacgtccgacaggcgtatcacaacgtctgcacgggtgaatttcggctactccaccatgtcgtcttttgctatgatggtgttgatgttgttactgatttctctgttgcatatgctcaatgcagcttgctccaaggaccttgggatttgcgcgaagtgctgcacttgtgttaaagcgcttgtcggaaggtgatccctgcttgtttactatgttgtggtactagtattagcataaccaaatgatatcctaactttgaaacttaggtggctaacaattttctaccattttctagggatcttagtgaacaggagagtgagcgcaaggaactagaggaggtttggttgtgctatatttgaatggagattgttgtgaacgttttcttttgtgctgactattaaattattttgtaggccataagaggtgctagggagagggagaggcgcacacttcttcgccttgtgagtacttactatggcatgtttttaatgatatatctttatctgattaggtatagcgaatgtttgtcttcaagggatgcctaatcacaatatatgtttcccatgatatctgaaggcagcactgcaagaaattagaacaaagattttgtcataattgtattgtttgatttatcatttgaaaataatccccagttcaccacagtatttcgcatatacccttgaatttttcccttttatgtgtttctttggatgcatcgttattttggacaacttaaattatggagatctctaaattatgtgtattctagtattaaggtgccactgcctttgtttcgatgtccaagttgaatgaattaatattatgcaccttctcttcttgtgctattcatggtttttgttgttccaatatgtagcattaaatgtgaatagaactttgatgttttaaattcttgtacacaattgtttgctttggcatcagtggttcgtttaactgtaaggattctttacaggtctttatctggagttctattatattgctatacattaaatctgagcatgtgaatataaatggctggtccatgttctaaagtttcacctgtcttgaaacattttgacctgtaattactaattagtagtatcagttaagattgttttataccccgctccctgtagaatgtaaatatgatctgttaatttagcttttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtattttaaggagataaataaggagagagaagagcagcgagctacagatttgtagctagctgtagcacggactctaagacgcaatgtgtgtttgacaggtgggaccaggtattaatagtgtagtatgtaactattgtatggatgagctattagattggttatagatgaattgtagctactacttagctatactattaagcttgctctaacaggggcttccttcttgtagctcgggttcattaacccaaaaatcttgcccacgtttgctactgtcatgtcagagcatggccaggacatcaaaaccttccataacaaaacacgcaaaaacagtaaacaagtgtctcggcaattcggcatcgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataaccccaagctctctctccccctccatccctttccccactcaccagtagccaccaccacatctcgcaaggccaaaagccctagccaccgtagtagtagctagtagctatagcaaggtagagagagcgctctagatctctctctcgcggggcgctgggcagatcgacctggcgatggcgaccaaggggaataagctcggggaggtaatgtgggagcaccggctgcaggcggcggccgtggtggcgctggtggcggccacggtggtgtcgatctccgccatcgggcccaggctcggcgccgtggtctccttcttctggccgctgctcgtctccacggggttcttcctcgtggccgtggccgtcctgctccggatctcgccgcccccctccagcaccatcgacgagtccggcaaggagctcatcgacttcgtcgccgggtgccgcccggagcaccaccccccggaggcggcggaggccgccgtggacgtgcctccggagccggagatctagaaaatcgagggtggcgggcgtggcgcgggcggccggcggaatcagcggcgcctcgtcgccgggcggcggtggggttgtgtggggtaatcgccagcatgggcccacctggaagtgcgtgccacccccggtgtacggtgcggccgtgggctctgtgttagcgtaggattccgcctccgttgtggtccggggtgtacaataccattctcaataaaaacatggcataaattcgtcctagtactactcggtatcgacttccattatgatcgcgtcttgctttgagttgatgcaacgcaggttcgctgtaacgccatgaagatgaaggcgagagtcttaagcagttaagctatacttacgctcgaagaatatgcgagtctgccaatcctcctcgagcctcaaaattctcctcttcatcccgctttagaaagctagattcactcatcgagagctgaaagcaaaagaaatggtgcaattgtaaatctcatttcgcatcattgatgttccgtgagaaaagctataaagacggaaaagagaaatggattgatagtagcgtggtagcaggatgccctttcggcgtaatcggagaccgacactctttcggtgttaaggagttgctaaaccggtcactcagccgtccagttttgctcgtacgcgacgccggttcggacggtcacggacgcgcgtttctcccatcgttgtcgccgtagtaggaccccgtcttactaattctcatctgttatcgagcggacgcaggcctgatggtcactgtcacgaggctgaacttgatacggtttttataaaggaagacgaggccgtcatgctatattctctggtgcataggtcaatgcgtctgacgtggccaccgcgtggtctggtcgggtgcttccatggtgctgacgtaatggtctctttgagctttggattccatggtgacatttcttggcacaaatgaatttagttggggcatttcttttcttgaatatgtttttttttcttgaacaggttgaagcaggttttactagctacgtagttatatgctaatgagccaattctattgattaactgacatcgagaggacgataggagaagaaggtgaccggacaccgaaaaatgcacaaacatttttgtctcgaatggatttgaatatggtcatgatggatgtgaagttctgtagttagtaaatactccatctgttctaaaaaaatgaatctagaactgtccagattcatcatatcctagtacgatatttgatttttcttttggaacagaagaagtatgtattttccaataacttgaaagacacacatgcacacacgtcatcacgcacgcacatcacagtcacacatcctcgcaaacacgctaacacacgctcaaacagaagaggctaacggcgtaactgcgacatcaataataaattctaattgataaagctacaacttgtgcacaatatctatggacgttaggatttaaaaccttagcagacaagattatgcacctatgacatcactaacacatcatcgatggttcctggttagaaaactatcaacaacataacaaacatatttttgtctcgaatggatttgaatatggtcatgatggatgtggagtagttagtaaatactccatccataaaaaaaacgaatctagaactgcatgtgtccagatttgtcatatcctagtacgatgtttagtttttctttgggaatggaagaagtatgtcttttccaataacttgaaagacacacatgcacacacgtcatcacgtacacacatcacgatcacacatccttgtgaacagctaacacacgctcaaacagaagaggctagtggcgtaactgctacaacttttgcgcaatatctatggacattaggatttaaaaccttagaatacaagattatgcacctatgacatcactaacacatcatcgatggttcctagttagaaaactatcaataacatagcaaacatatttttgacaatgttatcctactaaattttggtgttacttatggtgcttcacagctagccaaatgctacctaaatttccaagaccaccaaatgtattttacacagtgatatcttacaaaaaatgataattttgaaaatgtccaccactaaatatagtactgcaattattaaatgttctgaaccagatttaccgaaacacgtactacttgttgtagcagtgaggactaggtgtcatacctcctattcgaccaagacacgacttcaggccttgatgggcatattcctgagtttcaaagcaggtgacaaaaaaagagttcaagttgctatggacggaaacatgttaattgggcaaatagtattcaagcttgttatagaaaggcaagcggtgcgtggaggatggagaagaagcttggcggctacgttacccagcaagaatattctcttacaagttccctagggtttctagtcctttggattatccatgtaacttcgcatgtaactaccatggctatataagccgatctaattatatagcaacacgatttatactttactgaaatagcgatcatgagtgtcatttgactcatatcaagctcatctcgttacaaggataggcgagggaaacacttcctcatctatccccattatgttcatgacgttgggtcacaacttagggaagactacgcgtcggatgtatggagaattaaaaaaaatcggacataccccagtacctaccattgttgcatgcaccgaacgaatctgccctatcgatttcatcggtgcttattcctacatgattactctcttcaccactctctctcctctatgaccactttatcaacaacctataaacaatttttcctcttaaattctttatctgatctaccatctgattacgtcgttatacttatagcaattaaatctttacaataagatgtcacatgaatatattttgattatatatatatatatatatatatatatatatatatatatatatatatatatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaattctctcggccaaatagtgtcgatacgtgcaacacagtaaaatgcttgttgaaacattttgctcatatgcatgaaacatcaaatataaacaattgaaacatatacatactttttattagaatatagtcaaacgagatgtcattgtaaagatttaatcataagaaacataattgtataataaaattatagattagataaattgtttagaagaaaaatcattttaaacaaggaggtgggagagataaaaagctaatagttggttacatcatatccattgcatgctgcagctcatcacatcacatccttccatgctttgttgcatgctgccattatctccaccataaataatccattttcgtgctacgttttgcttgctccgacggaatgttcgattttttgtcgggcgtcggatgtctgataagaagcattttcgtcacaactcacaacacaacctaaaaaaaatagcagtccaaaagtgtaccataatttagaaaggaataagtccattttgcctccctcatctcttgcgcttgcgtgaataacatccctcaaccggaaaaccgggtataatgcctccttcttctctgaaaaccagagcaaatcacctccctcggcggtttcggaggtggttttgtcctacgtggcggctctgacttccatctgcgcatcgacgtggccgcttacctcgccactaccctcaaaacaacatgtcaatcgcgccccacatgttagtgagtaaaacactaaaaatcaaatattgggcccacatgtcagctaccttcccccttcctctctatcctcacggcaagcgcagcatggagagagctagctcggcggcagcaggacggcgggtgctcggtggagcggcggggcggcgggagcttggcggagcagcggggcggtgggagctcggtggagcagcgggagagtcggggcggcgggaggtcggtaggagctcggtggagcggcgggagaggcggggcggcgggagctcggcggagtggcggaatggcggggcggcgggaacgacagggcggcggaagctcggcggaatggcggggcgacgagagcggcaggagtgacggggcggcgggagctcgctgcctcccctcccacgcccctcctccgccacctcatccctatcctcgcctcttcggcctcgccgccgcctcttcttctccttccccggcatcctggcgaagatggacgccgacggatacgcaaagttggcatggtaggatgcagcacaggggtcgtcgaccacgcgtcgctagtccgacgtggacggagccagaacgccgccgccatgaccttcccgcgcttcggcgtcctccatccaacattcggcactcttctcgctgcgccggcagcgactggtagtgtcgccatccaatcttgcgttggggcagcaggcaacaattggccgatgacgtgtgatcatcgtaggcgcgtcctcttcgtgtcacggcgatcctcgtcgccgtagtagccgtaagcagcaccacaacagccgtaaggcacgccgtagtacatgtaaggatcagctccgaatggcacgccgacgccgaagaaggggtcgacgtagcctggcgccgggccgaacgggaagccatagctgccgtggtgatcgccgtcgacggcgagggctccatattctgtggagtggtcacccgccaccgtctcccacgcctttcttggtccgaggacacctgatgagatcgtggcgcttttcttggaagacacgttactgcggctcacctgcgaagcggccaggctctgcggcgccgcctctgtcgcgttgctgctggcggagctccttggcttctcggttccacttgaaacgctcgctgtgccgctggtggtggcgagaacgttggcgatggtggtgcggaacgttgggttggggatcaggtcgtcgacgcacgcctgcgccccgaacgcgcacttggacttggcggcgatgt

SEQ ID NO: 31184 - DNA, 3218 bp, Oryza sativa
  unsure (1)..(3218): unsure at all n locations
cagtagagttccgatcagatgacgccgctagatccccgaggaagcgtcctccattaggcactcatctggcagctgccacgggggatggaaaagataatagaggaagaggagataagttgctgacaagtgggacccacaagttgactcaggtgccatgtaggacacaaccgtctccgaaaccgccgagggaggtgatttgctctggttttcagagaagaaggaggggttatacccagttttccggttgagggatgttattcacacaagcgcaagacatgagagaggcaaaatggacttattccatttagaaatacaaaatttggtagggttggcttaggcaaccaaccaacccaagccaaccaaagaagccctcaaatctttgtctcggcccataatggccagcgtttatggctcacttctaatgggctgtggcccacctgaaacagaagagtatcgtgtaggcgtatatgcccactcgttaaaaagtggccactctctgacaagtgggccacatcggaacactcttgactcccctccaggcctccacggctccacctccttccgctttcgcctatccgccgtctcccccctcccccttcctcggctcctcgccatctcgcgctcggccgcctctctccctgcttaaaccctctattcgtcttctccaagcaaaaccaaaacccgagcccacccaccgaggtcctctccccctcctctcgctgggccaccacgccatggacggcgtcgcgaggtcgcgcctcctcgtcccgctcctccccaggatctccgcccgctccttctccgccgcctcccccgcgtcagagccagcggcggctgcggcggccgtcgccgcctccgacgcggccgccgccacggactactcgtcctccgcgggcgatccctcgtccgcgccgcccccgccggcccgcaagccgctgggcctgctcaagggcggcgtcctcgcggttgtcgccgccgcgttcggcgccacaggctacgtcagctatggtgcgatctctgatccctaaaactcctagatgcctctcggccctgctacttcgcattgcagtgtttctactaccattctcaattttaaagtgggaggggttcggtttggtgctgtgcgtatgattcgtgctcgtgtttttgtcttgtgtagcttattctctggatgaaattgatcagaggacgcgggagttccggaagaactcgaagcagcccatccgtgatgacctgtccggtttcgaggtaatatggtagcatgtcaatatgtcatgtttgggtgtgtgataacttgtcgctagctggttagtagcgtgactgcataagtaagcagtgatgcccttggaaatatgaccgcataattctgatttcctgtgtaaaaaaacttggtttcatggggtgaatatttgtacacagctatagggtagttgagatttgggcatctgaaactaaaagttattctagtacgacacaatatgttctattgtagacctgcattctgagagtatggataaaagctaaatttctgaattgggttaaagaatttggatttcagccatgtctaatagacgatttgcttcctctctgcagaagtttcaggctatggcttattcagcagctatgaaaggttctgaccacatgactccttcattatcttaccatattacctcgggattatagagtttcaacatgtcatgcatacctttcttcatccacatcaggagcaatttaccattacatgttattttttctttgtaaaatacttgtttgcagccaaccttagggaaatttaccctgcttcacagtgaataactaagccttgtcactctctgaaatataattttgtatgcactaaagtaatggtagtcagaaagatctactttactgtatgcatggtgctgttgttaagctgacaataaattccaaatatgtaacccaaacttcacaactggaaaaaaaaactaggggtactataatctcgtgtaaaatagctagggaatacccactttgtgtaacaatcagttagctagagcaactgtgatctaaccattatactatttacatgcgctgcacctagttgctacggagggcatgtgtctttggtacaaagctgtttgttaaatatctagtaaattgatgcattgtctagagcgctctatggctctagacaaacatacaccacagggaagaagcatggtatgagtgccctagatagcaggggttcgtcatttaaccctttcatgtactataaattgttatcctcctgtttgcatggcataattattgttgttccttttctttgcgtctcaattcttaaacacatatgttttgttttgcagttcctgttgctgctattgagttctatttggataccaggagccaaatagaagatcaaattcgggtcagtaaaaaatattaaatcttttgttctccattatccatgttggctattgtgaacagacgtgcagatcatgctaatactcatttttattaaagggctttagtgaaccatcatcagataaacttcttccggatctacttcctcaagagcagcatgtcttcaccctagttctggatctgaatgagactcttgtatactcagattggaaggtgaacatttatgttttctacgaagttacttatcttggtatttgatatgtagtccttatgtagtatacaatatgacccaatcctaacagttacgcaaactcttaacgctctggcttccccgtctctccacaaatttgcacttgaactttaccatctgtgctgtatggcataactcgaaagtgctcatgctgattttgttttggatctctgattctctggttttaccagaactgttttgttacacggatttgagaacctaatgccttattaaatttcgtttgggacacataataaatatgttatgtgatccaaacaaagttttaggttgttagcctctaaaatcttttttttacaagatctagtcttggactcttggtacaaccagagatccaaacaggccctaagtatcgtaatccccattcagattgatctaaaaagggatggttatttaaaatggttttacttatttgcttgttcgattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31185 - DNA, 614 bp, Oryza sativa
gaacaccaccgagaccgtgtttgttctttgatcttagaaactaatcctttccaggaggaaacgtcctgaaggttacaacccaaagcagctaattcatgcgctaccttattacagtttcgtgggcagtaattaatagagaaagaataaaaacagctagcaatcacatgcttgatctcaaggattactccacccatcactgataagttgaaagagttactctggagtaatccttgagatcaagcgatggaacgactggtgaccagtgatttagctggatcagttatataaagtttcggtttccctaaaaaaaaaaagaaactaatcccttccgcatgtaaaacgagcaccggcaacggccatcgctctatccaacatgtcagccagcgtatagcacgaatattgttcgcccatccaaaatcctcggaaaacccgccgtaatcccacgaatattccgtccacaaggctggaaccaggtataacaagcggaacgcctccagtgtcgcggacaggtgggtccatgtcccagcatcgcggaggtgtgtccctacatgtcagtgacgggtaggtgtcgctaccgcgtcctggaaggtcatctacttggttgggatagcgta

SEQ ID NO: 31186 - DNA, 638 bp, Oryza sativa
agcagtgtgcgcatggcgtatgcccaatactttagaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatacgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggttgataatattgtaaagtagatttagaaaaccgataccg

SEQ ID NO: 31187 - DNA, 953 bp, Oryza sativa
cgccgtcgccgtttcccttccaaatccggccgctcctttcttctccggccagaattgattgaggggaagcaatctccgggatctcctctaccttttctcctttggaaacatcggctaaaatcgttttgaaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcatcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatccatataaaggttttaatccgatttaatctttaaaaattcataactaattcatcttaactc

SEQ ID NO: 31188 - DNA, 28656 bp, Oryza sativa
  unsure (1)..(28656): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcatacaaagaaaataaaacaaacatgtttggaacacaatgtaaatgagagtttttaagtgtgtgctgtgctgatactatgaatattatatctaggaagttactgatttttgttgttatatatgttgaagagtattatgaatacctagcaacatgatatatatgccatgtttatggttcatcaattagagaatcttatcataccatggtgacccactataataaacatggtgtatgttgcaggtgtaaatcaacgtctgagaggaattgtgttcaggataatagcttcagagataagcattcattaaaattccaaccaaaacctgggcagtgattattgtttcaatgaacagtaagtaaattgataattctgtgtgctaaggtgctgtcgtgacattatatgtaaactattcatagcagaattcctgactcaatactccactgttgctttttgtttagaattgcaatacgtgaataatgtatttgtagtttttgtactatcttcaacatctttacaggaaatacaattattgctctctgcttgtgtggctggtcctgggagatgttttactgcttgctgcatatcgaggttgaaatgttttcgtttggggggtgggggggaaaggtcactggtgggaggttgaaatgttctgtagaaagatgtcgtcatgagaatgtcccgtagctaaagggagagcgatgccactgtaaggatgaatagtgagccatgccattgtccctttatttaaacacattacccgttatccaggggaggtagcaactgctagctttcatgtactctatttctgttccccattcatttatcattcgctgccatggcagtttgatctgcatagattagaatttgcttttgtgatatgtttgaaactttccttgtgtttgaacccacgtcagattctcttatcaagatgtgattgaatgtactctttcgaccaatcattgaatgaacttattttacaccttttggtaaatgatactctttgttttttctgcaagggcaaaggctactagtttgccacgtggcccactgatttgagagaattttgtttgtaacttcaaaggagctattgaaatcgctttctttctccaactttttttttgatgtgtacaaagtaagaatcttttcggcctattataatcctcccatcggtgtcaatgattttatcaccgcattatgcttgaactttgaggtgaaaaaaatgatagtatcatttccctatttgattgttcctgcaatgtgtcaccctagaaaatttcttattttaggagttattatgattcatatatttggactcaacatatgttatttgaatataagaggtacttactaactaaaacattatatcagatgaagtaattcatagttttcattttttttattttcccaaaaatgattattcttgttctaagccctgcatgtgtgaattcttatggccttgaaaataaattgtcaactggacggttatttgtttgtgcctgtgagatattaagtttgatgcatcaagtcttgaaagagttcttacgacatatcagaagttgtcgcttgcatgcttctacataattatgtgataccgagaggcactaattttgtcttttcattgaatgagaaactgagtgaactaaaagcaactacaaaggttagatactttcatcttggatctttattaaataaccgagattattaaggttggggttgatgtgggaaagatactttagtaatttgcaatataatttgttaaaaatctagttgaccattagaaaatggtgtgaatgtatttttcatcacaaatccttttgttagttttataatttttagtagaatttagctataaaatttaatgggcggattttataatactgggtcctatgtcaactgaaatactgacaatatttttgtactgtagcctctataaatgatcacttagttatagatgagcaattttgatttctgaacaccaaatatacaaaatagtatcctataaagtatctccagaatctgcagctattcaagtcactgtctaaaatgtggatagatattgcacaccctgggataactcacttgtatacgaactttaaaatatcttcacttatgttggtgaaggaatagtaacaggctcctgggctatataaatgaacctcatgttctactttctgtaacttaggtgatcggcaacctgtgtattcatttttgggattgactcctactttaaaggcttcacttcgcctcatttttttcctgactgttcaatacttgtgaatggagtacggtaatttgcgacgtcaagcagcttccttgaaaaagagcctcttcgatcaggcttgtgctctgttcatctcaaaatttcaagcattatagttgaggcatatctgagactctgcaaatatatccatcagtccttttgctatatcttcttctgctatttatcattcagcaagacatagaatacagtgttttgatggacatcaccttacagtcatgccattttaattgccataccatggattgacactattgcacacagataatgaaaacaaagctaaggagaatcagattgaagcacattatattaatataagtgggttatcgatatttctgtagagttcattccatttcgtacttatccccaccccagttagcaaagaaatgctttaaaatcaacgcctttcaccatttcggaactctcttttctggtctttatcttagtttaacatgtgttaagtgtgctggtttaacaaatcgttttgtattgacagggttacttggatgagcaattttgtcaggttgaggatttgcaggatgaagcaaatccaaattttgcagaggaggttgtttccttgttttttaaggattcaaccagggtaatgttgaattttgagcaagctatgtaagtggtgacaatttcataaactagacctgtcttgattatcttttcacattcagcagcattattgttggttactaatatctaacatcacacagtgagaagcatccgaaagacttcgccagatgggacacacacatgcagcaattgaaaggcagctgttctaggtaagcctcagctcagtttcttgtgagatctccatgttgtcatttgacggaactggcactgatggacttttacagggtgtttgaattttattgcctttttaggaaagtgtatgcctagtgcaattacccatttgtctaggaaaaaataatcctgcctttttccaacaaaccacctaactttgtttagaaaaacattgcttggagaaggagagccacacatcgcaaggtcggtttgttgggtgaaaatgaacatgattagattttctatattttgagcatatgctgtaggtaaacttaatttgaaatcttaagtttttaactgcacacaattgtatctttcaaaaagactatgtatgtgataataattttatcactaaatctaatttagagtgtcaagaatctataaaaagctaactaacattaccctataaaaactatatggccttagtttttctcccttcagtcttcaagaaagtagcttaactttcctaactggcatagttctcaggtttttatattaagtttatccttttctcaatggaagcaaatatgacagtttcgaacacaagctgaaggagaacttccagaagcctgatgtacctgaactcccaccacacgcacacacaacaaagaaaagaccttcaaataatggcctgcttaatatcttgtgaaattctagtgaacggtcagggaatatgttaaacagagatatttacagagacccatattgctttgattggtgcagccttgcaggtgcacagctggtagatcatgagtacatgctcactccttatttcattatttgacatgataaaagaagctggcaatttgcttagttatacatatgtgataatcttttgtgtactttatcaatgcttgacatgatatggtttgtcacagcattggtgcctccagggtgaagaatgaatgcacttcattcaggaatttctgtggagaagaaaacgccgaagggtatctctctctctctctctccacttttatgacatgtggtatggcatggtaaaagttcatggcttgagcattgtgattttcccatgcccatggctgttactgggtgtgctcgtctgtgcttgcaggcttgcagccacagcggctgtggcagttgtaaatggctgccggctgcagctggtttcaactgccgcagctgcagtggctgtggcaaccagagcatccaatcggcctgatcattacggaaaaaccaacaaagtaaatggctaagtgccagtctgccaccttgtcaaacttggcatggctcagtcgaggcatgtagaagtgtcacctgtcagccctcactgttatgagtgttagtacctagttacacatgcatattctgatgggtgaaagttcctcctgctagtgaactggaattagcccttgccgtctatctttttttgttcaattcattggcttatttcgtatgatgatagatctctactactattgttatgcagttgcacgagatccttccagaaagtgaagagggagcatgccgtcctcaggcagaagtgggagtcctacttccaggtaatcttcaccagccacttcgtacccagctttcattaatggcaatatatgtttgttactaaggttgtgttcacctcgttaccattttcaagcttgccaaattctagcaagacaacatagcattaccaacataaccttaccaaaataaaattttgtaaggccttaaaccaaataccacctaatgttactatatactccctccatttctaaatatttgacgccgttgactatttcaaacatatttgaccattcgtcttattaaaaaaattaagtaattattaaatcttttcctatcatttgattcatcgttaaatatactttcatgtatacatatagttttacatatttcataaaaaaatttgaataaaacgaatggtcaaacatgtgctaaaaagtcaacggtgtcaaacatttagaaacggagggagtatttcaccaaaaaaaaaaagggtaatgccaaagtttggtaagttttctttctgcaacaaactgaacacacctatggctaataaaccattcatttctccacctatctcataataaacacaacgtggctttgtgcagctgttgcgacaagctggtcctgctgggaccgcgactaggcctgcgggcaagtaagctataagcagccggctattgaattggtctcgggctgctgctgccgtggatgcgactaggctggtacacaagagcagcctgccgttgttctagtatgccactacggtgaaaacccgtatatagacgtgctacgacttatgagttgtgacatgcatgtctgcttgtttatgacaaaaataaaaccgatcaagattactacatcatcatgagattgctctctttgcccttattttgtccatgctgttgtccagattgcgatgggtttatatacagctataaccacagatgaaactgtccggctgtgtcggtgaccattgctatgctggagatagtgtgatcggccgacaaaagtttatgaaggtaatcaggactgatagccctgatagtgtgataggtattactgaactaactggaatgacaggggtgtatctgatatctatgtgatggacatgactgagctaactactactaagataagtactcctatatgcaaaagcatgagctatgttctaatcttggcggttaagttgcaaccactcaagatgtacattttgtgtttggctccttttacagctctgttacagtgttactgacaccggagcaaactctgacgacggaaaatttgaaaaccacaacctaagggtgtgtttagttccacgttaaaattgaaagtttgactaaggctgtgtttagatccaaagtttggatccaaacttcagtcatttttcatcacatcaatctgtcatacacacacaactttccagtcacatcatctccaatttcaactaaaatccaaactttgcgctgaactaaacatagcctaaatttgaaagttcaaagaaaaaagttgaaagtttatgtatgtaggaaagttttgatgtgatagaaaagttagaattttgaagaaaaagttgggacctaaaaccggccgaaatatgcaagtagtagttcctactttcacacaaccaatatggttcattccatgatgggaattcagaaatatttcctgtcaagctctcgctgagcagtgagcaccagcacgatgggaaaaagtggagtagcatttcgccgccggctttcatagatctttttttatctttttgaactttttaattttttaattttaaaactaaatatttccaagacttattttcaagatttgaacggtgtgacagtgttatttggtcacactgttctaatatagacaaaatgtctagattttgtaaataagtttcagaagtgtttattttttaaaataaaaaaattaaaaagtacaaaaagtaatttaaaaaaaatcctttcacgataccggcttgcggcttcacggaccgaatcaatcggaggtagccagtttggccactttggcgggagtgcgattaaaacctgtttgacgacgtcaactctccggcgtgccggcttaaggtagggctcatgtgtaaaagaaaaagaaaaaaaaactcaggtcgcctgcacgatgggaaagggtatccttgtaattgatacaggattcggcgtttgagtttggactctgcactctgccgcgcacgtcgtatgaatattggagcttaatcaggtcccagggattcaaacgcgtaccactattggttccgataaagatgttctacccaattggctccttgaggattccaaaacaaagaaattgtttactggagtacttcttgcgttgttcaaattatgctagactatagtaggaacaaagaacaaagaacaaaaatatgtctatgaatagttccacgcttttcaatgcttcaaagtcaagcctcaatgaggttaaaattttctattatcaaaatccaaactaactggaaagcaccaccggtgatatggggagcatcgaaagcaaatcgaagtaatttggttggggtttttacccaccaaaatttaaatcttggtgcgcatacaagttagcaatattagaaatttggtcttgtttagtttcaaactttttcttcaaacttacaacttttttatcacataaaactttcctacacacaaactttcaacttttctatcacaccattccaatttcaataaacttttaattttagtgtgaactaaacatacctttatcgttggcttctctttttaaacgtgtgttacttttttttaagatcttgttgttcatattattagatctttaaacgtgtgttactgtgttaggggatttattcatgagtgtattagtgtgatattacatgtgtagtagtttgtgtacgttaattggaaaaaaaacgaaactattcttaaaacaaattcgaattgccggtaacggcgaccagagcaaaactcacgcaagcgaagtttcaaatttgaaaacgaaattaaaaaaaaaaactcacgcgaacaacaacaaacccgcgacctgcgcgagaggacaaaccaaaccaaaccaaaaccaaaagcgaaacacagaggacaacacaaagcacggccggggggcggcgcaccgcgcacgacggcgacgagacgcgtggcggagcaacaaaaccagcccccgcattgccccgaggcggcgccgcccgagctcgaatccgcccaatctcgccggcggcggcctcgatctgagccgaggccgccgtgcgccggcccgggcggcgaggaatggggagcgtggacggagatttcgaggggctccaggcaggtgaggcgccccgctgatccggatgctctcgggagtttgaattctagccctagctgctcgaggtttgggttgctgcgagtttttgtgattttgggggtaaatttgtggcgaggaggagtggtggtcggcgatgggcgaacccgctttttctgcgctctgatttagtggttttcgagttggaattcagctcagcgacctcagtgattcgtgcatattcttcctctggttctaggcttctagctatcgccagcccagctattgttcagttactatgttttagtgtttgaagttagctggcgaccgctggattttgaattttttgctgtttcgatagtaaaatgtttgccgaagaagaaccgtgtgttaacccgtttttgtgccggagggttcaaaagttttattattatcatttttgatctgagatatcagttccgagctgccgatctgagttgtgatttttaatttctcatacttgctttacatgatggtgcaaaaaacattgtagcggatcggcgtgcggaagtgattgaatggctcaatgcgttactcccggagtactgtttgccactggactcatcggatgacgagttgcgggagctgctcagtgatggcacggtcttgtgccatatcgtgaacgcactcattcctggtgttctcgaggtgtgtccttttgggcttgaagaattttggcttttttgttgaactgtggatgttgatattggtgctctctggatgtgagtttttgtttgtttaggagtcgtggggtgcttatgcatcgtcagatcaacatgcaggccatgtgaagaagttcctcgcagtggttgctgatatggggttgccaggcttcagtgttaaagatcttgaggaggtgaggttggtcttatcatactatgtagttggtttgcagaaatgagttctgaaatgcaaatggttgagattagttttcttaaatgtttgcgtgctagccttattgtgctagtcaatataatggtgcttggccttgttgctcatggtattgcgttgctgacaagttttagtcatgcatacacatataagtagaactatatttctagagttttttttcccattataatctgtgaggaataaatgaataacctcttaatatcgcctaaccataattgcactatagtaataactcaaattctgtgatagattgttgactgctagaaaaggaggttagattattagttctagatttattctatgccggatgctgtcatctaggaagcaaatctgcaaaaaggattgacaccgcatagttaaaatgacatgcttttaaatactcgcaattgacggaaacatgcaagcattggagcaaatccccccaatttcactatttgtggatgtaagatgttacagtttttcattaaaaaaaatgtttaccatttccaaagttcctgattgcttatgttaactcataacttgaccatggcagggttcaatgtctggggtagtggactgcctcttggttctgagggaaagtgtgagttctggattacgtgatggtacttccaaggctcctttgaggaaaaaatggcgagttccagaaactggtgaacctcttgtccctggtgtggcacaagggaagacatcccctggagaggacaagaggaatggccttccagaccctaagtctcagcagaaaactcccatctttaatggtatgcacattgttgactattttggtgcatagtttaaaaatattagttgaaaagaagtccctacatgtttacgctttggctctagaattctgtactatatagtcaaattctcaaagggaaaatgacatgggctatttgtgattgggcacttggccatgttgtggggggtcaacgatttattggttgaagctgtagattggacaactatgttcaacatagaatcttagtggacatacaaactttctgatgaagctagatttgatcatggtggggtggttactttaacgtttcttaaattcaacatggcttccaagctccaaactacaaacttgttaacgtgtatgcttgctgcaagttgtaactcaagctattgtgtataatctatatctgggtcactactgttccctaccttttagtttataatagctcgtcatatatgctgcaggacgaaagcttcgtgagattttccaattaaaacgtggatcctatgctgatcttccggctgccaagatttcagaaatgatgcattctaacagtttagatgtaactttccattgcttatgcttgttgaattgttctatcttgttgtttgctattcctttcctaacagtaattaccttctcacagaatgcaccaacccaatcccttcttagcgtcgttaatggcattttggacgaaagcattgaaaggaaaaagggagaaataccacatgtatgtctgtgtttctgaattgcatgctctctttttcattggtatcttttaaatctaataaatttatctacctcacctcagcgtgtagtgtacctactgaggaaagtagttcaagaaattgagcgtcgtctttgtattcaagcagagcacataagaagtgtaagagagtcttttttccctgaagcctatatatcctttagctaataaatgcaactcatgaatcagatgtctcttgttgcagcaaaatgtgatcattaagacaagggaagataaataccattcaaaaatcaaagcacttgaaatattagtaaatgggacaaatgaagaaaaccaggtaaatattcagtattttcattgttataataaattacataatttagaagttctcccccctaactgatgacattgtggacttcctttcttcagatggctataaaccggcttcagataattaaggttagacctacactgaaaagatttgatttcctacatttgctatctttatagtacatttgctatctttatattattgtaataatataaacaaatgaaatattaactatataatgtttgatcatatattattgctataaggatgatatttgatgttaattttgttaccgcctagaccggtagaaattatggcaactgttatatcaactatataacatattatatatttttttctgcattcaggaagagaagtcaaaaatagaagagaaaaggaaacttggtgagcaagatgttgctcggctaatgaaagaaaaagaaatttctgaaaacacaatagctagtcttaagaaagagatggaagtcatgactagcatgcatgagcaacaacttcagaaaatcgaactgaccgcaaagcaaatggaagaacatttaactaccaaaattaaggaggttgagtctcttttagtgcaatcaaacaagaaaattgaagaagttgaggctgcttccctgttaaaatcacagttgtggaataagaaggagggcatttttcagaaatacatgaatagtcaacaactatatgtcaaggtttgtttatctttaacttgctcttacttccttttgtttttcatcttatttatgggttattgcttgaaaatgacagggtttaaggatatcatcatggtctataaaaaatgagatgcatgcccttgaaatggagttgagagatgagatgtccaattttggtatgtgttgtataatctataaagtaaacatttacttgtatattttaacattgtgttgcttaaacttttgcaggctctggtttaaagtgtttggttgatgctgctgaaaactaccacaaagttcttgctgaaaatcaaaagttgttcaatgaagtgcaagaactaaaaggttttttactgctcaaattttttatagcttcagaatgcacctattgatgtccatttcaatatctgcctcttttaggtaatataagggtgtattgtcgtgtaagaccatttcttcctggtcaagataaaaaatcaaccactgttgattacattggtgaaaatggtgagcttttgatctcaaatccatttaaacaaggaaaggatggacatcggatgttcaagtttaacaaggtttttagtccattttcttctcaaggtatatttttttacaatggaaatctggtataagcttatctgtgtgcaaataaattctaatacttatctttcaatttacagctgaggttttctcggacattcaaccgctgattcgatcagttcttgatggattcaatgtttgtatttttgcttatggtcaaactggttcaggaaaaacttacacaatggtactaacttttaccgatattttactggctcagcattgttgttaacttatattgatcttttttattggtattgtactggttcagcatgatgcactgctactaacttttgatcacttatgttctattccaataattttgttcttagagtggacccagcacatcaaaacaagattggggtgtcaattacagggctttaaatgatttatttgatatctcactaagtaggagaaatgctttctcttatgaggtgggagttcagatggttgagatatacaatgaacaagtgcgggatcttctgtcaaatgatattgcacagaaacgatatcctttttcatacttaaattgtcatttctaattatatttctggtacctatgtttttagtttgtaagagaatggttgtgttctctttaacataaaaaaacacttggcatatggagcacctctcaacctaatggacttgtcgtcccagatgcgagcttacacccagttaaatcaacatcagatgttttagacttgatggaaattggacaggcaaatagagctgttggttcaacagctcttaatgaaaggagcagtcggtctcataggttgagtgactgataactgaagttaaactatatcttttttgctctcaatatgattttattttgaaacacattattctatgcagtattctgactgtacatgttcgagggttggatgtgaagaatggatccacttctagaggatgcctacatcttattgatcttgcagggagtgaaagggttgagcggtctgaagcaactggagatagattgaaagaggctcaacacattaataaatcactgtctgctttgggtgatgtgatttttgctttggcgcaaaagaatgctcatgtgccatacaggaacagcaagctaacacaagttcttcaaagctctttaggtaatcaattatttagttgaaaaatcatgcatgtggagttagatttatggtttttgtaactataatcttataaaataatctcttgcaggtggacaagcaaagacactaatgtttgttcaaataaatcctgatgttgagtcatattcagagactataagcactctaaagtttgctgaaagggtttctggagttgagttaggtgctgcaagaagtaataaagagggaaaggatataaaagagctgctggaacaggttcttgctttttatgttctgtctgactcatcattaactgaaatttctttgcttttgttttacataattgctgaactatttagttctaggaagaaggggaatccttatgtgtaaatttgatgttcatgcaacaaattttcttgcaaatactgaagtaatttctaattgaacttagagctctattttagaatgttgctgatgttttactcaaaagcatggccattgttctcaacttcatattttccacaaatttattcaaacattctaaagaatcagcagtaaaacaacagcaatttccaagctattcctgaacgaatgttctcccaatagtaatacaagttatcatcaatattaggcttgatcctgaacaaatgttctcccaatagtaatacaagttatcatcaatattaggcttgagatacagaaaacctgctgcaaacaacctttttttttgtctagtatgaaaaaaatataaacaaatcaaaatggtgacttgttgtgatgttctatgtaattattcaagtctatatgctgctagtggtgtaaatttctagttgaactcatgttatggtttgtgcttgccaatgagacatgtttctgttataatgacaattccttctttttactataaatattttgtcctcccaacttgaaaagtcacttcacatattttgtccaggttgcatctttgaaagacactattgtacgaaaagatacggaaattgagcagctccaactcatgaaagacaaagtcaaatcgccaagttttgcagtcgatataaatggtgctagcatgccaaaaaattctaactctgacctaagatcagtattgtcaatcacaacaaaccaacagagccaactatcagatcctcagagttatgctgaggtgaacagagatggtggacctacttcatacactgacattacaccaacatgcttggatgaagcagattttgaggacaatgcatcagaagatggtttctctggaggaaccgactattctgttggctgtgctgccggtgccagcgttttcccaaattcctgctcagatagaaccgcagatacctccatgtactctcatctccctatatcacttacaccaaactaacttgcagctattaattgttctctcattacatttactcaatttgttgtaatataatcttattattctttatgcaacattatcttttcatgttgtgatgaagaagcattaatttggtacctcctaatgattgcagtaggagaatttcatcacgaatagctcgattcagtctcacaaagaatggacaaccagcaacatccagaccaaaaccaaaggatactgctccgaagactccaagtatgtactataagccactaatttacttcaacagattggtaactattactgtactggctacacagttttagtatatgtgctcaacgagttcaaattatcatgccaatatcagaagacacttgccaactttgtcttggttttcaaaaacaaatggtaattttttgggaatagaaaggtcatgttgctccgtgcaaataatttcatacacatgtggttgctattattgtaaaacttttagttttttttaaagatatttttcaaatttttagtgcactgtccaaatagtttcatacctgcacatgatgtaattaattatccttggttattaatgagaaatatattgattatcagatcaaacgagagttcaatcgagccaattgataggaggctcttcactgagggcatctaaaaggtggcagaagtagagcacgctccggttgctcagttgtattttgtatgtccagaatgtgaaaataggcgaagtagctgtaggagacaatgtacttgtaagttgtaactctacagatgtgagagcattctgctgacgaaggacgagcagctgatgactcatcctttgctcatacagatcaaatatccaggaaaggattcccttttctgttctccatgtttcccctgtacttcaatttttgtcatggttactgcatctctggaatcaaacgtttccaattttggaagaaacactggtattttttatttttattttgctctgagcttctgacgtacttcgagcatgctcgattctttgggcaagccaaatgttactgggcatggaagtctgcgtggtgtaatggaagagagacagtttggttctctctctctcgatcaatggatgcttgcatcaccctcggaatcaatggtgtaaagcttcgctttggtcgccctttggacctaagttttggagtttgtcgattctgatagcaaatcaggtctgaaaaaattataatcgcaactgttttaacaaaatcactgccgctgtttcttttttttcgaacacactgccgctgtttctgtaattactgtaacttgttcagatgagaacggtggcgatatcgaacttataaagagtagcacggaaataacgagttgtcgccgggcaaagtccaaatgtatatcgctggagcactgaagatcccttgaagaccagtgactactgaacacttgtgcaaaagagctaagcagaaaaactgaagaactgaagccttggtaaaaaaaaaaacttatgcaaaagagctaagcagaaatactgaagaactgaaccattggtaaaaaaaagaaaacacacaaaaacacttatgcaaaagagctaagcagaaaaactgaagaactgaagccttggtaaaaaaaaaaagaaaaagaaaaagaaaaagtgaagccttggtaaaaaaaaaagaaaaatgcaaaagagctaagcagaaaaactgaagaactaagccttggtaaaaaaaaaaaagaaaagaaaaagtgaagccttggtaaaacaaaaaaaaaaggaaaatgcggtgagcgtggatcgaacacgcgaccttcagatcttcagtctgacgctctcccaactgagctatccccgcccttggttaattaatgatctactacaaatatatctgtatccttaagctatctcatataaacacattttacatatatcttcaagtagattatgtttatgttgcaatgtaattttgtgtttaaaattttattttgagagattgaacaaatcctgccattctgcatgcataatgaccccgtaacttataaacaagaaaagggcaaatcatgtttgatctttttaaaggggaacttacaaaaaccacctcaaatatcacactgagttcgagggaagaggattatctgacttatttccctctgactttgagtcgcttacgtgtggacccactaagtagagggtccatatgtcagtgacacaagttagagggaagtaagttagaggatctcaatccgagttcgagatccctgtaaaaccatttgtagcaatatcctttcccaattgtcactgcttgcacatatgcgatatccatcaatacgatccgatgtctacgctcaagccgaacctgatatgcaaacaaacagggttagcggaatcaggaaatgtagtaattcgagtaagtccaaccttcaaggaagaaggaaggcaatccgtcgcttgtttgttgcaagttctttccttttctctttccttatgtgttatatgacttagcacatcttttgatatacatggactcatcttccggcgacccccatctctaagagctgagactcgtgattaccatcgcccaacaacatgctggatgccagatgccgcaatcgtgccatcgagcctacccaatattactggtgaccacggctccttggctagtactccctccatcccaaaatataataacttttagctctcaagatttgtcccaaaatataacaacttctccaccaacattctcttcccaaccaatcacaactctctaccattcacttttcccatctacttccactactcaactaatcacaaccctccatcattcatttctacccactttattaataactgtgtcctactataaaaatgcttatattttagaatggagggagtagtattcaggtgagcccatgtggggtttgcggctatgagaacgggtgggcataggtgaattaggaggagggagatttgtgataaatcatcttatcgggagtatcgaattgagggtgacatttgggatggttttttaaattttcctttttaaacaagaaatactacgttttaccgttgataagtgattgactctacgaactgctatcaacgaacattaactctacgaaataccattaccaaagtgttttttcttctgtttctgccatcttcattaagtctcccattagatacattccgttaacacgtcatacaaaaaatacattttacctatagaaccatatctcagagtctcagagtaggaagtgcttgatatatttgaaggggtaaaatggaaattttgcataaagttaactaggtgcatttgatactaatgctagtggagttggcatggagaaaaaggaaaaaaaattaaaacactcttatgtgatgttataccataaaactcccgttctcgagtatcaaacattttctcctcataaataggtctataataataatcttatcatctgcaatgcgtcatatgacatagtacaatgtatgccttttgtgcatttctcgaacaccaagcccgtctagctcagtcggtagagcgcaaggctcttaaccttgtggtcgtgggttcgagccccacggtgggcgtccattcctttttttttctctcgtctccactccactggttcggagaaaccccatgcttgagctcgcggacagctcagacggagaagatcctcctcactttcttcagtttcctccggcacaacgggcagctcccgtcctcctctgccaccctgcaaccacagcgtttgcaattttatggtgataaggtttacaaaccctgaggttatcgtaattatcacggacgataaccacggttcatggtaaccacgataaccgttaataacgataatctcacttaggccgagtttagtttcaaacttctaattttttccatacacatgaacttttaactttttcatcgtttcaattttaatcaaacttttaattttagcgtgaactaaacacacccttaaaacagtttagtacctcgtgccgcacgcgtggcaggtggcggagtgcccgcaggggaggaagaagcagtccctccgcgcgtcgcagcacaccacgcataggtgccgcccctcgccgccgccgccgccgccgcctctttcctctacgtcgtcgtcgtcgtcttccccgtcgccgtcgtgcgagacggagtcgtacgacgaccccaggctcgcgtcgtcttcctctttgctcgccgccgccgccgacgacgacgacagcagcgaggctctcgcgtctcctcctccaggcccgggaccgaacagcatgttcagtatatcgtacatgatcagcagtgcaacagccaacagaactgcaattcagagggattaataatttagtgtgcagtcaatcctaccattaatttgagaggttcttcttgtaggtgattattgagttggtacctaatccgatgatgtacactatccagcgaggtccatatgacagcttcacataatgaccatcagaattcagtccctgaatgaaattgtgcactagactagtcagtactgcatccggctaaagtgagcattgtacagtatacgagaggaatctgaagatgacagagaagacgctttttgtcacctctttggggccggatgacagaaccacaacgttttgtcctaaaaacggcagtttgtaagtgcaaagagagctggccggtgagcatgtataatctgctgcgctggtgttgtagaacaaggtcctgattctgaattccagtagcacctgccagatgaaacctctgtaacaaggctgaagatgccacaaaaacattttggaagctctgtcgctcttgacacggggtaatttaccgttacatcctgattgttaaagtttcccaaggcaatgaagtactctgaagagagattgatagtctgcttgattgttccatttcctgtgattacacatcctgatagcattagtatacggattctcccggggtactgcaagtctgcaactgattcttagtcaatgagatcatgcttaccgtgcaccaagtgccaagataatgtggtctcatttgctgatggattctcagcccattgcaagaagctttctttgcctatgaagcagtgaagcaccaacacgcaagaattttaatggtgtcagtgaaactctgttactgatatgaaaaaatcacacttaaacacacttgttcatatatctgaacctttcttacctcgcgcaatgatcatgcagattggacgagacgattcagtttcactcctgacgctgtaagctacttctatctccgatcctctgttaaggaaatacacccattcctgcagcacacaacatggagtatagtaagtagcaactaatcttcaattctgaaaataactgacatgatcatgagttcagagtttcaaacagaatcacacagatgataacgcagcattaccatgtgagaattggctggtacgacggcgcggcgagcctccgaccaagcggctgggacgccgagaggcggagcgaccggcatcccgtagagcaccaacccattctccggcgaccctccctccgtccttgcctgcaagagcgagtgcacacattaaaacactcgtcctgactgagctcgtgcagagctacgggaggatggtcaccttgatgtcctgcgcaaagaacgagttcgtctccacaagcctcgagcaacctgagccgatgacgactagctccggcgagccgtggtaataccccaacatcaacgccgccggcgctgttccatcaatgtaaaggatcaaagcgagttatagcactgagacataggccgtgttcaggtttcccagcacgcaaagtgaagctcgtattattgcatgattaattaagtattaaataatatttttttaaaaaatagattaatatgattttttaaaacaacttttatatagaaagttttttataaatcacaccatttatcaatttgaaaatcgtatgtgcggaaaacgagagaggtgggttagaaaaatgggaggaataacacagccatattatgtgttgtcgatcagagagattcggagtaactgacccaagaaacagaaggcgaggagggtgacaaagcagagcactgccgccgccatgactgtaaagtctgtacccgtcgccggcgctggacagcaagacgacgcgtgagagaagctgtgaatacctgaacggatcacggccgcgggggattttgtggaatcggtgtcttagctgatgtgtcctggttcggtagctggctcgtgctccaactaccattccacctagccgaaagaacagagcagtagttagttgagacttgagacagaactcacagaaggcaattcgacacgagttagcgattgacattaggcttattcattttattaccactttatttgggctttggaagtagagaatagaagtaacctttgacgattagaagtaactatacagtaacggaaaaataactttaaaaaataattacagtattacaagtacattactagaggaaaataactctaaaaaaatagaaataactttacatggtattaaaagtaactttaaaaaatagaagtaactcatgtaagaagtggctacactggtagaggaagtaactctcaagaaaaatataagtaacttttcatgtattaaaagtagctctttgaaaaaaaaatagaattaaacatcctgggaatacctatattgctagatgatttaaaaataagaataaaatttagaagtagttatgatttgtataagtcacttttaggtcttattgaatttactatcataaatatctgagaagtaaattaatcaaatctagaaataatttacaacaaaagtaatttgcgtatataaaaaagtaatttacaacatatatatttatttttatcaaaatataattatgtaagatcttgttataaagatttaattaaagaatacaatgatactatcagagtgtggatccagtatataatttgaaacaaaagtttatttgaggcttagctattatgactattttttctttgttgttgcatacttgcatactcggaaatacatgaatgctaattagacataactaatttcggaaagtgcactcggttaaacatcgtattaattatgaaagcacaagctttgtagtctcgtccatattttttactttgaaatttactttgtgatcacgatcacttgtcgagttgaccccctcatatttaaaatctggcttcaccactgtacatgaacagtgtattttcatgcttaggcatgatttagtttccaactttttctttaaacttttaacttttctatcacatcaaaacttttctacacacaaacttccaatttttccgtcacatcgtttcaatttcaatcaaactttcaattttgatgtgaagttaacacacccttatttcctttaagaagatcatctaacggcttcgatccttgatcctattcagcattgcttcaaatcatttgtgcagaactgctcagctaccactttttgatgaggccttcaaacaactcttgtctaaaagaaaaggagcagctgatggagccgccgtcgccggtgcccaacagtacatccttctaaaatccaggacgacgcatgaagaaatcgaggcaagtttccttagaacacggcaatcatgctgctccgcgagcgcgatgaccttccccactgtgaacgcatcaatgtcgtacctgtcgtcgccgtcgccggctgcttgttcctccatcttcttcttcgtcgtcgtcatcatctccggcaacgagtcggtgtacgcgaagaagagcaacgccttgaacacccgcgcctccatgccgtcgacgcggacgatgccggtgctttggccgacgacgacctccttcgcagtcgttgcgccgaagagctctaggtcgaagacggacgaccgggcgtcgagcacgcaccggtgcgcggcgaacctctcgccgccgacctcgaacaccacgtcggcgccagtttctccgcggaggaggtcgccgaggtgacggtgcaggtcggacggcggcccgtcgacatcgacgctgccgggcgccacttccgccgggcggaactcggtgacgacgacgtcgcatcggacgatgaaggaatcgttcttcagatgcctcctcctcgacctctccaagattctcctcttgacgaaccggctcggcccctcgccgcgctcccgctcgtgaagctcgtcaaagacgacgacggcggcggcggcggcgctggcgcttgctccgcctccttctccgcgtcgccggcgaaccggaaccggtgctgcgcgtacaccggcgcggcgacattctcgtcgaggatgaggtcgaaggagatgtagtcggcgcagccggagttcttgccgttggggtagtaactgatgcgccattgatggcctccgatggcgaacgcgctcgacgtcatgtacactccggtgggtatcggcgtggtggccatgtagccgtcgatcgtgaggaggttgtacccgctcgtgacgttggcttggacgatggaggcggatcgcgacgccatggccggcaaaccttggtgtgttggaaatgcaggtgccttcagtttactactccgtcatcgtatgctgatcggatcagatagttaattaggccctctgatcttgtccgaatctgggtctgtttgtgcatatcgttggatcacgcgtacacaaggacgaagggaagtttggctctgaacgaccaaatgggccgtggaggctaatgagccggatcaagaaacccacaccagcaaattctccctctgttttcgatggttttccctgcatctgtacaactacacatagcagtcaaagaatgactctaaaaaggtgataaaatacaggcggtttcatgcgcctatgaatataacaaaatataatactagctacgattttatccctctaattcatctctgaatatgttaaaaaatatgtaagcaacatccatatctcaaacatagagaaattgttggtagaaactaattaatcaagcacgcaatatgcacaatgataggtccaattcggagcccacatatataacacggctataacactgtacaacgagctgctatctctgtctcaggttataagatattttgactttggtcagaatcaaactacttaatgtattcaactattgattggatgaaactaatttagtactgtaaatattactatatttatctataaacttaatcaaacttaaaatagtttgactttgatcaaagttaaaatgttttataacctgaaacggagggagaagtaactttcagagcatgccaatcaactcctccgtgatgaacgggcagctcctactcaggtggtagaaaccatcagtggctaacaccgccattagattgtctggaaagctgacaaaatctaagcaagcctttatgaggccatgggccatggcaatggtactggtcaaccaacgccatgatggacgccactgtgcccacgtcaatgtacttgcacaacttgctctcgcatatcagcttgagcctctccatgccgtacacttcggctgcgacaagcagacgctggcatatggcttcttcctcctcctttctcatctccggcaacgagtcggtgtacacgaagaagagcagcgtcctgaacacctgcggctccatgtcgtcgatgcggacgacgcatgcggcgtcgccctctttcatcgcgccgaagagctccgccttgaaaaccttggaccgcgccgcgagcacgcaccggtgcgcggcgaatctcaccccgccgccgccgccgacctcgaacgccacatccgcgtccttccctgcacgaattaggatttaggagttcgccgaggtgatggtgcaggtcgggcaatcggggaggcttattagcgacgacaaggctttggggcgccgccgtgtcatcgttgacgacgacgacgacgacgtcgcagcggaggtgaaggaatcgttcttcatatacctcgacttctccaagacttccctctcgatgaacttgcagcaactccgccactccggtcagcgtagttcttgagacacgtcgacggacaaggcggcggcactgggtcagaaatgcccgacatattactacgaatatttggatcacataagtaaacaaagttcctttgtttctgtttcactattctgcttaggaaggtacatgtcatttgctagcacatgtttgcaatttatctcgtatggagcaaatagaaattaacccgaactcttgggttccagagcaccataaacttcattgcatatgtaccgcaatcaatcctccaaatgaaaaatcatatatgggaaattaattattcaaatgggcaaccagtttcatgcacaacataggctaggtccttccatctagtatttgtaaatctattttctaaagctgtgtcgaagcaagatttcagcaataataaaagggggtggctgtcaagctaggaaagtggatgggtttggagacaagaaattttatacaggttcaggccttcttattcaagaagtaataccctactcctgtccggggatgattccgccgagtgtgttattaattgtatagactgggaaaaagaatcgccttccaagaggcacacggaccctccttatataagggaaggagtccgctttacaaaatacagtccatatcctaacggaatatgggattatagataaaatacaatcgtaaccgactaagatcccgggtatttccttgacatacaagtttagaacctaacccgagtattcatagagatattccatctatatttggtaccgtatatccgactaaattacaaccgtcatgtcgatatgggatatccataatctccacagtagcccccgagaccttcgtagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatgtatcaaggacaaaaaatacaagaagggccgagtgataaacactcaaaggtccaaaaatagacatgtttgataggaatccgagtaaaaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaataaagcttacaaaaaaatggtataacacctttctgtcaggcacctttttatgcgcatcataataattccaaagaattattgaatcgcgttaaaaaggattttaacagcattaggccacaccatcgtaaacacaaattgccaaagcaaaaagtgcctaagtccctagagatcacaacagaccacgctgattatagcattgggctgaagtactgtacaggcccaggcccattagtgctcccgataccctaataataccgaagtaaaaaacgtctcttcgtcttccccgccgagactctcgccattttccccatttcctgctacagtgcaaaactacgccgggcaaactagggttcatcaatccgctccaatccacactcaaaaacttcacgaaatttctccctgcatccaccgctccaattccccatccctttccagccgtatctcgaactaaatcagaccatccatttcacattcatggcggaagaaagagaaagcttcgagagtcagtgggcgccctccgatgtgacggaagacaatctgaaggagatggtggcgcacggcgttcttccagcaaaagagatcatcgggtggcgaccggcatttggtgaggcattcccgacctccgatacacacgaaatcgtggtatttgctcatttcttctacggtggattttctcttccaacctcaagatttttccggggaattctgaacttctacgggattagcttgcatcatctgaatccaaactccatagtgcatattgccaattttattcatgcctgcgaagcttttctgggcattaggcctcatttcgccttgttccgctgcatcttcttcctcaagccccaaccaaacaagagtaaaccatgcatcgttgggggtgctggtttccaactcaggggaacactaagccaaaaatacttctccatgcccttcaagacctcaaataaaggctggcacgcaaattggttttatgttcaaaaccccgagcctgttcttctcgagtactcctgtcttcctccagtttatcgggatacttggaactcactgccaatgggagacgaagctgcacaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctacttacacttgttgccagtcgtaccgttcaatgcattcaatcctcctccaccggtacgtattcatacacttcaacctttctcaaaacatgatcttgctttcttgttgaatcagttaacaatgaaggatattacacccaggaatttgctttgatgaagtcggatcccccaatcgctcaacgccgatcgccccgccaccaaactgggcaagggagcggaggaccaagaattcggtctgaaactcaaccaagtgcttctgatccaatcggccagtcagattctcgaaagaggaagctggttctaagtgacgacgaagccgatgataccgccaggaggcctggagaccgagagacaaccaagaaactaccaaagcaggctactccaaggtagaaaacatccagtcgccctgtgccaaagatcaggaagtcttctaggtgcaactcatataacgatctcttttgcattgatgcgcacccattgcggcaataatactgataatcaaatttgcaggaaaccatctgatatagatccgtctgggaaagactctgacccgactaacgtggacacaagttcttccaaagaaaccgagccaactgctgaggatcatctgagtgacaatcaaccggcaaccgataatgtagaatccggtgatcaacccccgactggaatccagtcggccgaagccgaagccggagttaatcaggagcccccgactggaaaccagtcggacgcagggccaagccaagagattccagaagtcgaaacccaagcagacaaccctcgtggacaagacgccagcaatgaccggagatctggatcccctttaaaagtatccgaatccactcgtcctcgtccagaaatcattacaggtaaacactttgtccgaaaccatgttgacccaaataactctgatcgatcgtgtaacctttgtcaatggatgcattaggaccaatgatcggtgatgaagaagaaattccccgtatacaaacagccgaagattcgtgccctcctattctggtcaagtggtgggatgacaacttgcaacctcaaggaattgtaataaaccggcaaaaagaagacgaagaggtatgcctactgaaaaaggcactcaaccaagcgactcgcattgtaaatgtaagttccttgacgcctaacctcagccatcttgtttaccgtctggctcgagcgctgattaaactgctccgcacaggattcatcttaggaacgaggcgaaaaccgcaaccctagagagactagttcctcatcttggaaccctcgaagccaccaggagtcaactgcacgaggccagagaacttaccaagaagaatgaacacgatctgagggatcggattgctgagctccaggagtccaatttcgaactgagtggctcatcaaa

SEQ ID NO: 31189 - DNA, 2449 bp, Oryza sativa
agcttgaaggagccaaggataaagtcgctaatgccgctactccacttatccaggccatgttcttcaataacgccggttcgagtacacttgatgctgccgaaatcttcgacaagctgagagtcgctacagatacttacttcaagaacatcaaagaagctggaagtatgggagcaagtctggcattggcgatgaccaaatccctttatccaagagttgacattgatgccattgatggctttgtagacgggacgagcgaagaagctgctcttgacctcatcagtgatgcgtagaaagcggctgacaagattgctgctgatgtagttgagagattccaagatgtcgaccttcggccaactgggtctgataagtctaatgatgaaaaaactgatactgattgatataacaatgattttgatgatcaatgatggtggaagctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattattatcataatggccccctgactgaaaacttcaaggaaaaacttgaagttagcagtcaaataggaaagatacaagcgaaatgcctaagcataaaatcgacgaaggtgttcaatattccaagaattgttgatgagagtactgtcttcgcgcttgagtcgataagaacctggccgagtgacttcagcaattatgaacggttcttcccataagagagataatttatgccgatcccgtgttgtttgaattttcctcagaaccaggtcgccgactaaaaaggctcgcgatcgaacattccgattatgataacggcgcaatccttgcaaatatcgagtcgactgaattaaaactgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactctgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggaaaaacaactggggtataagc

SEQ ID NO: 31190 - DNA, 4667 bp, Oryza sativa
ttagatcattaatgatcaaataattactgacctgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgcaacacttgaagacacaactcttgaagacgcaactggcactgcattggctcctgtgacgacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgcttgatgttaacttcattgctttcattagtctctgatttgatctcaccaccgatattcaactgttgcgattgtccttggccagcggaaaaaggttcaccaatttggagtggcttgatacgctgcctctggctactaccttgtgcctcctggaaaacagtcattttccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtacactggagcaattccaacttcttctcaatagcgtgtagccaatcacctgcttccactgggttggtagtgctagaaaaggtaggtggcctcacacgaagaaaatcagctagcttgttctgcggcggtggagcattgttgttcccttggttgagctggttctgcatctgctgtatcatcatgttcattaactgagtctgttgagccagaacttgagcaagagttgggttcccttcattgttattgtttccacttcgactggcgcgagtgttcaccatctattgcagattagagaagataggaggagaggggttacactaaagacaagaccttaaccatgttaccactgatctggtgtgtgtagaccattatattgttcaagttgattaagcaagcaacctagtatagttacacactcatcaatgaactactccaatgatggaaatgcaaccatacctacacacaagcaaacaacaaacgttctaccctactaactattcttcaaagacactttggcggcataggttctaaggtaggatccaaacttcattccatcttgaccacttggcacttcagatcgaccatcaccttcttattcatcgatccacttgactgacctccataagtagacctcactggcgtcttcaagtttcaacaactagtttcagaaccacttaagttgaaagcaggaggggagaggatgataaaatgatttatacagaattctagagaaggaagaaaggaaaattttcacaaatcatgttttcagaaaatttgtccttaaggtttgaccatttggcttatcctacagtcgagatggctctgataccaacttgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaa

SEQ ID NO: 31191 - DNA, 8396 bp, Oryza sativa
cgtgggggagtgggaaggagaaagaggcggtattcggttttcgaatcccggccatctcgggcgcgggcgcgaacggaagggataggggaaagggcgcgggaaacgcggcgcacgcgcgggcgtggccaacgtggcccgggagagacggaggcgtgggctcgtcggcggtttcggcgcggcggcgcgccgggatcggcgggaggtgggggaaggacccgacaggtgggccccacctgtcggcgaccccgagagaggaggcgggcggcggctgccaggctgggccctcggcctacggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgataccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaatgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactgttctggttccttgttgcagggaacggaactctctcttcttttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagtcgtgggcctcgattgggttggtggtgcttgagaaagtgggcggcttgacacgaagaaattctaacaatttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcgatcgttgggttctcgggcggtggggacggactgttgtcagatgcaccgttggcacgtgctccattgatcggctcttcgctgccactggcgttgttggagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcattttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggccccgatctacccaagggtagatcgccccgatctacccaagggtagatcggacggcggcgggacctcgcggccggggcgcgcgggcgcggcgcgagacggcggcgaccatggcgccggcggcgcggcgcccacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccgcttgccggcacacgacggggatgggtctccggcggcgaacctcgacggggaaggggcggccgaggtagatctcgaccccgcgaagctaacggcggcgacggcgcgagacggcgacgagcc

SEQ ID NO: 31192 - DNA, 43021 bp, Oryza sativa
  unsure (1)..(43021): unsure at all n locations
ttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaacctgaactaaaatttcatgaagtgcctttttttcaagttcacttagaaacttgtgtaaatattgatcacctaaaatttcatatataagcatgcatatagcattagatgatacatgcctactggataaatagtgaaataatgaaaataagagtaattctgggtttaccagctacacgagctagctgacaccaaaacagaaacatgattaatcggttatcagattagccaagagataaagcaatccaaataaattttaaaaaatgaaaaaaagcaacaaaaacaaaccaatatggccctagggagatccaattgtcagttatatctatctaataacagacacatttttgacaattatgtgatgttgtacagttgcaataccaaaaacagatagagaatttgctggtgaaaaacttgaaacataaattgcaaattgctaatatcagttatgtgattaaatgacaataactagtggaaattgaatagcattgctgacagataacaattgtgttactgatcaaatggcaagattatagatagagaaaaaaaacagagactaagtatgacatacttctgcatctaggatattatcatacatagagagctttcagaataatcttgcaggtgtaaaattattgaaccaacaagatggaacattcaatcttgcagatcttgtgattctgacaagtaatcctacttctgtgacgctagaaccttgaggacagcctcatccgccagagcactgtagttcggtttcactgtagttcagcttcaggttgtcgtaatcctgtgttgtcatggtggctgcaaattttcctgggcccttagagaaattcgaagcatgcagcgttcttcaagccggagcatccgtgttgctaggccaagattaggatgctcaccacgctggccacctcgatatgtttacaaagaagggcttctcatagcagcctccatcctgtatcgatcgggccgcgatgaggagatgctcggccatggcgcgtccctcctcgcgcctgctgcatctgcggcggcaatgagtctatgtaatagtgttattacagtgcgacacagctaggatgtaatggaagatggagcctcgaagtattgagcccgaggtccgccaattaattattttgaaatggtccattaattggagtcagactgccaatttatatatatgttgggctgagttacacctcagcaatagcccaatccgattttttttttcgtttcactccttggcaaagtaactcgcaacccattggcagtgatcaagagttcatgactttttgcatttaggttccagagttttcatgttttggttgcatttagattcctgtgcgtgcttagcctaaatatgtactctccttgccttttgtcactcctccgacggtcacaagctgccaccttgcctcaccatgaacctcctccctgcacgaactcctctccagtctccactccgccgaaagcacaacctctcaaatcgtgtttaatttcccgctgaatgtacgttgctgcaacaatagcaaaaaagttcccgctagatgcacgcctgctaaatgcaacggtttgttgggacacaggtcaagattctgataagcagttgatgaatagtcaatagataagaatataagcattatcgatttttagcttctactttactttctgcattagctagaggtgctagacaactagagaaatcggagcatgagacgccccaaataaatagcttcaatatgcgtttcacaagtagttaaagtggtttatgtgaggttgtcgtccaatccagtttcattattggaggtcaatttgaggtgttagacaagttcatgcatgtgaggaggaaagtgcaaggtgaattggatagaagcatacccaccaaccgagtatatgggggcatcagatccagcacctcgagaaatcttccagagcgatgcgcctgagatggttatgacacgaaaggagatctccgaaaaaatcataagtgggatcacaaacaccatgagaagatgctgacatgctcttgttcgctgcgaccaccagcggacgtgggtataatctgtttatgggatttggcatggttgtaaggatagaggcgaaagaatataacaccaaaggtccacgcaatttccagaaagaaaaacagaacacataaacaagaccacataaggcagcgtgtgacagcaagatcttgacatgcgaatgaatgaatgcatgatagctaacttgctagatcaacttgtaaacttatggaatgtagtacaagaggtgcagctcatccccgatgatatggacaaaaaaaacttggaaactcacaagtcatgaggaatacatgacggcaactgcctacaaaacataatttaccaaccccccccccaaaaaaaaaaggcgtttgcctagctagtaatacaaaactaaatctgaacatcagacaaagtatcaatctgagaatggacaaacaacacatactgccctctttgccccctacgttagaaacatccttccatctactcacgaatgtagatacacgaggaaaatctaagacatgctgacaacctagatctcgtgggaacaactcgaacaagtgaagcctattcattgaaaaacatgtacaaacatacatgagtggtgggaggcgctcgcaacttgccttggggaacccaagcaaggagtttgctccctcaccctcctaacaaacttaggaactatggaaggaaaatatccataataacctccgttgaaaatcaaggaaaaagcaataacttagacttttgcaggggtgaagcgtcaagctagcatagattttactctaagcccttccttgtacaacccttgtttttcatacttgtacaatataaatttttacatgtgttatatatcagtaaaagttgtcactaaattttactattagagttatcgcacgaatcatgcaatttttttcttgcagcacaatggctgagttgaatgctgcaagcttgcaacacaacatgtaaaacttggaagtggatttttatccctcgagagaacatcacatatgttttgtgcatgtcgttcaaaaagttatcagaaaatttaaaaaaatttatcaagatagataatatatgatatatcttttcgcaaacatgcgagttaaaattcgacttatacaattcgaaacaaaaataacaaatttgaccgtaaattacgtgttatattcatagtcaaacttgtttttttttctacttgggccgagtttagttccaaaatttttcttcaaacttccaacttttccattacatcaaaactttcctacacacaaactttcaacttttccgtcacatcgttccaatttcaaccaaacttccaattttggcgtgaactaaacacacccttgtataagttgaatttgaatttgtatgtatgtgaagtgatatatcacatatttatctatcctgctaattttttttaatttttaaattttttgatgactttttgagtgcatgtaaaaatgagaggatatccttaagggatgaattaagttttccgtaaaactccaggtatgaacggcttggatgccggccaaaccaaaccgtcgttgttcgtgtgctgttttgcagccgctgtacgagatggccttttcactttccagcataaatagaagccgtcaaatgccggcgtgcgccagtgcgtcgtcggacggcaaccccccgaaagcaacgtcactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggcaggagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaaatctagtttcgacagtcaccgactgacagacagcgccgtgttgcagtgcagctgctgtgcgatcgatcgaggtggtgagaccctcccatccccgccacctcgcagccaccgggccgcccgcccggccgcgccccccgatccctttctccctcatcatttcgcgtctcgcgcgcagccgcgctcctgcaagcaacgtaacgcaacgcgcgccgcgaccgaaccacctaactggccacgcgcgcgcgcgcccgcccgcgccgcgtcggcctctccgaaccgcgcacacaaaactgctcgattattgtgagaccgcgagagcaagcgagcgatcgatcgatcagccagccaaccagcccgtcacgttcggaaaaacgggttaggtgccgcgcggccgcgcgcccccggcggattcgtggaaggaatcgcaccggagattaaaagaaaaaaaaaacgagcttcagaggaaaagacgtcctttcaaacattcttaagaaaagaatgtgagcatattgagaattagtaacattgaatattgggttacaattacacatatcttactacactatctggtacatctccgtaccggggattcatcatgcacgattcctcacttctctcctgccagccatcgcggcgccacagaatcgctgctccgtctcggtgttctgcctcctgtccatagagctagccagcccacgattttctgcctgcaccgattcgcgtgtttttggatactgatcatgtgtgcgatcgacaatcacccggctaaacctgtcatcataactgtgcctcgcacactcgggagactttcttccagcgtacgtagaattgtcctgcgtctcctgcccgcccatggaacgaagtacaacttgcgagagctcttgagaccataattaaccatgattagtcaaaggcaataattcgtgacactaatttcgcttcgtcgatgcgtggcaccgagtggccggcgattggctcggagtaaatgcgaggcaattgatgggttccttcttccctgcagtggtcctggctgaagaaaagggttcttgctgtttgctcttgtggctgctgtgacactgtaggtccgagagaacaatcataggtaaattgtctgcttcatgcatgataactcatgaattatggagttttgatcgacgtaaagggaaaaagatatgattattgccaacctggaattcgttcttatcggcacggattgagaagcctgaaggaacaggaatggaatactgtcaggttttgatgcgcattctaatgaaatattcaggtgaggtttgtaggtcggaattacttatgccgaagtaataatcgacaagtactgaaaaatgtacgcagaatatagatcacagttgaaacgagaatgatataccgtctgggctctgcattttcagacggaattttctgtgctgtatctgaaagcaaaagcaacagcctcatttaaactgtgaaagttaagcagacgacattcagagaagctgtcaattccatcatttcttcaagaggggggcaaactaatagtgccgtgaactttcagcttgtcataatgggaactaagctgaaattccctggtaattgcacagcttgattaaattttatataaaagtagaattgtatttgatatacaactcttgtttttttagttttataaatacaagtagattttgcatacaccatgatgatactaggattaaatggtacaaacatttctcttattctccaattaacgtggtactccctctgttttaaaaacggcgatagtaattttaggcccctcagagtaacagataggtaaattaaaggaagccactcatagttgcatacttgcactagtaatctccataagagcgaattttagattgaattatttgatgagctaagttcttaatttaaaagacagtatatatctacccttctctacaaataaattgcactagtaacaagtaacagcaatacatacttttccaatgattgagaagggcagatccaaattattaagacaatgactacaaaaaattgacattacattttcatgaaaaattttttgacaatgtcaaatctcacgtgccataactatttacttccatttataaaacaccaggcttcatatttttttcaaacaggtaggaaaaacagtattattgcattcatatttaaatataaatatataacagtaattttacttttcaccaccttttattactgacattttgctttggattaccgtttaacaaatattttgaactttggattaggtaatcttaccttcgttacactctgggccatattgactcacttctcaagcatataaacgatttcgaatacgtcggctcttactcgtcaatgaactcctatagccgtatgagagataatttctttactataatacaaactggatatatatatatatatatatatatatatatatatatatatatatatatatatatatatatatatatataaagagttaagggtgatccaaagtgccacaaaaggtaaaattatccggtttaaagtgaaaacattggtaaatgatggttcaaagtaaaacattgataataaaagtggccccaaagcgaaattcattcaatatatgatgatgttaatgtcatttggtatgtggcaagcaacttatttgaccactccttttcaattagaataaaacgataatgtctaacaaaattataatattgaaaagtacttatagagataaatctaccatattatttatatgtttttaaactaaatattttgagagctgttgattatcaaagttttaaaaatttaaccaaattagtcaatagtgtcacatatttaaatacaggagtagtatttacccggttgatgcgtgtagatcgacatccctaaagagaaagttcattccaatttgtggtaccgtaattaaggcaaataacatcacagaaatgggagaggatgcatgttcaagatgatagctaccctgatatatcaatctagttttccttatcggttatcatttcgggtaagctaccaacaacatctcttttcttttggagtatgctactaggaacaacctatgatgtatagtttgatgcatatgtatatacacagtggactaagagcatccccagcagctcttctatctagtcatccatccgatatttggagtatggaggagaaaaacaatgctccagcagagtctccatcatcatatgctctatttttggaggtcctccaaacctagcccttcctaagctaaatatggagctctctctcctcacttcatcctcaactacccactccctaagatcttttttaagtggtgaaaggtgagaggaataggagtaaaaatgtgtggtagttaaaaaatattagtaaaatataggatgttggtatatgtgggatgtaatatgaatgatctgttggagtaaaaagttatatagagtgagaatctttttggatggccatctaaatgagagtatggaggataaaatttagatgagctgctgggatgctctaaccttctcattttctctccactcttgtgaagtccgacagaagtttcggtgcaaaatttgaagggacaattcggcaaactcaacgtatcctatacgcatttgcaccgattaaaaagagaagtaatttggggcatagacttcgctgtcctagtcttcggtctgatgttaccgctgtaaacatcgaaatttataagtgacaattgacatgccgatcacactgaatttcttcctacatttctactagctaggatggcagaaaaagttcagaaaatcctgaattcttcctacagttctactgggagcagggtttcgatttcgaaattggattttatgcctggggtgaccgaaatgtaatttcagaaatttctggccaaaattatttgaaatttgactgaatttaaataaaatttgatcaaattcacaaaaaatgtaaaaaaactaaaaatttcggacgagaattgagcatgccggtggggggcgaaatttcaaaccctgactgggagtataggcagtataggacaagttcagaaaatcgttgaattcatcctactgttctactgggagtgtagctgtttagcactagttcagaaaatcttggattcttcctacaattccactgagagtgtaggacaagttcagaacatgtttgctctcaaaatatatgcatctcaaaatcaaatataccaactcgatcacactcgatcgtatcaagaattaacaggaaagagaaaaacttgaagcatgcgcacaattttcgtctctatgtatgtactctgcaataatccatgcgttcatgaactattcacatggtgccgtactgatccgtactgactatctaacgaagtagtaggtgctccgctccttggcggcggcggcggcggcgcgctgctgctgctgcatgcgcagctgctcgtggaaccacatgatgaactcgtcggcgcggcggtccaccacgccgagcctcccctcttcgtcgtcgtcgccgtccgcctcccacgccgggaacggcgagtccgtgatccgcacctgccgcggcgccggcaccaccaccgcgggccacgcgaccacgtcgccgtcttcgtcgtcgatatccgtcgtcatcgcctcggcggcggcctcctccttcacgtccatcagctcgaacagcctcgacaccgtggcggccgagccgtacggatccgcggcggacgaacggtcgtgccactgcccgtgctgctgcaggcgcagctggctgcggcgctgcgcgcggcggcgcctgtgcagcggcgtgctgctgcagctgaactcgacctcacggggccggtactggtactgcgacacggcggcggagggatccatggaccggcacgacatcgaggagagcccggaaacgcctcccgacgcgctgctgatgccgccgccgctgcgacggcggccagcgccgtgcgcgccgcggccccgcgggtacgggtgcaccgccgcggccgggtccatggacctgcacgacatcgtcgacgacaggtacgtcagcaacgccgggtgctcccgcaaatcgtcgaggccgtggtcgtggccaccgccgccatgccgcctcgaggacatcatctggtgcaggtggacgccgagcgcggcgagcttgggctggtgcttgccgagccccttgacgaggacgaggtacacggcgcgcaccacgcgacacagcttcttggcgctctcgcccgcggtggccgcctgcctctcctgatgatgctggaaccaccggactccatggcggcgtgctcgntggtgctcatctcgatcgaaaaaatatgtgtctcttctcttgtttttagaaaattccggtgatctcagctgcgatctcctggaccagctactcctctctctctttctctctgtgttcttcgcaaccaatgaggcttattatcagagaggagacgagagggagaggtatttaaagggggccagatcactagctgggcattcatgccaaagggaaattattggtgtacgtatcgtcttcgtattgtccctttcgtgtttcggacacatgcctgcttttttttttcgtgacgcgttcagttttgatcagtgtgatttagttggtggttttcttggtttattactggagctaactaaggcactatttagatcccgcccaaaaatttttaccctatcacatcgaacatttaaacacatgtatgaagtattaaatataggttaaaaaataactaattgtgtagattgcgactaatttacgagacaaatcttttaagcctaattacttcatgatttaataatgtggtgctacagaacatttgctaatgatagattaattaggcttaataaatttatctcgtggtttactgacggattatgtaattagtttttttattagtatcagaacacctcatgtgacattaatataatacctgatatgacatgctaaagctttacaccgttagatctaactaccccctaagctctaagcttgccgtgtccagaccggatctgataggtacgggcagtatatagatagctgcttttaaattacctttctggagacgctttcagaggtttaccaattgggttaatccgagtgtttaagtagtaaaacacgtgcatatatggcacttgcatatactgtacgcggcgataatcagttaagagagttgttgaatgacctgcgtagctgctccattttagtattactcttttccggttgataatatttgtcccggagaaaatattaagttattgcagaaacattgtcctaaggattttggttaggaagttgacaaatacaatgccaaccgctcgattatcatggctattggacttattgatccagtatatatcaattgagaaaccgttcgataaactcgtcaatttaaaaataatcaaactaaagttcaaatttgtggtaaaatctgtttgagtttaaccggttgctgtgaccgaacgattttctaatccatgttgtccagttgcatgtttatcaatgtcatacacctcaaataaccgcttaccatttttttcggccagatgtatatgactgtactaccatttttatttgttactactactagtttgcatagtgctcatttaggtaagtacttattttttttaaaaaaatgaagtcaatagagaaacaaataaagtggtccctttcatggttccatcatcaagctctaattaggtttagacatttggaaagctttttagtgttaagacaattagttaggatcttcttttagtgtcggacatgctggttgaagggaagaaattgtctagaaaatactcaatcattgcttgttttgggcccatagaagaaagggcaaatgaacttttcattaaaactggtgtcattagtccatacggacgggatcataatgaagaattgatgccgtattcaaccctgaaagaacagctccatgaacactcggcaaaccagtgataagatgggatcttaatattaaagacatttttgtcaaaatataatgaggaagcgttactaaaaaagaatatcaaggatgtctttttctgtctttcatgaattacaagtggaattttgatgtcaccagctggacaaatcaagtcactgttcattattgaaaaggttatatatatatatggactgcaatttcataacaggaaggagtccataggctgctgctaagggcctgttcactttgataccattttcaatattaccaaattttagtaaagttattaaaaaatggctatatttagtttgctgtcaaattttggtaactatataagaaatcctgccaaaattttggtaagtcattgccaaaatttgataaggtttttttttggcaccaaagtgaacatgccctaagtttgatatcactgtccaaatttaatgaggccccaccaattatcactgtccagctcgagcaaacagctactagtactcagctagcaaatgaacggcatttccatggtttagtattcggtatgaattaacttgtcattaatctggtctatccatggactgtttaacacttgcaagaaatagcaccatttactgcttttactgtgtattttccgggcctaattaaatactccagtacacgccacattgagatatttctaatccctgggatgtcccctgtacgttcccacttctcacatatagcacacaagggacaaaaagacctgttggctgtttgagtgtgttgataaagtttatgttttaaatttcataagatgtagtatatataatgtgccaatacgttgccccctttttttggtaaaatttagctatttttctggtgcaaggagtaggctgaatatctttgtaaatgattagaattttttttctttgacatggcttttgttttgattatgctcttctccatgagagagagagagagagagagagaagttacgtttgctcctaaattttgccgattctacaacaacatatagagagtatatagaaatcagaaaaatcacaattaagaagcaaaatttaaaacggccttccagtattttcaggggaaaaaacgaactctaatgaaattctccatcgacaacactcttacttgaaatatttatctgctttattaacaagttaagttgttatgcgactcaagagtgtactagagcaggttttcagttaatcacttggactaattccttcagtcacgatcagttttcatgcattatgcgtgtagtcttgggcaaaaagcgctatgtatttaagtccaaatttcaaataattagtactagtaagcattatacgtcttcatcagtgttgatcaaccggacgcgttgaatacttaaccaagatatttcctaattgacatttaaggctcggccatggacctagaaatgtgaccggtggttgatccactgcctgttgcagtaatcagcaggagatttagatagtgtttctccatgtgcctaacccgactacctacataagcctaacttagatacagtgtattaattaattactgtatatgtgtatttgttcggcaacgaattcagctaccagcttatcccacgtatctatcttgctgctgtgttttcagacacctaataattaaattgttagtccctagtaactattggatcataccaagttaaaaggttcgatgtgttttcgcctggttaaaagtatacccgtctggtttacttctttggagagactggttttggcgtggctcgttgagtcgttgacctgcagccaggtctactaaaccgttttaaagggtacagttatcatcacctcacgatttaacagtcaccctaaaataccgtgatgtagttttaaaatctgaaaagaatatatatagtaaatgatgcctgcatgagctcacgtcgatcttaacacggaacccaggggctcttgcctcttggtcgacgatcaagttttgcgatcgctggacgcatggcaggttgggcagcggagtcgccgaagtgaagcaatcgccgtgtgttggagacgcaggcgagtcgtcgtcgtcgtcgtcgccgcgccggatgagtcgactagctggcggctagcggctgcatagaaccaacgttgttcgggacttcgggccggtgactgaaggacgtgatcacgcgggtggtggataaacgggccgaggagattggtacatgggccgtagatgaattctgggctggaggccgcagctgaatatataagcccataaaatgccttcgtttcagcgggacgaccaatcaagggctttgacggttgttaattaaggaactatactagtactactctatgctgtgttgagtgtgattctttttattacacgaaacacgcatacgatacgcacgtacgatacatcatactccctccgtttcgaaatgtttgacaccgttaactttttagcacatgtttaaccgttgtgaaatatgtaaaattatatgcctatataaaaatatatttaacaatgaaacaaatgatagaaaaagaattaataattacttaaattttttgaataagacgaaagaacaaatatgtttaaaaaagtcaatggtatcaaatattttaaaacggaggtagtattttcgcgagtgcagcccctaacagatacttagaaaacatatgaagaccctgtaaaacacgtttagttaaacagaaactaacgacatacccctagtccattaaatttctaatcaaagctcacgtgtgcgtgtagtattatttatgggcatcagagtttagctttcgatcggtgaagtcatgtctccacgactcagtcgactctaccactacacctccgacgcttcctcgtgttaagtgtgattttaaatagcaaccgggttagcttggcttagcttattgtgtattaatgtattatgcgattaattggtcaattttttcaatacaataatttgagaaactatcgacgtaccttttgcatgaaaccactctcgtttcagtcacttttaaaaggctcggatcgtgttaacatttgtgtaaacataataaccttgccattttattcccctcccccttctcttgctcgcctcctccaccgccgctcccacctccccaccctcaccaataccagaagacgccaacagtagtaaagccccactagccattcttctccctctccccctcactatctctcctaagccacgaggcgatggggtaccccagtcccactgtcttccacatctctaatggctctcttgcccatcagagacctcgtcgcctcccctgcctccaaactactcaggatgtagcacacccaccgtcaaccacatccaccaccgtcctccaaccccatggctcccccgccacctcccgtcaccttgtccccacctccccagtcgtggtcaccgctgccaccgctccctaccatggaactagtgggtgaagaagatatggaagccctcccggccgtgaccggccccagcgccaatggcgaggtgaccgtggaggagtggcagtggtgaggcacctcctcgcacgctccaagccacaatgaccaccataatccgtgaacttcttgagaggaggaggaggtgcacgcgaatggagaggagggtgaggagaacggactgacgggggtggggggaaggagagggggagcccgagggatcaaggacgggaggggagaaccgaagaagggggaggaaggtgcgagcggacggagttttttatgaggtgggggctcggcttggctctgtcagttttaattggtgctggtgttcttttaaaaaagagcaccaataatgttagttctttagaaaattggtatctataatctactataggtgtcggttcttttaagaaaatgtagctacagtattggtgtcggtttttcctttagaaccaatacctatagtgttcaaaggtatcggttctatatttctttatcactcgaagatgggaaaaggtccaatgaactggcacctatactcaagccgatacctaacctatactcaaatcgatacctataagggattctgtagtagtggattcacgggttgactcacttacccactgagatatcgataaagtataggcatcataatacataatcgacgaatcgaactaccaattgagttcctcccgtacatctgatgatctgaactgaacattttattattaggtatatagtattatgagattgtttagcttttggatgactactgtaactcgtcacctgaatcgaaaaagtttttcatccctcaaggggatatcttctcgtttcatgcatgccacctaaatagtaataaaagtatgaaaaagttgataggatggataaatatgatatatatcactacataaacatgcaagttaaaattctactttaacaatttgtaaaaaaataataaatataaatgcgaatgcatgataattactttaaattttcctttgttgcaacttgcagaaatcgaatttgacattgtatatttgtagagtgatatatttcatatcaatctatgttgtcttttttttgttatttttttaataactatttagatgctctaaaacttcttatattttagaacggaaggagtagtttgtaagtaacgaggggacgtcgccactacggatgaaaatccacatatatccaccttaatcaaatataattggctcctggcagagttgtttcaggctttgtaaaggaggggtcctctgatactcccctctcgccgtcgcagttatatcagtgatgaaaacgtaagtctctttatgcaaaaaccatgagcctaagcgtacggtggacactgcttacatcgtacacggagccgcatgcaagcacaagctagccacgcaacttggctcatcacaagaacttgtaactatacatcgacatagatgtgcccaccaccttaatccaattattccaatacaccatgtacaccactgatgatcacgtatgaccgtatatataaatatcacgtcaaatgcctgcaggctgcagcagcatctttcagtcactatatatgtatactactactctataataacttgttatatatacatatatacatgcataaatgcgtacatatgtacagatatatgcgtaaaagtatactactacgtaggacctgtataaggatgtgcatgcatgatcgctcgcgtgggcacgcgtacacgtatacgtatacgtaggcaatccgatcgttagacgtaggggagggcgcagctggtggagcgggccatggtggcggcgccggcgccggagcaggcggaggggatgacgtcggcgccggtggccgtggcgcggtgctggcagctcttgcgggcgatgtcgcgcatggagcttgcgagggagagcttggggttgaggcggacggtggagttgaagcgctcgcagagcgcggcgtgcgcgtcgacggcgccgtccacggtgagcgccggctcccgcttctgccgctccttgacggcctccgagcacagcccgcacacccacttcccgtggaagcgctcccgcacccgcccgatgtacctcggcgtgcactcctccgccatcccgcagcactcgcaccgcacgctccgagcctcctgatccgcccccgccgccatcccgccgccgccgtccgagttcgacctctgcagcgccgccgcgccctgcatgcaaaccacgcaaaaagacgtaaatattagagaagaactaatatcaaataattaaaaggaggcttcgaatccaaatcatttagcccaccgccctaaaaagctagccgaaagatttcttgatatttctccatatataaaccacgtagagcacccatccgtcaccatgacataaattccatcgtatttatagacacaactgcgtgtacacgtctataggtgggtcggccgtcgccggcctagctccctccttgtcacgtacgtatagcagtcaccattcatcaccaacctcactaattacaagtacacagagcgagcccatcacaggtgattgtttacttgccattctgattgatggacctatcagcactaattctttgatgatagaaaggcagttttcacatactagctttaattaacaccaagtaacacagtataatgatggattatacgtgcagatcaatgatagctcgaatttgaagagggtcattagagcaggcacaatagcaggctataagccatctagaaacatattttatgagataatagaggagagagaagagcagcgggctagaaatctgtagccagctgcagcacggacttcaaaacatggtgtgtgtatgacaggtgggactatgtattaatagtatagtaaacaactattatatgaattgactattagattggctatagataaattagagttactagtgagctatactgttgaacttctcttaccgtggggggctcagcctgctgcctagccatagccaaacgccaaggcatctcgccctctctctctctctctctctctctctctcgaactttcctttcctaaataaagctactttaatcacctgctaatcaatgagctaagctgtctaatgtgtgtgcacaccaatcgcaagctgctaggcctaccacctggccctatttataggcacgagccgcccgaagcaatcgaggtctcgggttggtccggctcaggtccagtgtgcgcgcacagtgtctctcactggataaaatctccccacgaaaaccaatccatcttcgccaaaggggacgaaccacacccgcgccgtcgagctcgagagcaacttgggggatggatggccaatgtcaggttaaaagttcgcggaaaaaagcgatcaaaatatctccatgctgcatgatttcgcctgatctgtgttgcggtttttttcccagaaaagtgcaccggatcgatccagcacaggagcggatcttttcaagcggccaaatgggcagccaagcaggttaactttctcgtcgattaattttactgctactgttgcatggagtacgattcaggataccagcaactgtcacatacagcagcgtgcacgcacataatcgtctctaccctaaatggtcgatctgttcatccatgcatccaattaagtaagtggcaaaaaggatttattaatgtctgaacacatttatcttgattcttttcggattacggtttcatctgcagagatcgactgcacgcacacgcttgcacatggtgcggcggattggatggggatcgattgatcaagcgggttgtcgaaatcaaattaatcgcgcgcgcgcgcctgtgagcagctcacgggatgcgcatcgcggccgccatcgacagagctccatcgcctaacctcatctccggcaacatgacgactacttttcctctttttcgcctccctttcgggtgcgggtcatcgctcgccggcgtacatcattcgatcgtccgcatgtcgccggtgatttcacctccggcgccgtacgcctagctgaggcgattcaggtgagtgtgtcccaagtggatattgaaccccagcaattggtgatactaactaataattagatatctaaataaagcgtaggttgctgcgcaagatctgcgtgctctttcttgcatgtggagagatcgatcgatatatacctgcgtatgtgcctcactttactagctagctatacgtctcagtactttcgtacgtagtatgtaggtagcacgacatattagcaatgtgtgttgacgatggtccgatatatatatatatatatatatatatatatatatatatatatatttttccattgttagatgtggcaaataactatttaccacatggattcacatgtcatagacacatgacatgaggatccacatgtcattaacacatgtgtggcaaaatagttaaacgccaaatctaagagtgataaatagttaaatgtcccgtaacttctattaattataaaatcaatctatctattgaaagatagtaatatagtgaaagttaaaatttgatggtcaacggtgacaactgacaagcaaatgaaggcggttggagtaattttgtgtaaatactcacatatatgccgtagattctttttttgcaaaagaagataactgtgttgcttaaggagtagcctcatatgatttttttttttgttaaggagttgaatccctgtactcatagcttactgcttcaaaccattatctttttcttgtagcactttagttagttttgttttgttgcagatatatggttcactcttgtagcgatggtgtgtggtcgttagtatcggatctcaatatggttattagctgttgtcgatttctgtagtcgacagagaggtttgtgagcagtatttggtagtgggtttaaggttattgtgggcacttgactaactagacaaagaacacaaagattttttacacaggattagacctcctgaatgataatacggctactcctatcgaaatgtattgagagggaaaaaggattacactttgctcatgcaaggatgttatgcctctctctctctctcatgtgcaaaagcacctattattgcgccacaccaatgctagcgtcgttttatttacattatcctaccttcttcaccttctatcatatcgacaggcgtactgcttccaggcgtctctaactagtcattgtctcgagttgtgttgtacgggacatttgctttcccatctaactggacaggggcaggtaatgatgtatgttatgggtacacgggatatgcttgatcacctgtattttatgtgagaagacttgtgatagacatacgtatttattgtggaatgacaggatgcttaagtgtacattacattctatactcatgtcttgaccaagggacctatagagagacggtgaacaccactactagtagtcgcgaagaccactggagatcagcaaagactattagagatcactgccagcaacgcagagaccatcggagattagagggaccaccgccatagtcactgagatcactgctagtggccacatagaccactttcatgtccacgaagaccattagtttattagcaaatcctgcctattccgagaagagtaggaggcgcatagggcatcttctcacccatgaccctagtagttgtttcgaagattatcaatctcactctatgtagaaaagatataggagcaaaaaatgtggcatgcatgctttaaattaaaatacaatatacacttatgcaccagggatggtaactaatggctgtcaaagttttcttcattgtttaaagaaaatagaaaagacaaataaaaggttgtttcaaatgaaaagtcaaactaattaaggtggtggatatgaattggagcatgaaacttttgttcttgtcacaaaagtacggcccattctcaagtgctcaaatttaggcacttctgtatgcaactttacagtatttttttataagatacggtttaatttacataggaataggaaaaactccggtgtttcaaagcagaccttcaattaggaacatgtttgtttttgccattgcatccatgttccatctgttacctccttgcaacttaaaaaacgacaaaataatccattggcaaaaaagtaactgttcctaggtagcaagaagaaaaatcatcggaatatgaaagttacacgcaatgtacaacttacagcagcatgtataataaaaccaacatgatctagtaattctatactaaaataggaaagtacaatatacagcatgtacaagacttataacgtgaacctgttcaccacttacattaccatcacacacactgactcacacagttatacagctcatgaacaattaaaacttgatgcatgcagcagtgtactaacttgacaaataatgcaagtgcctctctgccgttgtgtcacctactcgcctgcattctagtacaagtctacaagatttctactgtacatgtactccctggagcagctgtgccagtgttggttcattatgttgttgctagcaggaacaaaaatgtgttgtgttgatcaatgttcccggcaccacttttatcgcgatgacacctgcaggtataggctgcagtatgcatgcgacggtagtaattaaggccctgtatagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacaataaacattctctaattatagattaattaggcttaaaaaatttgtctcgtgaattaacttttatttatgtaattagttttgtaagtagtctatatttaatactctaaattagtgtctaaagacagggactaaagttaagtccctggatctaaacaccacctaaaggctgcacacaattcatgtcttgctgttgcaagctcattcttcagttctgagttctctggctcgcacatggtaagcatgcgcatgggatactaagcttggcatcatgccatctaaataagtacgcggagaaatgatatgtagatggaaagaacatacctcttccagaatggtgctaaataaaaagaggaaagtagcacacacacaaaacacctgagatagataggacatacacatcggaaagataggttcgcccataggaaagacaataccgctctaaacaagttaggtttgtgatgtattccgtccatggtattttgatcatctaaaaggtatcatgttaaggtctaaaagtcgagctatagtcttgtcaatgttgagttgaaatcaacggtcaataaaaaagtagacaacttgtcccacacaagttgagataagacacatcttcgatatcatccttatgaatgataggtgtttttagcggctatgatattgatagtgttggccgacctaataattatatatatgatcgacctacttatcaagcaaagaatatgtgggtccgtgacatgtatgaatctgacaggtacttttgtcataaatagacttggatacgatacgtgtctttatttaacaagcggctgatatttcaacgtacaaaacataaagtgtagagtagaatcacgagaagtatgaagtggaaaatataacaccctccttacaattactttttttttctttctgcaggttgtcacatgatataatatatgtttcaagcatctacaaaggctacaaccctcggggtaaagaacccattgtcagtaaacggagtacaaccccgttacagagccataggagtcataaaaccgccgagataatacagaaatgggctttctgcacctgggcctgaatcagaagccagaagaaaggctgtgcgcagatggagaaactaaaaactttgtagtgtactgtgtgggctatgacagcctctcacagcaaattcgcagtatctcaataccaaagacattgccgtggcccaggttttagacattgccgtgacattgatcgttatcgctaaaaagaagaaaaaaaacggacaactccatttactccttacctttctcggttcacatgcggatctaccaacgacagcgaggaccctggttaactgttcgtgcctgctgcaaatactcctcgcctactcggtcttgttgctccatcaggtgatcccatggagtggcagaagaaatgagaagcaacacgctgctcctgctggccggttcagtggacgtacgacgcaaccacgtaccggtgattactgtacgtatatatgcgtagtaaatgccttcacgaaggcacggcaaggtggcacgggaaagatcaaccagtgtcacgaacgccggtgcaactaggcggcagtagctgcctgcgcgcagcaacccagtcagtcagtcaccgcgcgtggcgtgacacggtgtacgtgctcggttgcggccgtagctcatggggttcttgccggcccccggccgtcgcgtgcacgcgcgcgcggcggcagacgcctcgatcatcgatcattcatccgtcgacggcgacacacggccgcccggcctgcgctgccacacgcgcgcggtgcccggccgactgtgacgcgtgtggattgggcacgcgaggcgaaacgtaaggtggaacgcgccgcgtgtgcgtgcgcgcgcgggggacgcagcgcagcccgggccacttggccgagccgcgcgtcccacttgggcacttggcacagccgcgcgcgtgttggagagttggacgccgccgtttcacgggcgacgggcgcaagcgggcaatttgaatatttgatggtgcgaagcactgttgcgtacgtatatatgcgcggctcagaggctgtttgcgcgcgcggaattacatatgtttccatctggaaaggataactatgtactagatcgagtatcagtgagaggatacgtactcttctgctgcttcctggtgtatatgtcctgtgttgccgccttgccgggccaactgttatcgtactgtagtctgtggaatgtactccgtacattcatcagagcaggtacaatagcagcagactattagccagctataaacatattttaatgagataaaatatgaaagataagagcatcgggctacagatctatagccagctgcagcacggacttcaagacacaatgtgtgtgtgacaaatgggactatatattaatagtatagtaagcaattattgtatgaattggctattagagcacccgcaatggtaaaagaaggtctcagtaatagactagattaatagtaaaccacctcaatagtatgtctacataggtatctatagctctatcatgcattgccttgtttttctctatagactatctctaagttagtagatagctttgctctctttcttcatttaatatctttcaagtagaaaaatatgctgacatggatctcttgtagagagcttatagataaccattgtggatattcttagattggctatagatgaattggagctagtagtaggctatactattaaacttgctctcagtgtttaattccggggagataaaagctggaaccgtactggttactggtttgtagaccagattcatcaacttgcttgctgcatggcagtaagccagtaattaatggacgttaatgtgttgctcatcgcttactctaccaccttgctattcccaggctccccgctatggatcatgcccaacaatcaattgattataaggaaattattttaaactctcgaggatacatcctctgcttatttacatgtcatctaaatagttataaatagttataaaagaaatttttaaaaaatcaacaagatagatctatctattatattatcaaaggaatagaaaaaggagcctccacgttcgctctcatggtctaaaaattctcacattaatcggagaaaaagaaaagtcagagtccatatagaaatacaatttagaaatagctgaaattcggaattaaaaaataaggaatattagaagaggagactagagtcaatatagaaatacaatttagaaatagttaaaattcggaattaaaaaataaggaatattagaagaggagactagagtccatatagaaatacaattagaagaaatagttaaaattcggaattaaaaaaataaggaatattagaagagaagactagagtccatatagaaatacaacttagaaatagttgaaattcggaattaaaaaataaggaatattagaagaggagactagagtccatatagaaatacaattaggaaataactaaaatttggaattaaaaaaattaggaatattagaagtagagtatagattacttatagaaatacaattaggaaataatagaaattcggaatgaaaaataaggaatattataagtagagtatagaaatacaattaagaaaaaaaaatagaaattcggaattaaaaaataatgaatattagaagtagagtatagagtctatataggaatttaaaactaactaaaattcggaataaacataataaaatgaaaagtagtgtttagagtccatataaaaatacaatttacaaataactaaaattcgaaattaagaaaaacatgagaagaagagtttaaagtcaatataggaatacaatttagaagtaactgaaatttgaaattaaaaattaaagattattgaaagatgagtttagagtccacatagaaatataattagaaataataaaaattcagaattaaaaaaagaaatattaaaacacaagtctatagtccatataggaatatatataatttacaaataactaaattttgatattaaaaataattaataactaacacgtatataaaatacaatatgaatattacacattagttgtttcgtaaagttattgcaaaatttaaaattatgttgtcattgtaatatattttaataatataatgagaaaacatatatgttattatatgagagaaaatataatgatgctaaccgcgcaatttgcgcgagccaccatgctagttatattatcaaaggaatagaaaaaggagcctccacgttcgctttcatggcctagaaattctcacattaatcggagaaaaataaaaagcagaatccatatagaaatacaatttaaaaatagctgaaattcggaattaaaaaaaataaggaatattagaagaggagactagagtccatatagaaatacaatttagaaatacctgaaattcggaattaaaaaaaggaatattagaagaggagaatagagttcatatagaaatacaattaggaaataactgaaattcggaattaaaaataaggaatattagaagtagagtatagaatccatatagaaatataattaggaaataactgaaattcggaattaaaaataaggaatattagaaatagagtatagagtccatatagaaatacaattaggaaataactgaaattcagaattaaaaataaggaatattagaattagagtatagagtccatatagaaatacaattaggaaataatataaatttggaattaaaaataaggattattagaagtagagtatatagtccatatagaaatacaattaagaaaaaaacatagaaattcagaattaaaaataaggaatattagaagtagagtatagagtccatataggaatttaaaactaactaaaatttggaataaagataataaaattaaaagtagagtttagagtccgtataaaaatataatttacaaataactaaaattcgaaattaaaaaaaacatgggaagaagagtttaaggtcaacataggaatagaatttagaaataactgaaattcgaaattaaaaattaaataatattgaaagatgagtttagagtgcagatagaaatacaattagaaataataaaaattcagaaataaaaataaataatattggaagaagagcataaagtctatatagaaatacaatttatagaaaattcaaaatttaaaaaaagaaatataaaaagacgagtctagagtccatataggaatatatatataatttacaaataactaaaatttgatattaaaaatgattaataactaacacgtatataaaatataatatgaaaattcagaaataaaaataaataatattggaagaagagcatagaatctatatagaaatataatttatagaaaattcagaattaaaaaaagaaatattaaaagacaagtctagagtccatataggaatatatataatttacaaataactaaaattttatattaaaaataattaataactaacacgtatataaaatataatatgaatattacacattaatagttttgtaaatttattgcaaaatttaaaattatgttgtcattttaatatatttgaataatataatgagaaacatatatgctattatatgagagaaaaaataatgatgctagccgcgcaatctgcgcgggccaccatgctagttaatagtatgtgataaatcactctacacaaatgcaaagtcaaatttaacttctataagttgcaataaaaaataaatttaactgcgaatatacattaaatagtcatagtttaatttattttttttccttacagtttgtagaagttaaattttaacttacatgtttatgtagtgattcatcatatattaatctatcttagaaattttttaattttttcataaccatttagatgtcatgcaaataacaaggggatgtctcttcgagagtttagaatccactcccttattatgtgtcgggctatgtgcttacatatgtgggaataaaatcatattgccctctcttaacttcttaactatgcgttgagcttgattcgctctcattcacaaaatcacatataaaggctcccttaactactattataatcatgtcaattgatctccctctgctattttaaaagagtttttggttgatgtgtgatggctacgtgtcacattaaattctaatctttatcctacatggtgcttatgtggtatcaaaattgaaaaaataaatataggaaccacttgtaagtcaccaacctttatcttctttctccatctgtccaacttttccctatcctatattctctcttccctctctcccctctcacctttagacgggcaaaggtggtagaggggcggtaggataggctgagagggcgacaattggtgttcctcttcagtcgtgtttggcccttgtcatgctaaccgccgccttctcggccgatgccttaatctaccactgtgtcatcctagtaagagaagagagatggtgctcactgacatatgactccacactatattaaaattcttgtttatgattataatgtcttataagcgtcacgtggttgtcacgtaggatgaagattggtcaacgtaccacgaaaacgtcatgccagccgaacctgctgtaaaaacagtcgagggaggtcaattaacctggttgtaacaatttatggagtccgtgcatctgaatttatggctgagggagttaaaatgaacttttttgcttatgggatttgtgatcgtttttgcctgcggagcccatcgtgtatatgtggttggtgtctatggattgacatagaaccctttcctgattcctgacttgaatttgtttcatgtgaaaaattttagataatcgcctcctcttgcactgtcccaagtctcccagacgacgagattagagttgtctttctttacttgtacagcagggaccctatcgtttcccccaatatggaccaactgcggccatgtgtacaatcgtgccatgtcaacccatctttatgagttacgagtacctacactgttcatgcatgcaccaactagctagtactaccagtagtactctactcacaaaaccttctacgaaatctgcgccaaaaacgagaaccaattttcgctttcactggaaagagcgcgccgggccggcgctttgcgtgagacgaaatcaaccagatgcacatgccatccacggcctcctcttctcccttgtcaaaccaatttacttaccctgaacctgaaggccatccagtactccagcagtatgtacaagtgtcagctttggcaaagcagatgatacacactacacagaataggatggacacaagtgagcaagtgagaatgacgcgataggtaaaaaaaaaaccgaacgaattataagctttcggtggtcagatacgtacgcagcgaacgtccaaaaaagggcccaaacgaggtggtagatagcaccgcaccggccaagggaggtgatgtactgatgtgcctacgaatccatccaacgggagccggtccaaaacatttttacagcagagtggttggatctaaatcccgtccttgcaatcaccacctcccagtccccagtccccagtcccccacacatgagctaccagcagagtggctgctacaactacagcataatcctttcaccaactctggcactctggctgacacgctgggcccactcccagtgaagttatactcgtaaaaaagaatcctaagacgccgggggaggcatctgaccatctgttctttacatgtgtgtgtttttgccaagattctgatgatcacgtgcagctttttttgtttaacactggttattactagtagcacggttgcatgcaccacatttgtgtcactttgtgcgcaccagcatgcatgcctcccttatcataacattgatcgattgattcaccaccacaagggcacgatcatcttgctcaccaaaacacagacaagattggaaatcacgtgtaaagaagaaagtaccgggtgctttgaactaattgaaactgctcctgtttcctcttcttctaagagtcctgcattacaaaattcaaaagaaaaaaaaatgtgctacgaaagaaactcctcagagtctgcttctaagggggaaaaaacactaaaaatctcaaaaaaagaaaaaagaaacttaagaagctgagaaataaagagtaaccaaaaatgcggtttgcaggacaaaaaaaaaattagctgtttttatcgctgaattattcctgggctaatgaatagtttcctaggtagcctggcgccggtagtccgggcttatgcggttatggatcaggaattcgtccgcgccggcgaagagcggcgccgacgacgtcggcccgtcgaacagcagcgggctcgtcacgtggagcagccctccggcggcgccgccgccgcccgcgcccacgtgcggcggcggctgctggtggtggtgcaggagctgcatctccttctggcgccgcagctccaccaccttgcggtgggagttggagtgcttggacaccacgaacgtcgggctcgccgccggccggtactccggcacgagccgcccggacttgtaccgcaccccgcacgcgttgcacagcgtcttgggacccatgggccccgtcctccactgcggcgtcttgtccgtctcgcagtggaggcacctcctcccctccgccgccgcctgcgcggccgcgttcggcgccggcgcgggggacggcccgtccttcttcttggcggacttcgccgccttcttggccgggaatgccggcgccgcggtgcccgactcggacggcgagatgaccgccgacgccggggacggcggcgacgccggcggcggcggcaggaccatcaggcgcgacgaccagctgcacggcgcgacgcgggaccgcttgctccgcgccttccccggcacgggcgcctccgtgggcagcgcgccggcgcctcctgccggcagctgcaccgcggagacggccagagcgggcggcgcgcgcggcgcggcggggatgccggagatgagctgaagcttccggagatcctccgtgggcaaggtctcctcgcccatgtaggtggacacccattccagctccgcgagttgttcatactgcgtagaaatttcacatcagacaaccgtctcagcaatggcgctagttgttaaactcagtaaattaacaagatattgtcatgaaaattagaataaaaaatacagtggctaagttggctaagtggggcgagtggacataggatgctactatttttggacgcagatttcctcggttactatttactcggcaggatgctatttatgttccctttattcatgggggagttttaacgcggggtggtgaattttggaaacgaattacgggtgaattgtacacagttggccaaaattcattgaaaaatatgtgccatatttgcgacgccgcgacagtaatcaaataaacggaagccaaatttagccctcaccggctcgcacagcccgccggagaagtccccgtcggcgaggccggagaatgagttgctgcagctgtcgacggccgtcaccgtcgacgagtcggccgacgcgttcccggccgcgcggtcatccccgccacctccgacgacgcccgctcccaggccggcgccgccgccgccgtacgccccgcacaaccccgtctcctcctcctcctcgtcgcacggcaggtcgaggaggtcatcgacgaggaacatgtccccgctgccgccgcagcctccggcctccttcttgacacggaccccgccggcgtagtccgccgccgccacctccatcgatccctacttcaccaccacgcagttcttgaaaaccgaattcgtctatatctcctctcctttctacctcaccttttgctaatgcttattctttcatgattttctttttctcttctgtgcgtgcgtggagaaggaggcggagataacgtgagggcggagagagagagagagagagagagagagtagggtttaattgggaagcgttcgcgttggagagcggagtggaggacgacgaggaggaggggaggggagggagggcgagagagcggtggtcaggtcagctcgaatgaacgattcttaaggagtaaataaagccagagccactaccccttggggtgaaaacatggacgagtttaaaagccggttaaatccaaaatcccacatttatagcagtaatccttgggagaagacgacaactgtagtgtacaccaaaacggaaccatgtgatcgttgccaatgcagcaatgctcattgcatagtgatagtgctactatctctatctttactactataaaaattaaaaatattttcatccaaaattttaatacatcttatccatatttgagtctaactttactattataaaaattaaaaatattatgtttgagtgatttttttaagttggttgtacgtcgtctgtatccaattcatcatgaaactagattatctattatacacctcctttcagtccaaccctcctcttagctcaacccaatcgaaccacaccatccgggcaccccgtcatgtgcaccaccacaacacactgcgcacccctctcctgttttttctatcttttttctcgttttctttttatcttttttcttttctcccaatcatcctgatcctctcctgctctttctaatggcctctctttactcgtccttttctctctgttttctccttttcttttatgttctaattttatattttcataaatatttttcttttaaaattataattgtttaaaatgtgtatgcgataagtttaatactttgcaaatgtttttcatttatagtaaaaaaaagacttttactaattgaacaattaaaattccaacctatggtcgatgaagtataacaaaatacccatgtatcaacttatgacattgccacccatcaatttgtgagactatggaatggtgtatataaggtattcttcgcgtgatgacgcatgaagcgaatacaaccgggttcaatactatatatttcgtgtgtttttctattgttttgtttgtcttattttggtttgtcgtataaattggtaaagtttttttcaatcgtaaaattgccttcacctgttacaatacacagaattttttttctagttagcatatatatgaggaattaatttgttttttagggtaggaattaatttgttgtagtgggaaaaaaatcctatacaaagacgtgtacacacgcgtttccttaacacatgctagagagatagagactatagaccgctgatatcactaaagaagcctttgtttggcacttagttaggggtaaaacaaaaaaaaagttttcatataaaattaaagagaaacaactcaacctccattgttggcataaagttgtatagcggatttcaggcttatctatattacacaaagatttgaaaagtgtattacggagtagttgttagagtatcgtgagtttgaattgtatttttcatatattagcaaaacagaaaaaatgtgtaactttgctactgtcctcaaaggagaaaaaaaaagaggggaacaaaaccattggcctactaagcaagccttcgcttagctcttagttagaagaaaaaaaatccaagtatattaaagaggaaaacaaccgaacttctattataagcataatgtttataaattataacaaaattttaggcttgtctgtattagccaaaaaattgaaaaaaagtgtgaattggggttatttgtgaggatggtgggggagaaagttctctacacagtgggtgcaaattgtatttcacattttttttcaaaaaaaaaaatctattcacgtattatcataacagaaaaaagaagtaactttgctactagcaaaaaaaaagaggggacaaaacaaaaggtaattttgctactgaatatgaccattgagcaatttcgttttcattaacgtgtggggctgactggtgatgcacaaaattgagcatggctgagctattgtgttttgtgcacttcaaaagggaacataatcatataaaaagtagcatcacatgtttggccatcatatcattcagtactatcatagacttatctactccaaaatgcacctatcaaattttgtgaaaaaaaaataaataattacttaaattttttgaataagaaaaaaaaattaatcaagcctaacgtggtatgatctgaagcattagtcagtgattactagctttcaaacaaagcccagtaaaaaaaagtattctactgtactatccatactacttcctccgtttcacaatgtaagttattctaacatttcacatattcatattgatgttaatgaatctatatagatatatatgtctagatttattaacatcaatatgaatatgggaaatactaaaatgacttatattgtgaaacggagggagtacgatgaatcatggaagcagtaagcattgttgcacgcagcacctgcacttttccatttactgtggtacggttaaaatagcttcaaaaaaacggtgtttattagcccccaacattagtagaagggaccagcgtccaggattttttagtagttgtagactggaccaacgtccaggatattgccacgtcgcgccacccatccgtaggatttcgccttcgtgggagacgcgcatgtcacgggcctgtctcgtgctaccacgtaggcaccacgtgggccgcccccgccgctaggcgctccgtggccgttggatgcgtacggcccaccacgtggccggcatcagagtgggctactgggctggattagataagagggtccgggccctgcaggctcaccgatcccgaggtggattggcctcgggagacgtgacaaatgctggggccggttttgttttctgtaaatttataattcctgacctcgggagcggtgatccaccagcatgttaccaccacgaacctctcaacctcatggctgaatcatttgcttaaaaacagtggcccaaaatattaccactgtgcagcacatttcatgtcttgtttacattggaaaagatcctaggaagtcaaaagtattcagtttttgtaaaaaaaagtcccagaagattagtatttggaacaaaagaatgatgatacacccaattcaattgtattgaaataggaattgccattgaatataaattttcaaggagaacaattgtgagatttaaccacttgttttttcccattcaagctgacaatttctccatgcaacttctaaaactttcatgtactcctttgttggtctagcgtgttggtatgttcacggttcagatacacttaatttttcaaaattttagcaacatttacacaactatagtatatttaaaatattcagtaacaaacgacatgatttttactctatatcttcctaggctctcacctagttttgttagggtagatagccaaacaagctattttgaataagatgtcgacaactttgtcaatttggtattgttccaagtgtgaaattgtatacaagtgtttagaatgttcctactacttatatgttctgaagatactgcaactaaacgcattaaaattaactctaaaattaagtactaaaatttattttttaattgcgtatgaaaagctaaagagcaagtgatgaagctgtaattgtactggtagaaaagatgtgctatgctagagtactctctctctctctctctatccattatataataataaaccaatttttatataataagtctaaacatatcccctctataaaaaacaatttatgactacaaatctaattgtaggttatatcgaaatctgtagctataaattttggaatagacgaaactagaagaactgtcacttggattaaattcaagacatctcgtaacggtggtactgtagaaaagtacgtactagtagtacaacaccttgtgctttgtaattttaaaatctaccgtcctcgtttatgtaccaggccgattatcaacgcactgcaaattagaagagatgccctgacaaataaaatcacgcataattttgtgggccgttgacattgtagtagcactgtttaaggtggagtggaaaacatccacacttctaaacaaaaatactcatcacttgttaccctacaacgtccaatgatgcatggccgcacaaggaaaaaccaagagaacgatgggaacataatattatcgctgtccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31193 - DNA, 10533 bp, Oryza sativa
aatcttttctttagtcagcaagactctaagccatcagccctcaagcaaacagaggagccatgcccttgacctctatctgccaagacgtcgagtcaggcacagcaaaccaacaacacatgtcccggacagcatacgtcatcatatatcgtacacggtttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccaaagtagcccctaagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaataactataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttgataaacccaaacagcaccttgactatataaaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgacagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtaataaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagccccctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacacacagagacaaacgaagaacagcggaagactagggcgacgaccacaggcacttgacggcaggcacgagctagacaccgaagccttcatcttcaaggagctcctcttctgggcttgggaaaaattgagcaagactgtgtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaatgctacaaagttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttggggattttgaatagagggggcggtgtgaagccaattccacaataaacccacaattccagagtatccaggtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtagtaataacaataacaataataatatggtcataacaaaggtaaataggcatggctaagtaaaacagtgataacgcgggaatttaaataaagcgacaatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaatactatttattgcgtcagccgagggagcggggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcggtcggcgggcgaagcggaggcgcggacggagtcggcgacgatgcggcgaagccgaaggaggggtcgccgagtcggaaggacgtccggagcgacgtcggcggcgaaccgaaggtcgacggcgacggcggagagagaggagcacggcgcgagcacgaatccgacggcgagagcgagcggcgagcggcggaaacggaagagcgaagcacggggatcgaatatatagcaacgggagggggagagcgcgcccggggagagaggaatcgcgcgcggagatctcggccgccattgaagacgccgccgatgattgcgggattcgaatcggacgaatccgagggagagagagagggaaaagaggggggaaacgggggacacgggagagggaatcacgggggtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcgcggggagccgatgggccgcgggagaggagagagagagagggagggagaagtgggccgagccggcccaagagggaaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttatctttgcacattttaattgttggaggctttcacattgaattttaattattctgtggagattatgggtaccccatacccacacggcatggttatccgactagttataggggataacttatatctatgtaatatgtaacagatcatgacttgggtgttacgtttccttgtatatgacggaacggcctaaagtcctgatttaggaaaccgataccgtattggttaaggtttctatcttgtaatcctgccccccatcctatataaggtgggcaggaggccctctagggggcatatatgatgaggacacgacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccacccacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcgtgcctccgtcgccgccgagtggtgcctccgcctacacggctggcgtattatgccgccgctgttgggcgtctacgacctcaccgccggcctgcctccgccgccgtcgactggcgtcctcgcctatacggttggttggtcacaccatcgttgatgggcgtcttcgctttcaccgaccggcttgcttccgccgccgactggtgttttcgcctatacggttggcggacttcgccgccgttaatgggcttcatcatctacaccactggcttggttccactggcgccgactggtgtttttgtcaccattgatggattgtttcgttcccacatcggctacttctgctgtcaccgagggaatacgacaaagctaagtcatcgcttattttattctttatatgatattttgtcttttcctttgcctcactacatcaactggttcgccgttgactagtgagtcgggggctatagatgttatatcgtattttttaaacaattttcataatatttatcttgattgcttgcgacatgttctgagtacaaaagtgcctatcgagttatggagttccatcttcctatgctttccgtttggtttgccaatagatagttgcctttaggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgcatttttcttgagtattgtatttacatcagatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcgcctatacagttggagtcttcaccgaccggccgccttgtccgccgccgactggtgtttccgcctgcacggctggcctttatgccgccgttgttgggcgtctatgtcttcaccgaccggcttgccctcgtccgccgccgactggtgtttccgcctgcacggctggcctgttatgacaccaactgatgctatcttcttcacggccggctacgtcgccgtcaccactaataggcgtcatcatattcaaacgcaagctgtctacgtctgctgccgactagtttattcacttccatggctgcatgattctgccagtgttgattggccttatcttcttcaccgccggtcatctcgtctgctgttgactagtgccctcgcctctacgtctggtttataccactaccactactgatggacatcatcgtcttccgtcgccgactggttatgccgccgccgactggtgcttttatcttcacaactgcgcgtcttcactaccggtttgcttctgttgccgccgactcgtgttcacttcatcacggcaatgcaactttgtcatcatgcctcgacatctcggcatgcgatgccatgttgttttactacaacaagaggctctccaatattcaggatttctacttggacatcttcaacacatatcttcaatcaagcaatgactactcgacgataagaagctataattctcgactctatgttcagttgtttcccaactaaccaaagagtcgggggctacacaaatataaggctcaaaatttgccaaattttatgtcaagctgaagaaatcaattcatcaaccaacgagtcaactccaggagtcattatcttcatctttgattcggagcagacattctacttcaacaacttcaaatatttcggtttggacgagttagacaacaacatcaactctcctccaagtgaagcatctacaacagccataacattaatttgatggattattgtcactgacatcatcaccagcacttctgcttcatcgaccctgacatctctgctgttgctaatggatgattatgttttcgccgacttattatttcaccttcacggttgacctactatgcaaatgctgatgagcgtcttgtcattatcattggttgctacactgctattgaccggatcaccgacatcgtcatcttcatcatgtcggttgcgtttgtcttcgtcaagtattttcttcatcttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggctgctcaattttgtcgatgttgctggatgccttcatcttcactgttggctgacttgtctgctgccgactggtttcttcgctccacggctgtgcaacttcatcacttttgattgctaccatcaatggacaattgtgactacgacagaaggacaagctatatgctcaggggcttactagctcaaacacaagtatcataccttcaatttggacttgttccggatacatgcaacatgaattcatgatcatgggtctattttctatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcaggagcatgttacatgcgtcatcctttaaagggtgtcgaaggcatatgttttggcctaggcctaatatgtttgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtactgtttgggattttaagcaattgattggatacaatatcattgcttttcgccacgtaagtgtgcatttttattgacc

SEQ ID NO: 31194 - DNA, 1118 bp, Oryza sativa
gagtgaaggacgaaaggaaacaatgacttggttgttgatcaggagttgctactatgctgcatatctcaaagatacaggtgcaaggtatatgtactctctcttagattaaataatttttggcacggtgggcttacccttacccctgattcccacgagacactgcttctccttgccttgagcggttgaaagacagaacagcaattaaagcaccaatcacccgatctttattcaactcttgttccggaagttttcaaatgattttgaaaaacaaaaccaagttcctcaagtgattcactcagtctctctaagtgtatcaaaatgaattcctcaccaaatgttgccttgttgattcctactctaaggttttgatatgtggcgctcggtagggatcaatcatggtatacttgcattcacatttattactaagtcaaaaacttagactaaagcagataactaaacatactcaagatcaagatcgtgcataaagtgtgtgatatatggtgtaaatggtgcatgaagaaaataaagaaaatgcttctcctttttgatttactttcttaatgcttctcctttttgatttactttctttctcccaaaaatccttcttttattggaagtgggcatggctacaaaaatttcttttaacatcatgctcatgcttgatggagtataactttatttatttttttttcatttcataaccatgcctttccctcccctttctttttttttcaaaaggagctttttttctgagaagaaagcacatggaagcatggaaaatttatttttgtggtgttaacgaccgaatttggtaatatcaccatcagaaaagaggattagatcgaagcggagtcaaaggcaaagatcaattcgggaacagagtaagaatcggctgaagtccgagtcggctacggctaagatcggcagagttcgagtcggacgaggttagccgattgagttgaatccgtcaatacaactcggtgtacgtcatcgggttgagttgatatgcttcaagatgattgccacacgtgggtagagtcttgagaaggcaattgtatctattaattaggatattttatgtaatttccttagagatatgtttgggcaaatgtctgccg

SEQ ID NO: 31195 - DNA, 805 bp, Oryza sativa
ccaaccaaggccaaccattccacattttagttgttaagcaagttttaagattaaaacactaacttgggtacattgctcggcttgcccataacggagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttggggattttgaatagagggggcggtgtgaagccaattccacaataaacccacaattccagagtatccaggtgatatgaatatttcccaaagtctatagttgtaaaaccacctaaggttacctaattagattgcgaagcatctacctaaaattatactagggataccatgagtagagtgtccactagttgaggttttgtttgtctagggt

SEQ ID NO: 31196 - DNA, 397 bp, Oryza sativa
gagatcccctcataatttccccaaagcgtaaccatgtgtgaataaattttgagctagtagggttgcagccacgagtaagtcttcccttggtattgtgtagccagaatgccgcaaaacttccatgcctaagcgaactgttgagagtacgtttcgatttctgactgcgttagcctggaagtgcttgtcccaaccttgtttctgagcatgaacgcccgcaagccaacatgttagttgaagcatcagggcgattagcagcatgatatcaaaacgctctgagctgctcgttcggctatggcgtatgcctagtccccaggcaggacttttcaagtctcggaaggtttatttaatctgcattcgctccgaatagatattaacaagttgtttgggcgctcgaatt

SEQ ID NO: 31197 - DNA, 498 bp, Oryza sativa
ttcttttgcgccaaagcaaaaatcacatcacccaaagcagacagtgatttattaatgtgttgagcctctttcaatctatctccagttgcttcagaccgctcaaccctttcactccctgcaagatcaataagatgtaggcatcctctagaagtggatccattcttcacatccaaccctcgaacatgtacagtcagaatactgcatagaataatgtgtttcaaaataaaatcatattgagagcaaaaaagatatagtttaacttcagttatcagtcactcaacctatgagaccgactgctcctttcattaagagctgttgaaccaacagctctatttgcctgtccaatttccatcaagtctaaaacatctgatgttgatttaactgggtgtaagctcgcatctgggacgacaagtccattacggtgagaggtgctccatatgccaagtgtttttttatgttaaagagaacacaaccattctctttcaaactaaaaacata

SEQ ID NO: 31198 - DNA, 418 bp, Oryza sativa
aagagcatataaacttcaaatgaccatacgcttggccatttgaactcggaattggaccgttcaagtctctaacttttccttaagaagtcaagaacccatttttgcgctttgtttctgcttgttatatggagtttattagagtaaaagcctttttcttttccgttggtcgtgtagacgctgcagcttcggaagatccgctcttcgcggaggttgaagccgacgtttgggaaagcgagcaaggcaagtcatatcatccttgaacatattgaatcccagtttataaaattattttgatttaaattattgcattaccgcttaatttaaattcccgcgttatcactgtgttatttagccatgcctatttacctttgttatgaccttattattattgttattgggattattaccttggtcaccc

SEQ ID NO: 31199 - DNA, 30232 bp, Oryza sativa
  unsure (1)..(30232): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacgacgttctatgttgggctccgtcaatggtttcagttgctagtgagttctggcgtgtgctgtgcagctgttcagccagccggtggttgttttttcttttcttgtaacccgtctagggtttttactcctgcttattgaaaatataattggcagttctcctgccggtttagtttcaaaaaaaagtataatagtaggctataagccaactataagcttatgtggaggaaagagaatttgaaaaatggagaggattggctttcatgcaagagctagctattcacatactttaagatagatacattaaatacataggtgagagatagagagaggagaagaaaaaaaagagataaccttatagcccatttactatacatgttaactctaatataagctataagctcatagttggctctcttattaaacttgctctaagaaatcgtccgatcccaattcccaaccttcccctatacactcggatctccctttcctcctcccttccttctcttcctactacagtacaccacaagattaaaaaaagtttgaaaaaatttatgtatagaaatactatatataaaaaatatttgaattcaatcaaatttgaaacgggtatgtaaacttttgacttataaactttgggtctataaactttaggtgtataaactttagatgcatagaaatactatatatagaaaatatttgaattcaaattcaaatttgaatcagatataattcggattcaaatttgaaacgggtatataaactttaggtctataaactttaggtgtataaactttagatgtatagaaatactatatataaaaaatatttgaattcaaattcaaatttgaattggatatataaacttttgacttgtaaacttttggtctctaaactttagatgtgtaaacttgaggtgtataaactttaggtgcataaatttactaaaatagaaaattaatgcggtgccaaaaaagaaaaccaggtgaaggaagggggggggggcgagtttccggccaataaggccatacattgcctcctctgcgaagagctgttcgtctaccgctacaaccaccctgcagcagctgctggcgccgctgcggctgatctcaggaggctccccgcttgctctcatggcgtcgtcatcaacatccacgggagcaggaacgctgggatactactgtgccgccgcaacaacaatggatcagagtttcagcttgttgtccagctcaccttgtgttagagctcaaggaagtaccagctggaagtcccaagagaaggaaggacctgaaggggaagacgacaacaaggctgacgacgtatagtctgaaggcgagttggaggaagacgccttaccaaggggaaaacgcatccggcgaaggaacaagaagtacatgggacctgactgggctgtatgaaccatctctgtgtatcggcccatcttggccatgtaagagagagagagagagagagagagagagagagttggtgaggagagaacatcctataaatacgcaaaacaacagttgtaataacttggcttggaactcggcggcggcgttggcgacggtggctcggtccggttggacgcgagagagaaatctatcaatcgagttcctcgtatcatcttgttcttgtgtgcttgtgtgaatcgtgagctagggttctaacaccttggagggatgacttcactagaagatgaaaatgatggctctgcagatctgccgatccctcgcccagtggcagctgagctgtgcaagtatgatggcggcttgatctggggcactaactggttgcgaatccgtcatgccgcaggtgaagaccaggatctgtgctggtgggaaatgtaatgccctcattgtgacctctaggccgcattcaataggcaaggtgtggtgataccgacgggtaccagataaattagagcgattcacatcatgtggttttttacaaactcttgagagtctaaaataatcgattagccatgctcatggtcatgagcggcatagtgtgtgcgccataagtatagttttgttcttttaaatgtgtgaaataggccatgggattgggagtttatgatacttatgatgattatgatggcatgatggtgcaagtgtggatatgatatttatattgttgaaattacttacgtggatcacaatgttttatatcatgtacatgctttaacttgtgttataagttccgttgcaaaatgtttatgaaacaaaatttgctttgtgctgaaaatgaaaccacaaatagccctcctttgatttagagcttgcataggtttgatcgtggctttgccaatacattatttatataatgtaccgactcttgcttgttgattattttgttgcttaggttgagggtttcagcatgattctaactaggggcctacccctagtcggtttgcttgtgtggaagggtagacaagctttctgctaaacttctactattggctggtcggccttatatttatgatttagttctatgtctttaattgttcctaagtttaacttaggcctttgtgttttggtggtctagctaagatgaaagtgtgaagctagcaacttcctgaggctagctgatcacgagtaagagttttgagcaattgcgatgatcgtggaatttagcactttcagtcaagtcccctgagatgtgtaacacatttagtcgccgccttcgtgcggtctggcaggtacatcttaggttgaagttgactggcaaactattccatcgaagatctcctttgttccctactcggtgctttgggttttatattggatttcttatttggcatgccaaggcaacaacgaggttggatggttacagtctatgttacccagatacggggagtacgacattttttgaaaaacacgcatacggggatatgtcatatatatgtatatataaaataatatgaatttatgcataggaaatcagtagcactagtaataaacagttaatcatgtcttccatttctctctatcttaattacctctacaacccactggatggcatgttagtttgccatggcttcgctggtccacttcttgtgtgaatttgcaactacatattagccgtggtagctctttggagtgttagatgcattagcacatgagctattataaaattcattagctctaaactacatagcatgcacttgcacttaaaaaacagaaaagtggaataagaaagttggaaggggtaacaattcactcattcgaactaacctggctcgctgtgagatgaacgaagttagtggtaacgtggtaggtgatggcggagttgtgccctggcccctgtggtacaggggcggagccacatggtggtccgtgtgggccatggaacacagtaaaatctagcccaaatgcctattacccctgttctgatgcaaacgtagaaaagaacgatgcttttgtttcattagttgatttgccttatcgagttgttgtttcagcttccgtccttcccagttcccatcctgactacaccattgatcgtgcgagtgcttctttcgtaactcgacgactcaacgattgggattggggacccgtgtccaacgggggcaatcggcgtctggcgactaggatcgagagcagcgttcagcaagcagctatgtcactatgtcagtttcggttcgattttagaaattccgattagaattggattgataaattaaaacaatgcataatcctattgtagtgtttagaaaatttatgttaagttggaccaccctaatctaaaatcctagctacgccactggttgtcatgctaaactcaatatctagcctaggtatccctacaaacaggaaatatatttttaacatattttgatgtgtaactataacattaatgagtctatatatcttgattcatgattaagaattttatcgcaacaaaaaaaatctgttgtatattactgtagccattatctttaaatgcattatctgtagcaataataatataaatagccacatctgttacatgctacaattatgtcatgaccagttaagaagtatatatacattttattatcataaatcttataatcatatgttaaatcaagtttactaaatttactatgtcccatcatgacacatgatttttagttttaaggtgtgatgaagtagtcgatagcatcaggttaattagctattcatatatacaccgatactcattattattgatacaatagaactagtactgaatactcattgatattcttttatacggtcaatgtttaaggtattctttttttcattttcacatctttgttagcacacatctcatgggaggtgcttctaaaacacccaataaaattgtttgtcttttttttactgattttttctgtactaatccaacggttctccttatccaaatcattcattcaacggttgatatttgtttgatgatgtggctcatcttggtgacatctagggattcccttttcactaatgtagattccttgaaatgtggccaatattttccttgatcctgtgcaccccctccccttcccagcatgcattttatgaccacataacaagcattagacactatctttgtttgaattatcgattgttgttcttatatgcaattaatcaccgtttaaggataaaaaaacatattttagttatagcatctactttatattgagctctatcgttgagtagaaatgaaatagtttttgacaaaacgctaactaaatcttatatgtaggtactcttcaaagtaatatactggtttcggttttgggtataactacaaaggtgtgaagagaaaatggtgattattcacgttgcatgttggaacttggagacaaccgccatgcaaatttctgtcaacttcaaatggagatttaacagtaggattattctttaaataagttttttctcttctttgatgatgacatttattcttgtgtcgtctctctatcctttgttagaaattgttatacttggttttcaaccaaaaattatgtactaagtggctatagctttagttgaagtaaaggccagatattatatgttatctaaagaaatcatcattcaaatcaaggagaccgaatgaaaagcctatatattgttcatagtcttacgctcatatagcttagaatatatgaccgtaccatacacaaatacacaagcaacacatgtacggttgatccaccttgagggatcatgcgcaccagaaagcagtcttctcctgacgtctgaaaccgatcctcacggaaaccgacatgaatggagtgttaggaatggggcctttattatgacgggtggccatcaagacaccaatattcctgagattttgtcctttaattctcaagagaggggaataattctacatcataatatattatgtgaaataaatctcctccaaggcttcaaatccctcttaatttttttatgggaggaattaaacgaacaaggcctgatggggttttccctacggatgaagtgtctcacaaacttgaaagtcaggccgggtccagcccgtgcccgtacacgcacaagcacccctctttaccaacatgacaaaaacacggctcgatccatcgctcgacgctcggatcggataggaataggattccggcactgactaaagaggatagtagccacactattcatcggaaaaaagtttcattccccgtaggttacctgtcgctcagccagccatgcacgcatggctgatggctcgcacgtgccatccatcggtgatctcttcagcaatgcgtgcagggccaggttcaacttttcgtttttcgttttgggtgtttgtatctggcggtgcccctatgacgaaatttcgaaaactttggtccgaaatttagaacaaaatttagtcaattttgaataaataataccaaaattcacgtaaaattttaaaaaaattaaaaatttcggctgaaataatatcgtatcggaagggccgaaatgttgaaccctgtgcggggctgcttgggagtatagtattttttaacacttgtaaaggcaccttgtaattttaggtcaccaagaacacacttgtaatcttttctagttgccttacgaatacccttgtaattaagttaagagtgacaggcagcatataaacacatgtccttgatagtcgatactcaatcataatcacaaaaaaggaaaaaaaacgatttttttaatccatcggattgctagaatataatcacttgtcctgctcttcttgaccatgcaagatctgaaatcctgaagaactgtagggaactgaagaatcacctgtgtcttgggaccattacattgttctgctctgattctagatagcaatgctcatgaagaacatgaattgggaaacctgctcttgaccgtgcaggaaaaaacgaagctgctgctgcttttctctcatgatctcatcagagaacaaaacaatcaaaatgtcggaatgggccaaaaacactggtaaatttaataggttatggcccatccaagcaacgttttaagtttaccctgagaaaaaattataggcctataacttacatcggttttgagccaaatgcatgccttttccaatgtcctgcagtagtgcgaagagaaaagcaataatatacttttttataataatgtcgtttttttttctttattgtgtgaacggtgacacggtttatgtattatctttatgatctgtcactgcctgctcaatttgtcacagctatatctccctcgccattattccaaaagggcaacaaagaggaaatgctttgctgttttcaacagagcaaaaaaaaagagggtcggaggagaaatgcttcttgtagttctctgcattttcatagcaccggcatctactcctatttcatatttaaggtagtattttatatatgcatggtttctaacaagtgagatggtattgcacgtatcgctatttcaacgttagcttttagatcatctaataccatcaggttcatatgttagtgtctcaatggcacttgtcgtgacggtagagggcacgagtccatctaatacatactacctccgtttcacaatgtaagttattttagtattttccacatttatactgatattaatgaatttagacatatatatgtatctagatttattaacatcagtattaatgtgggaaatactagaatgacttatattgtgaaacggaggaagtacttttttctatggttgagatatcagaaaattaacactagaaaatgcgatatgatacaccatcgctctctctctaaggaacctcgtgaaaaaggagctcttttgattcagcgtgcagcacaacacgtcaattcatgaaccatatattttttttgagatcagatcaatattacaattcatgaacatgcatatatattgttcgttatacttgtacacacaatttacatggaaaatgctggctaggaaacatcaaatccgtcaccggctaacaataggaagggccaggggtttccaggggcgttcaattcaatcgctgatggtggtgatgacaccacgatattattctctgtgccgcggaaaatctcagaaaaaagggagcaagaatccccactatgacgaggcgatcgatgccctaaccggtgaggtgaccagtggcgccatttcataggcttaattagccccgcttcacattccctccctgaatgcaagagattaattagccattgaaaaaccttttaagcctcttcacaaatttcagaatcatttcagaaaatccagatgaacccttttgaaacaaatttcaattcaaacattgcaaatatttaaactcgaccaacaaattttgtttccgttgttttggttggctctaccaaatactgcatccgtcctaaatataagagatgtttcctgtgtgtctagacgtacattttggtgtgaacgaagtgcatttccgttgtttttttgaactccctgctccactcacctagctagctagggtgatctggcgaatgttagagccctgttccttttctttttttcgttttcggaacaaaagagcagcgttgctccgttaatccgctcactctgaagatttcagcataaaggaaactggattcttgcctaggtagtctcaagagcttgtacttcgttcgttgcaaatgaaaaggaaaaggtagtactgcgtagctgtttgatgttcttctttctacatacccctaccctcccttttcagttgcattcaacttttgtggcatcatgccaagatgtaaatgcaataccatgtacatgcaagcattgacattttagaaagaaaaaaaaagtaagaaaaaggcaagaacatattattatgcttggattccccttctccataagcttcaagataatgcctctggtgattcagaacagtcgcaaattgatcgcgaaaaagaagggctccaagaacacgaggaattcccgcagcatctcgcgtgacatggtttaattggccgatgttgacacgcatcaattggtgaatggacaggagaaaacttgtgctcctgtagtttctttgagagcttcacaccgccaaggaattcatatgaaatctatcatgtcatttcagacacttgggagcctttcttttttttttttttttacttttgagagaagaagccatgccagaaactttagtggtaaaatcagataacattccctccttctttggatgatattgtagttaatggaagtgtgccctacgcatggtttcttacaagtgaaaaaagtagaaaaaagtgtaaaagaattgttgcaaacagaccatcatattctgtttcatctctttcaggaattcagcgcacccaggcacggagttaccgcaagcgcgaataggacttgtaatggtgggtttttgcaccttgaaacccatggaattctgacagagtggctgcaccaatggattggaataaaatcggattttataaagaaaaaaatttagcatggggtgttcatgtgaaaggatgatttaaagttgacaaatgctactatggtggtaacttttcatctcatatttcttttcccctccttcacaagcacgaacatttattaacaactcagaagcgccaagataaacagaattgtctttgttctggattatatattaaatgttgatcagaggataggttctgcactaaacttcacctttaaataccttttccttcaaaaaaacctttttttttcattagcctcaaggtgcataaactgaataaaagaggacaaattgtacacataaaataaaaatcacatatatgattaataagtggaagagagtacggaagcaaagttttttctctcgagtttttcaggtgtgatcgtgcaattgcaaccggcaggaagatttggagtcttttctggtggcattattccttcttgacacaatgctggcctcaaatatctctctttatttctgcatcattccaagttgcgttctggccgctgacttgtgttaattaggcccttgacgtggactcaattcatacagtaaattatctttccgttgtgttgttcagtgcgagatgatgaaccagggaaccgtacctaacgacacaggcaatcagaacccagagaatattgctgtcagatttcaaaagtatttctgatgagacggacatgagcatttctttacatgaaaccgtgttttatgtatgagcacgaccattcatttcaaacccattttgacaactgtaagaacacggccccgttggggaaaaaaaataaccttcagtatttacgtgcttaggacagaatcttcagagtcagaccatcctggtttcagcagaaaatgcaaaacagtgtgtgcgttacttcgaatcttgttaaaatatgtgaaagtaatattttgaaagaaacatatagtacatgcaatactgtatttctgtaacaaaggggatgcttgaaaagtaaaccggagctagctatgacatgacatctaaatacaacgttggattcttcttctttttctcaaggaacctctggccctcgttttctacatatgaattaggttttactgaaaggggggattttttttatatagagtaaaatcatggatctcatgtacttaaccatccatgaaatgtttacaagaaaagagataattatagaatatttgtgctagttgcgtatgctgttccccgtaaccgacaaactgtaatattttcagcaacgacaattgtctgaaatttctgtgctagctacgaccttttcagaatataattgtattaaactttatggatgcctcacgtttcataggagcatatgcaattagaagaaaggtatgctacatatggaatatgcaggccccaagccttctgacagaacacaatcatggcctataatctctagcatggagaaaggattaggtagttaataagcaagtgtttcagtgagaaacttcacctagtccctaatctatgtagactctaatctctcaagctcagatagggactacactaaaaagaataaaaaaaataacatatagggacaaaaatctcacatagcccacatagtttagcctcaagctgcctcccacactgctaatctcaatgcatagaaaatacagaggtgaagtgcatatgattcttcctgtgtgtagtggagcttacacgggagggaaaaactaggtgcaaatgtgcagagctttgcatcattcttctatcacaaattccccaggggttttgtttagatttgacttagctctttgtttaatcccttttaaatttccatcgtcgagaggggatcaaagcctactgcctacctctctacactgaaagcaaccctggccaaagttacgtcacttttttcgcaagccgaacctaagaatagcagtttgttagaaaagcttgcctcaaaggagaagcaggtatgctgctgaggaatatttttttggcagatcgtcgatgtaaaacttgatgagatttataacgaaagaataggtccttgtagtttctcttgatgggcaatttacagttaagtgttcctgtcagttatcacatacctgtgcatgctttgtggtgagcagttcattttgctgttcttcgttcagtatcaataccttgaggatcagcgccgccatgtcaatgatatgattatgcctgcaattgtgccaagttgggggtgatatatcatataagtgctgttttagtgtcgacacattcgagatatttctggaatcttccttgctatggcaatcttcactttatctgtctagtactcctgaaactctatgtggagtactctactgaaaattgctcctgaaactctacagggagttctgtatatatatatattaccgaaattgcttctgaaaatctacagttgttctgtatttttacctgcacagtacttgcttccatgtgcagcagtaattttgaatttttttatcacattatgataggaactaggaaggagcatgaacaacaagcttcctcctgtgcacaaacattctacaacaaaagatgccttttcctactagatatggagcatttgtgttaacaagaaccttccttaggtactgagagtgagacattcactatgtacctttattttctttttctttctctagagagacaaagggatagaaaaaaaacacttatgcttattccttagcatttgtatttatgttgtatataatactatttaggacttgtgatgctaaattagtgggcattagtatcttatcaagacaccaagatgagaaattgggtggttataaaaggggtactaagtagtatttatatatttcggttctctctccactgccaaggattgaatctattctccctgcctaaatacatgccatgctcatggaaaataatcttgcagggtttggggcctactcagatgggctgcatagtgtggtgctgacaattaacctcctaaccattttgtgcataggacccatgaactacaggactattttcccatgcttatcctttgcacaggagaaagctcaccccagggtctctttgggccacctttggacataagaatttgtagggactttataggaaattcacagggtttccacaagaatctttttgaatctaacatgattcgagaaaaaaaatctgcattccaaacgaggcccagatttgtaaggtttttgttgggaattttggatttcttttcccacaagaaagtttgaaacgtatgaatgtgttgtcaaattcatatgttgtgtattcctatgctcaaaagaaacatgagttatgtttctctctcacaccctatttcggagaacggatttgctataaatgtgtcgccatatttttcatgaaaaaataatcagcatgtatttagtgtatttacaatgtaagtttcaaaattacatatgtaattacactaattcacatatgtaattacattagatttatactataattacatttgacatatttttacctaaaaaatctatcactatatttttagaaagacccttcggagaaacattgatttccaaaaacataccggccctaaacttaacttgtgtgtcttgaaatcccatgaggccattttgttcctaaggattgttccttatttttctgttaattcttgtgcttttacaatccttacactcagggatgaaaatagttgaaaaacagccttacccatttccgtaacattttcttcttagaaacataattgaaaacagtagagctagaaatgaaaatgatatagaaaaatcaggaaatcaaaaacggaaaatcaatcagaagaaattctgaagtacaaaatcacatatgtaatttagaatgactatataccacgttagttcatgcttacaacactaattgtgagttgcctcgcttttaaccgtgtgctaaaaatatatagggtttagtgggggagttagagtaaaacctataggccttgaactacatgaactgatttatttagaaatatgacaatttccatattataaacacggtaacaatatctgtgaaaaatacggtaaaccaagtaaatggttggtcaaacatcaaaaccatttcagtttgcacatttcatttttaccacttgcttttctatttttgttgattggtagccatttgatttcaagatggtttgatcagcaaaacaaaattgggaataatagccgctcagtcgggaatttccggcaccgtttttcatccctacttacacgccacccacacaccattacaccaatgaatttacatacattaagagaccctccactgccaatgcctgcaggctgccacctcccccatccccatcctgaggtagcaaaaggcaaaagcccctgatctttcttttttaaaatttttttgccctccctcgtgtgtacgtgtgctaactttttaataacggtattgctatatttatggcgcatgttttttgaggaaaaaacagtcgttttttctagtggtaggatctcccttgatgtccgtgcttagcttcccacgctgattgattttgtcgaggtgtatatcaaggatgacttcatcacttgattactttgttacaaatactcaaagggacatgtgattttgtgagtaattattttctactttgctagcttctttcttttctccaaacggacctatgatttgtgagcttccctcttctttttgttgcgattatattgcatatgttatttagacacttacatatgtaattttgggacttacatcctaaatacactaaaattacatatgtaatttaggcacttacatatgtaattttgggacttacatcctaaatacactaaaattacatatgtaatttaaacacttacataggtaattttgagacttacatactaaatacaataaaattacatatataatttagatacttacaatgtaaatacatgccgactattttttgttgaaaaatatggcgccataaatatatctactccctttaataatgcaaagaatcccggcctttacttcaaagaagctactaccacttatgatgcgctcaatagacagcgcataaaaaccaggaaatgactagacaataactaatactaataccaacacaagttagaaaagacattttattcaggtatatttgtaaaatctccatcctaagttggcaaataactgaatgaacgtttatctcattccggcacgcattacgtatgctagaggtcatggattattattcccccctctcccagcgacagacagctagcgagccaacctaccagccgccgccaactgttgattaccgggtgcgcgcccgcgcgattcacatattcaccacgtcgtcttcctcgtcgtcgccgctctataaatacgggccgcctgtgctcttcgtacttccaccgctttctcctcgatccagagctatacatatccatcagcagcagcagcagccaaattcaccatcctccagcgatcgatcgatcacctgcagtactagttctctcaagcttcttggtcgccggccatgagctacgggagcagctcttctggtctctctctcacttcctctcttttttctttctttgcttcttcgtgtcttctttctccgccgccggcgtgtgctgacgaacgatcgaatggaatgcgtgcaggggggcgaggcgggcggcgggtggagtacgggaggacgtacgtggtgaggcccaaggggaggcaccaggccaccattgtgtggctccatggcctcggcgacaatggcgcaaggtaacccatcatcacttctctagagttctctctctcgatctcgagatgatgacttctttcttccacagcttaataattatattacacacgaccaaaaatatgcaaacttgtactactactacacgctcccagtttttaatttttaaatgtcctagtagtacacagattttatcacaactactactatactcactccttttttatatacttatatatgacctgaattcaccaaaggtcatatacatgtatattataaaagtaaaaaggagggagtggttcagaaagattggtggtagcttcactagctatagctgcaagtgtttagtatgaatgcaacaaacagagatggatgggacgatctagattgacatggggaacacgaacgaatgaactagcttaggttaggctgtcaagatgttgatatctgcacccaattaatcgctttattctctctcccccgacgttgtactgtaactcgatcgatgcccctttatttttttgctagaaacgatggattcggcctcgccatttctgtccatgcatatattcctaggattgctttttacctccgaattaaagcctgatcatgcatcatctccaattgtcctattctctctctgtctctgctccccgacctcacaaaaatttcctgtagatcgagaaggatggaggtagctagacgatgccgatgtttgcgaaaagaaaattaaccagttggaatatatattggccatctgccactcactacttgtttagagttacacttgatggttttaattgccatctatgtgtcttatgacaaataatccacgtatcttaaattaaacacaaaactataactgtagttggagtgtgagttattatttgtgtggttcgttaagaggcttgtttttaattaatccctcaagggggtggtacacaccgttcaaattaacagttatgaaacattgtattctttagaaaattaaacgatgtagatataaacatttgaacttgcatgtttgtgaagggtgtgtaagatgatcggttatattctctctttttttttatttcaaaatatcttgtttctatctgaaccacatgcaaaaaataataatagcatataaccttgagggattaaaatagtttctttggtttctcttaccacgaaagggtgtagaaacacgaatgcaagaatccattgttgaaggaccaatatgttgattaaatatagaagagatagatgtggattaattacctcatgcttcatgcaaggttctgtctgccaacaaggatgcatggagcacctcagttttgtgatgttgcattaaataacataagtttttttggcattgtttctcttctatgggttttggcagcaaaagcatagaatatgctagccattaattttctttttctgagttcaatatgcatgtgtcaactgtcaagtgtctgcttcaaatgttctcttcccacttctttgcttttcccatcagtactgaattacaatggcatatttcattaataagacgattgtactactacctggaactttcaggagaacacaagaaaaaacttaattatatatacatatgtgctctagccagctcattagctgccttagtttgatccagtgttgtgctatgtcatgttttattctttcctcactctttacttcttttattctccattactttctgataacccttcttttgttgacatgttaatgtcattagatgaagctatagttttgatagaaagccagcacagcactgaaatatctctacacaagttgctgactagctgtaacatgtactttttcttgaaacactggcctaatcttgtttcttgtttctttttcataattttatcttctgcagctggtcccagctactggattctcttcctctgcctaatgtaagataccatactgcactctcactttgcagttgaatcaatcatgcacacaaccatcttcacctacaatcttatttctattcctatccctattccaaatgggcacaataatgcatgtatagacttgttcattctgttatctcttcaaattaatgtaacttatctgaatcactaggttagccatagcaattttttaaaaagatttttagcaatagcattgttcatgctagttctaagtttattaactctcaagcttataccatccttatgcagatcaaatggatttgccctactgcaccaacacgccctgttgctgctttcggtggattcccttgcacagcatgtgggtttctgaaccatttatgacttggccaaaaagaaaaaaaaagaaaaaaaaaagaaaaaaagaagcatgcagctttgctttcctaattttctaggccatttcttttgctgcaacctggctacagattctgatattgccgttctcctttttactgaaattgaaacagggtttgatgtggaggacacttccgtggatggccgtgatgatattgaagggcttgatgcttcagctgcacacgttgcaaacctactgtcatccgagccatctgatggtacattttcagaattgtaccataattacagaacaaaaggaaaaaaaatgtgaaaatattaaataagctttagaatactctgtatttgtcttactgatctttggtggaatttcaaatttcagtgaagcttgggataggtggtttcagcatgggtgctgccgctgccctccactctgctgcatgctatgctcatggaagattcacaaacggcgttgcctacccggtcaccctcagcgccgtcatcggtttgagcggttggcttccctgttcaaggtctgattctattcttcgatcgttttggaaaatgataataataatttaatttgcaatgatttccttacaagtgatgttcttcatgtgttcttatttaggactctgaagagcaagatggacagctctcagactgcactgagaagggctggtgccttaccaatcctgctcagccatggaagaggtgagcaatgcaatcgttttgaactagatgtgtataaaatgtaatgatgctaaaaatgttctacttatttttgcctttgcagctgatgaggttgtcacctacagaaatggtgagaaatcagccgatttcctgcgaggctcgggttttcagtatctgaattttaaaccctacaacgggtatagacacacttacttaattttccccatcttcatttttttctctgaaaactagaataactaacatgatgccatttacacagcctggggcattataccatccctgaagaaatggacgatgtctgcaagtggctcagttcaaggctgggacttgaccgatcccgcggctaattcgaaaatatgaacccggttcagtggctttggtagtgatgtataagagaagaaggtattgacaatatacaggagaaggttgattaggatatgtgaattgtgacagtcatggctttggtagcatatgtaacactatgtgttttccaaacaactgcataccacgttacagttgtagttttctactgatgtactttgttaccgctaaagagggatgcgtataatgtagtattgtattgcttgtttgatactttcgttactaatgctatcgagcctcactaatcttgcagtcataatatatttgtgctctagatcatgttagtgtacttcgttacatgatatcatagtcccctggaccaacaaaagatgagagatttaaaaattaaccgtacgattttatcacaatttcaaggtatcataattcataaatcataacaagataagatgataaggtgttactatgagctgtctaaagtatagataatctttcagcagcagacatacctatgttcttgaaggtggtttgtttagggggtgaccattttgctgaaagtaatctccatcaccaatatgtttgagaaaccttctgatctcaaggccatcatcactgcacaaaggaacaaatcataaaaatattgactaatcgtgaacacattacacatcataaaaatactgtatatcgtacaaccatagaatttcaagcaactaaatgaaaataggctaaacagtagaacaggtgcataaatagatcaccaagatgattatcacatcaaagaatcaaaccaccgccttttctagttatcaaactttactagttgaagttcaacacacaaggacagttacgaattatatggatcaacattccaaggacagccaactataatatttttttccatcatacttgattgtgttggccaatgcctcttgtcgtctacaatttgtactgtcccattattgttccactggaatagccagatgtcccactagaatcgccattgtcatcaaatcgttgtatatctgtgtcagtcactgacattaaagaaaaaacttaaccattagaaaacccaaaaaaaaaagagaaagaaactaagaaagaaagaaagaaaatatgctaaggaacatgaataaacgtctgatgcagcactcaccatcttttgcattctgccacaccctctgcaatggcatctcgcggtacacgcaactttgtttttcaaatcacaaagcgaacgtaagatttgcacgacacgatcatcacaaaataagcatcaaaggacagtagcgcatccgtacgtaattccgtttaccttgaaggcactcacagtaaagcttcctgcatccagacttacagcaagcgcatcccttcacttggttcctcacgctcgccaccatcctgttcatccaaagattcagaacaataacctgagcctaactgaacaagaaaacacagtgtagaatcaggtattggcacttaccacagccgaatcggctaagccatttgcactgacatcgacgatctttggtctgaatgcctaaggcttcttcagtatcagcttggagcaaaaccacatgttgctgaagcactcacagtatctgcagttcaagaaatggggggagaagaagagaaagctgtatgcctacaggtcaaacatagaaatattttcagtagtttttagagagttaattctattcgtaggatttttcacagaaaaagaaggaaatgaaattcagtgtgctcagatggtggatcaatgggcgtcagtttccttccataccattggaggcagtaactactcttgttgcaacggcagagatggcggttcctcttggcccatactgaaccgttgaagaggattagacgcagatgcagcctgccatcgaatacagaaactgacacagcttcaaatattgttttttgctgtatgtctattaatgcacaaagtagagtctatcgattgtattatacatatgatagaagtgtccatccaatttttctaatcaacaagaagacaagttaaggctacgcgcctaagcccacaaagagcagctcatgtccaaacaatatggtctgacgaacacagcacaactttcaggagcatatgaccgaattcttcaatgtagaaggaaccaaagtgcacctatatacataaatatacatcaaatttctgctttaacatgatcagattcatcaacgcagaaagaatatatttcagagatcaaattacaacgcagtgaattgaattcacccaagtcctagccgtggacatgataaatacaccaccaccattgatgtttctgtttgctacagaccttccagcaaatatattaaaaatgaaactaagacaactccacagcggttttgagcctatccctgcattgcaatttcatctcagttcttcttgcacgtaggcaggatgtcctgactacgcctaaagccaaatggaacacccccatgtttcttcccaacatgtggtcttggatgcctggtgaacccgaaagattgcttgcttgtagagcttttcagtccaggtgcacgccttggcactccctaccagctgcatcaatgtgcaggatcaccatcgacttcaccatcatgctgagaaccagccgatgcctctgttgatagcgtgacgtcgtcatcaccttcatcattttcgcgagctgtggtgtcaccatcaccactgccacttgctccccctaatggggaggattcacgaccaaaagcctccccaagcagaagaattgttcttcttctgtggtggcctgggaatgcttccctgtagtggagtatcgacctgccagtgcgcacaatgaagaccattgttatagatgggctatgtagagccctctcgctgatatcctcttccccttcactgactccgatcccgtcctccctggcacttaagcctgaacgaagcatgctgaacaagtccccaagatcacgctgctgctccattctgtgccagtctcgctgccgttcaggatccacctgagttggtctaacagtaggatggttctccctggcgtgtctcctcagttgaccgtatgcccccctgaactcgcaggactctttagtacatgctcgaaccttcacgttcaagtacttccgtgcatcataatcctttgtccaatggctgactggcccacgacacaacgggcaagacagttttatgggctgctggcactcgctgcattctggcgcagcagcagcactggcaccagaatcctttgaggactccttagaggccttgcggtactgatcaaagcaattggagtgtcggtagcttgtgtcgcacatgaaagggcggcagcccttctcatgcgacgagcagacgagcagaacagcgttgtgtgggtgatccatgcagaccgggcagcggacatcctcccattccgcagcctgcttcgcggcagcggcagcggcagcagcagcagactcctctgacctgcgagcacagcccttcccattggaggggtacggcgaaacacgagaccggcggcgctcgtatgacacggcacgggtgctcctgtcctttggcatagttacctcaagtcagtcagatgcaaaggtttgttggttttgtttgaaattctccgcaatccaaaggaaagcgctacagagaacaacaaggttgatttccaacttcaaactctgaaagagaatcaaagcgagaaagcatgagatgcttaatcagatcgcaaactagtacatctttgtagaaacaagggttatacatgacagaacacaaactaaatcatttttcctttttctttttttgcaaacatgttatatgactccggatccatcaagcaaatccccatccaaaatcagagaactcttatctatcgagagatggactcctcctttttctttttttgcaaacatgttatatgactccggatccatcaagcaaatccccatccaaaatcagagaactcttatctatcgagagatggactcctatgccgtatagaacataacgaagtactaaaagtagagatcggccatagcacaagtccttgttactccagattcacagaaagaatttgttactccagattcacagaaagaatcagaagcagcagagccacccaacaagttaacataagattcctacacctacatagctgaatcccgtcacagcaagaacaccgcaaaatccccctcactcgatccagtctaaaacgtccaaatacaacagatcctcccagtaaacgcgcgcacggggggatgcgaccgagccgaatcgggcgggtcaacggcgtccagatcggcccgcccccccgccgccgcatccgccatcataggggaggaggaggaggaggaggctttttattttttattttaccgtgccgtcgagggagccggtcggcgacgacggtgtacggcgagagaacgggcgcgccccctccgtccctcgataccgccgtcgatcggacccggcggcggcgaggggaggattcgtctcgcggcgagctgaggctaagacgaaaggggaggaggaaggaggggaaaggagacgggagactcgagagagagggaggcgctgaggcgatgggtgccgctttatattatttggtcggcgtgacgtggacagtgacgtggttggctagggttctctcgcccgcggcccggcccgcacccgcgtggaccgacctcgccgtgagccggacaccacggccggtcagtggggcccgcatgtcggtgtctccccggtgcaccgccctgtcggtgggatgacgggtggggaccaccagccagccttcctgttggtgcgagtggtatggtaaacccggacgccacgtcagcgggaggctgctcccccccagcacgagctgctggtcagtgacaggtggggccccggtgcggtgtggactcgtcctggcgtgtccccccgcccgagtgcgatgtattcgggtgggccatagggccgggagcgcgtaggtggggcccacggccatagtgctcccccctggtgtggttctttggatgctcatttgatttgagctttaacccccccccccctcgtcctcgtgctgtgtaccgcggcggatactactagtagtactacgttggaatttgaactctactcgccttcaaggttcaaaattcaaaattcaaaaagtttcgaatcgcgcacgaggtatggggcaaaaactaagcttggacttggcacggagcagtgattgctcgaggatccagcatttttttttcaataccattaatttgacattgaaaagaaaatggcattgaaaaatagagctcccttattccacggaaaaaaaaatctctctcagtagggaaaaaaaaggcattgccattaatttgggcagaattaggccgcacagggatggaaagtacagaaatggaaaacaaacacatgaatgagatgaactgtaaatgaaaaaaaactttaaaaaatgcataaaaggaatgatgaaaaattggatggttcgactacaggaaagttttagctcattagaatttattggatgcaaagacatttcctttccgtcggagagatcatgttatttcttacgaaaaagtgttggaacttccttccaagtcaacatacttgatttacactagaatatctaggaaagtaaggcttcgttcgattgcaggtggaggaggaagatttgtaccacacgtaaaacgaggaatctcattagcacataattaattaaatattaataattataaaggtgaaaaatatatttatttaaattttttaaacaacttctatatataattttttttacaaaaatcgcatcatttaatagtttgaaaagcgtcgtatcggataacaagtaagttagtttcagttgttgaatagaactgggcctaagagcaattcgaacggatactatatccagtccttcatcgatgaaatagcatagggaaaaaaaaccagctccagcagatacgctatgtgggcacgtgtgtgctatcccaaagagaaacgttaaattttagcgttcctctcccctcacgccatatcgcaaccgccacctctagaccgagctatcccgattcagattgacggagcaaccccttgtccattattgtcattgttgtcattctttttttacaatgatggtggcagtagcgggacattggctggtggagccgtggaggagtggaggtagagaggaaggagtgtaccagattaggaggtggggatgggttttgggttggcacccgctgcgccaccgattccctaggctgctacggcagccaagcgtcgccccgtgcccacactcgcaccccgctgtggagcatttgaacaggaacagaaccacatcgtagtggaggatccgactgctcatatttatcttgtgcgactattgctacagcaacgatgagttcatcgtccaacaatgaatcatccaagagaagatgcctcaaaatgtagctcattgagtgatgaaagaggatgcacaacaatgtggatggaggaaaaagatagcaaacaatgtaatggtatatgtagtgttgaaatctagccgttggaaagctatcaattctaatatagtagccgttacaactagccgctaaaaaaatatccatccgttggagatatagccattaaaaaaatacccactagtccattacaaatatatacattcaaacataataatttaaaaaatctatccgttacaaataatagcgttagaatttaatcatttaaaatatagctaataaaaataatattggaatatattactaaaatatagaatggtgtaatatggaggatgtaatttggataatctattagagcgaaaagggatacgaagagggaatatttttttgtatggtcttccaaatgggaatatggaggatcaaatttgtatgagttgttcgggatgttccatccaatttttacctgacaatgctagaaacttcaactccgtgttgtgtatacggtgaattgatgggtacaattctaaaatttgtggctattgtaagaatactatagctgcacatatgaaagcatataatgtaaaattaacttaactgcatgatcaacatgttgtaacgtttgtcctctatccttcctactatgaaatactagaggataatccgatttggaagaaccatggaaaccagacaaacatgagactattctcatcatgcatcaaaatgatgatttagcatgcatttatgttgagttttagaatgtcataaaaatcatatattactatatttgtatgttaagttttgggtgtttactggtggatataacatgattatatgttaggcattagggtgtactaataattactatggttatatgttgaggtttaggtgtttagtgggttgcatatatatatatagaaggtatagagagctggaatttttatacaggtgtgacgtaaaattcttgggactttcatacggcacaagcattctcttgcaattaaaattttaaaaagttcttagttactccattgaaaataatatcttggtatttaagctcgctttgcttaatctggcttgactataacaagcattcattaagcaatgaaaggacactataagtacagagtcactgccagttgacagcaacttgcaaccatccaatgggctttccttctttctttaattgtgtttttggtttcttgtttttaaaggaaatcttttcagttttcctatactgtaatcatgcttcaccggacagctggtgctgatgaatttccatgctgtagcctgtaagttgctttcgttcattgttattgtacatgtgtaaatatcattttcccccatagagttgccaagtgtgccctctgttcttgtttgatttaggatgaaggttttactgcccaaataccatgtcaataaagatgcgaatattaggcaatgatctaatatcaaataattagaaggagcgaaacttcaaacccacatcgtccagctcacaccttgtggagcccctgggcgtttctctggcattgtagtattttcggaggagggttgttttgaatgttgttctctgaagaaaataacatttctatttaattatggatgaatgtgagatgaaactttaggacagctttgactagatgtgggataagtcgtatcgaaatgatagaatgagaatgcaaccgccaagtgatggaaaaatacattttcttctctaacaaaaaatagttagatgatataaaagctagaagaaatagaaaaaatacaaagaggaacatcaagtgagttttgtccgtactgatagtatgtaccttgggcttttcatctcttctatgggctcttgtcaacatcattttctactagcagaatacacgtacttctgttatgggtttggagcacacagcatacgataatgccaatgtcaccatctaatctacccatgccattccgaatttccgactactatatgctctcatctgcaactctctcatgtgttaattaactagtcagtatgaaaatggatgaaggatagtggtcctatctgtaagattgcagtcgatgaagtggtggcagattcaccattatcattggagtcttttaaagaagtacataaggtacataaggtatatatatctttgaaatatatcagcattctctatttttatttctgccataaggtacatgcttctttcttgtatttaaacaaaaatcggcataccacacattcttactttatccttaaggcacgaatactagcgcgatgtcagtgtctagagtagatgtcacgtagattttttttttaataaggggaggtgagataaagaagcctaatagacaacttaataccatatatatgttttatataccatctacaaaactaaataaataattaattatactacggacaacctattttatgagttatatgtatattgtccgtatatgggatggaatgattacatagaccacaattgtctcgacaacaaaaactatacccttttgtgcttattttatcatggggggttcccgccgtcagctatctttccatatagtgagtgtaacggtatatcataacctctattcagtacccaatatcatcctcacctctctacaaaattcattaatgtcttttttttactgagtacaatattgtagacaaaaaaatataaatatttttgcgccattgtagtagtagaacatgtacaatttgcagggccatcccagaaaaattcattggccctatatggaacgctaaatggacctaaacttaagttggcttgtaagttgaaacaatgaaacaccaaatcaactgatttgtatatacaaaatatagaaaaaaaagaaaagaggaaaaataaggcttggacttggaatttactccctccatcccaataaaaaccaacctagcattgtttacgatggagggagtataccggaaggctggagcttgtcgttgtcaatcgccgtaaccatctcctacggccacaaaataattaagagcaatgacggcgaccatgagcgctcagtgttgttgctgccactgcatcctttccatgatgcgatactgattggcatgacacaaagagcaaatgtgaagcgaccctagagacaactacaagcgagtgagacaggagaacccacaaattaggagatacggagagttgaagagagattgtgccaactatgagctaaaaaactcatttgaacaacaagaataataaaaacaaagcccactataacattatatacttagggtatttaataccacttggggccccttggatttaggggccttatatggttgcatgccccgcaccggcctagggacggccctggcaatttgttgtggaaggaaacatgaccttttttacatttttactattgaaacgaagacatgggtgacaagtatcaaagacacttcttttaagctgaaaaaaaatactactaacctaatgaggatagagcgagaaaagaggatatcataataagcgaatgagaaactgattttttccttgccgccaccaaagggagatagtgtcgaaactcaaaaaatgtccaccaacacatcctctcctttatcttttgctgccaccaactgccatgggcctatgggagcactcgaggaggcacatctcaccagcattgagtgagagtacagacggattttatcgtaaaccatggcgacgatgaggtggccgcttacgccaaggggttagtgatgcacatggtaatggtggggttgacgaggatgtgcattagttcccaagagtattgcaagccttccatgatgttgagactttggcgtgccgctgaaccttttcctccatgcaccacaggccagtcaacaaacttctcggtcgttagcactgctcatggccaccgtcggttggtgatggtgtccctaatgaattggattcaatgagagtggaaagattagggaaatgacagatttattacaacttagttactctttgacatcatcttccactttagttcgatgtaagtcgccaatgatgatgtgcgcaaaaaataagcgacacaatcgctgctttcagagattttgtttcttcggagagtttgcttcctggctcgaggaggacaatgattacatacaacttgcaaaccgttgcgtagaaacaacagttatgcatattttcgttaactatagttggaagtttagcaatatgtgccatctctaccttcaggctattggtctaagtagttttgttggtttcaatcgagttatgattttgtaattcatagtagtttgaactgcaacatctataataattagttgtaacttctttgaagtaaagaccggaatggattctattggtgaattacaaagcatgatccccaatatctgctgctcgggacgcccatcaacacgctatcaagattggatggcctacatcgacatgtcggtaagtgacaaaacttcccatacctaacccctgtgtactaaggcctttttttaaagaactcgatcactgtggtattcctccattgactacaagagaagatccaaagccaccgaaaagagggatcagatccaaccttagaaacttttaaacacattcgcaactccatagtaacttagcttctaaaccgctgagcaatgaaagaaccccataggagtagggtattacgctcagtatgacccggacatgtataactgcttttcacctcatttactcacgtgattactcttgttctgcaccctcgctccctagcccgaacttacatggagaggagaggagggtctatcgattccgtgctcgaggtgatctttctgcgacaaattccattatctatccactttgcctataaccctggcgatggaagcgccggtgttgtcgacctcccatggtctgtcaccatggaggccatatccaagtgatccgagtcatcttcatcatggtggtggctagcttagctactgctactgaagaggagaacgtctaaagaaatggggatcatgattaggggtattttaatccataaaaatatacggtagaaaagacgattcaaagcatatctcatacgtataatgtgacgtggatctaattttagatttgtcacggtggtacggttttaattatgtgaatagcatagattttaaaagttatatgacatatctattttttttattaaaaagatcagccgtcctgtccatgtgagcaacaaaaaaaaaaaaaaacttcagcgcaaaggatgaacggccgagatttgacttgggctaaaccccagtagaaacacccccattttattgcttctctctttgctccgctaccgttttccctttcccggtgaccgccgccgtcgcggcgccaccccctcacccatggcgagcttgccggaggcacccgtaccaccggagagcgcacgcatgggttcacccccgccatcccattccccttctcctcctcctctccaaggagacccctccctaccaaccgacgctcctccaccggagccatccccccaaccccaccatgccaccccgatcccgccgccgtctccaggtca

SEQ ID NO: 31200 - DNA, 11775 bp, Oryza sativa
  unsure (1)..(11775): unsure at all n locations
ccgccttctttcttcccctcgctggagctgggtacctcggcggcgccacctgcgctggaagccgcggcggcgggggcggggcagcccggctccccttcgccgtgtcctcccgctgagccggcggccgagttctaccccgggtcggcggcgtcatccccttcttcctcctcgtacgaaaccgcgcagtatgactcgccggngttgcctccgcccactcttccgccactggtattatgcgcctcgccggattcatcgtacaccgagtcctcccctacgcgcgatcgcttcggcgacgaggagggctcgcacgcggcgccagagccgccgccgccgcggacgccattggagggcgggccagatgcatcctccgccgagcccgcggcaatggcgtcccgtgcgcgcgaacccatgggctcgcgcaccgcacgtgaaccgccgacgccgccattggagagcgggcaggaggggtttcagcagcagcagccgcatccaccgcctacaactcatccggagtgtgatagctcggagcctgcggagctgccgcttcctcccactagtccggctgaaatcgcatacacatcgccagattcagtcgaggtcgatgtagtagcggtgtcgccagaggaagctcctggttcaacggttgcaatggaggtaatgtacggggagactgatacctcagctgtcagtgtgtctccggtattggggagtgcggagacagatgcagccgagatcgatgtaatagcagggatgcaagaagaagctcctggttcaacggttgcaatggaggttatgtacagggagaatgataccgcagcagtcagcgtgtctccggtattggagagtagggaaccagatgtggccgagggcgatgtagtatcaggtgtgcaagaagctcatggttcaaagttttccatggaagtaatgtacagggaaactgatgccgcagcagtcagtgtgtctcctgtattggagagtggggaaccagataaagccgagaacgatgcagtagaagagatgcaagaagaagctcatggttcaaggtttgccatggaggcaacgtacggggagcctgatgcctcagcagttagtgtgtctccagtattggagagtgtggagccagatgtaactgagattgatgtagtatcagagatacaagaagaagctcctgattcaacgcttgccatggaggtaacgtctggagagactgataccgcagcagttagcgcgtttccggtattggatggtggggatccagatgcagctgagaaaaatgtagtagcagggatgcaagaagaagaagcacctgattcaacgcttgccatagaggtaacgtctggggagactgatacggcagcagttagtgtgtctccggtattggagggtgtggatccagatgcagccgagatagatgtagtagcagggatgcaagaagaagctcctggttcaacgcttgccatggaagtaacgtacagggagactgatgccacagcagccagtgtgtctccagtattggacagtggggatccagatgcagctgaggttgatgtagtagtagggatgcaagaacaagctgctggttcagcgcttgccatgttggtaacttacggggagactgatacctcagcagtcagtgtatctccagtactggagagtggggagccagatgcagcccagattgatgtagtagcagggatgcaagaagaagctcctggttcaatgttggccatggaggtaacgtacagggaggttgatgctgcaacagtcagtgtgtctccggtattggagagtgtggagccagatgcagccaagatcgatgtagtagcaaggatgcaagaagaagctcctggttcaaagcttgccatggaggtaatgtacggggagactggtaccgcagcagtcagtgtgcctctggtattggagagtagggaagaggggtcacttcaagaatcaatgcagagaccatcttctcccacaatgaacattgagcaagagtcaatgcagagaccattttctcccacaattggcactgagacaagttcgccagagatggctcctgctggatctgagaactgtaaagtatcatggttgccgttgccccctcctacaccacttggcgaatcaatgccctccttgccagtcgcagctgcccccaaggttttattggtgatgccggaggaagcggttgagtcagtcccttcatcggaagctctggatgttgaaaaacctgcctccatcacacaggctgagcccagctcacctaatacgccaccgccaggatttgagaattttaagtcgtcatggttgccgctacccacgactcctcccccagttgaaaccactgatgtcttgccagatgtggtggttaccaaggcagtggaagcacccattgaggaagtgtctaggccattgccagctttggaggtgacaaacatggagtcagacactgtcctcagtatcttgcccacaacagtcttgccaacagaagggactgagggactactgcaacaaccactattgagacccccttctccagtggtgcaatctgaaccatgtttgcaaaatgagatggcacctccagggttcgagaattttaagtcatcatctgaaccatgttcagcagaggagatagcacctccagggtccgataatttcaaatcatcatctgaaccatgtttaccagaggagatggcacctccagggtttgaaaattttaagtcatcatctgaaccatgttcacaagaggagatggcacctccagggtttgagaattttaagtcatcatggccaccacttcccactttgccccaaactgtaccagatgcagccgcagcggatgctttggcagcaacagtggaagaagcagctgggccaccacctgcattggagttggaggcaatggatgtggacatggatgccatacatccaccaccgctgccttttgacagtggagtggagtcattgcaaaagccactgccaagagcaccttctcccataatgcaagaagcgccctgttcaccagatagggcaccgccagggtttgaaacctataagtcatcacagttactgctaccatctccatctctggcacaaaccacaaatgtgcgacaagatcaatcggtaactgaacctgtgtctgtgatagaggaagcccctcagctactgcactcagtggaggtaatgggtgtacatatggatgcagtacctccattgctaccatcatctgaaagtggagcagatgggctatctccgcagcaattcgcgcaacctcctcctgcagaaaaggatacaacaacctgtttgccagatatggtgcattcaggatgtgacaattcagagccctctcagcttctgtcactgcctgctgttatttctccagttcagaccccagatggcttggctgatgttcctgccattgacagggttgcagtggcattggaagaatcgcctcagcgaccgcttgtatcaggggaaatggaagctggcacagtgcccattcggtcatcaccactgaagaatatttctgaggggtcactgccacaactagaatcagagtcacattctcctacatcacaggctgcagatagcttactagatgcatctgactcaaagtctgtggctgtggcctcagaggagatgtctcagctaccacttgcatcgcaggcaactactacagaccttgtcagtacaactgcaatgcagccacaatctgagggtatagtggatgagtcattgcagcctcagcatccaccctcttctaccgcacatgattcaccttgtttacaggactctgtgccattggtgccaccaccaccttccccttacctaaataaaggttagtatattgcatctcacttcctctaattccatgtctatataactgctattgtttgtgttgacttagtatttgtgatgagtttgggggtctttggaaggtgaaaatgagtcagtgtgagattggatcaaacaccatgcagaggctctgagatgaccaagtttctcaggaaggtctatttcattgataccctgacttgagtacataggacgtccacgtacatggctcactaagctaaagaaacatcttatcctaaatatgattctcttaccactaacaggaaacacatttctatcttatctattctaacctcttaacttggcttccttgatgttcaaggacaactggacaacctggccagccttgcgtgctcatgctactgggtcgtgtttggagttctacgaacagttttctttccattgattaatcatgtaccaatcatatgcccatcttagactatataagtttcctataatttgtgaaaaaagttggcttgttttttgtgattctcagtctttgatatgattttgaaagaagaatgctcatgcaaactgtggctagcagatataaatttaatgaactagttgcgggaatcagcattaagtccttaaagtttaccaagcatgtaatgtgctttcattcattcaaaaaagcatgtaatatgctcacttatatctccattgatcccctatttgtgtatacctggtccctcttaagacagtttcagccaaaatgatgaagtttgattgcaattgtgaaatatagtactaacttttttttagagcaatagatgaaaggaatatactatgcttctgtgtaccttctctttggatgttatccaatccctcaatatcaattcatacatagttgtgaaccaaagaagtcagcttttcacccataaataaatctggggctagtatataagtaatccggtgtaattctctctctctctctctgagcataagtaacctctgttgctaacttgtacagaagtaggtcaaatggtatgtggaagctgccgtattcttcttgcttattttagaggtgctggttatgttcactgtacttgttgccagacaatgaactatgtattggaaggtgcgtactatttctcatttgcccaacagtgttttacttttgttatgccccatataatttttattttgtctttcaacacctatagatatcagccatcttgtatcttacttctgtggaaatacttactgaatactgaacatgctttttctcaaaaatttgccttctgctactgtctaaattatgtgtaagaagtatggttggttacatatttcaacattggaccactcaatagagaactggagaattttgcccttgcctttataatactatttgttcatgcacaccctctaaagctttttcatgcaacacttctgcaaaatatggatgccatttgcgcaaaatttatctcgtctttgtctttccttttgaagcacggctgtccttaatatttccatgtattatagcttttaccaaatactgatgtaccgatgtgtgtatatatgcatcttcttacccttgcatgggttttccccctatgtttgttgcagctcatgaagttggtaaggtgcattgtggacactgtgcgacattattgatgtatccttttggtgcgcctgctgttaagtgctcgttgtgcctctttgtcactgaaattggagtaagtgaactatggcttgtgataaatttacttgctatatgtgcttatttgtgataaatatgttgaaaaagaaggtaatgctacattgaaaaaaagagagagagaactgattatgtactgtgcatgttggtcgagttggtttactttctaatgaatatgactgccttagattctagatttcccatgcatccggttggctatatgagctaaatcactaatcctgacaggcattatttgctatgtaagcatgttgtactgagacctattgtttatcaaatattaaggtgatactacataaacttcaatatttgctctaaaaggctagaaatccccatattaatcagatagagggagggaggttaaccagatagatatatggtagatggaaaggagggatctgaagtctgaagcatgttctgagcatgactcaatatgctcctttaataaaatgtcgtggctcaggtgcttcatatataatagacatggtttgctttatctgaatcccagtcaacacatgaagcttttatcttcctccttgtctcagataatcatgccgtgcactatgatagatctgaagcactacgaactgtctttgactgtgactccactttgatgccttcagctttggttgcctgcaatcctttgctgttcccacgctttcattcagtagatttcttgatacttagactgtcgttgcagtgcataattgttcagctatttgccaatacattgatctccttcaattctttgttccttttgttccaggagcggaatgttcgccgtcggttatcaatcgagcaacccacaagaactaactcatcagggctagctgaagcctgatcagttctggtcccatgtacccatcggattccaagaaagcttcaaatgctaatgtggatgaaaggaacagaatgttcgcccttcgtcatgaggtgtgggcatgaaagttcaagatggtatggacaagccaaagtgtacaaagatagcgttttttttttcattgatgtagacaggaaaggtgaccttgttagtacgactagatctcctttgaaagggaaaataaaagaaaaatagttcgattcaatctggaggtgatatgcgtatgtcatatgaatgataacagagtagttttcagatggttctttcgcggtgaccatcatgttgccccctgacgtgttgaggcttgagaattagccatgctgctaatcgtgctttaggccatcattgctggagacacttttgcagggattgctcaaacttantttcagagttcggtctgtggtttgggcaagaattgacctgcaaaattttttttgaaaacatctggaaatatactcaatgtggataatggaaagtttcagcttaaccaaagctctctctagaacaatttgatattttatttgattcctgcaaatgggcacaaccctcagtttctgacttgatattaaggtaaaatctcatctaaacagtaattttgtcctcggttaagctttttttagtttagcataaaacaaagtagtttatcgcatactctagctaaacgcgaaaaccatgcgagcataattaattgagttttaattatttcaaacttaagaaaatagatttatatgatattttaaagcaacctccatcagtttagcagcttgaaaaacttgctaacacaaaccaagataaaatcggtaatcagagaattagattgagaagactatggctcctcagttctcaacatgtgggccgaattctttactgtgcctaactaaatgggccgattgcgcaatcggctaaggaaaacgaaggctcacgtctcgtcccgacgacgtgcggccgggaagcgagcgagcgagcggagaccccctctcggctcgcccatggagttcggcagcggcggacgcgacgcccgcgcgcggcggcagctgcaggcggccgggcgcgccgcggcgtacctcggcggcggcttcctcctcctctccgccgagtcctccgccgccgtccgctccctccgctccctttccgacgccaaccaggtaccacactacaacacacccaaacccttgtcgctcagtttgccgcctccgcctccgccgccgtcgctgccctgacctgaactgggctgcgctgctgttgcgcgcagaggaaattcgcggcgccgtgtggcgcctgcgaggggaaggggacctacgcgtgcaggctctgcaggggcagctcgacgatcgagtggtctccgctccacgacccggtgttcgtcaacccgtgcctctgccctacctgtgacgggactaggttggccgtcctttgcggagatttccttgacctttggtcacgcccctttgaattgctgtgctgctgtgaccatgctgctatggatgtttgttgatttttttttaaacatgttttcagggtgcagcgctgcttgaactgccttggaaaaggctacgcttgaaggggcaatgcgtccttgcgtttggcttatcgttggccactgggatttccgcacggtcagtctctgttcttgctaaagtttggtgaggacgtttcaagtgtttacagatgtggcttggtcttgtgctgatgaaatgcaaatgataggtgattgaattggatggtttgtgtcgaggaattaggcctttttaggggaagttgagaaattaggcttgtaaggaggaatttctggccaaaaactaaaaccaaagaccaacgtgtataataaaatgtgactttgattttccctaccatttttgtttgtatagaagaaatataattatgctttctgaatgtatgcagaatattcagatgatagacataagatgcttgagattctcttttgatccattgggttttcttgtaaatatgtaatgaggttttgctacaagaatggctaagtattagttgtttttgcttttcagtatcaactgtcatgacagctaatttctcagcatattattttaggtagtagtgttgctcaactaacaatcaaaaacatgatagaaaccccttaaaacctttaacatgagtccagtatttggtttgagaaggatcactccattaaatgttttgagccccagatcatgtggctgtgagcctgtgaggacaagaatggtcatcgttcactcttatcggctcaacagtcatctagttgatgaaataaaaactgcactgtgtcatgactacttccattcacataaaaaaaggtctgatggtgtaacaaattagtcacttaagtctgtgttctgatgtgaatccttaagggccccatccctgaaatagatagtatatcataattataactggcagggtgaaagtaaaaaaaattctctacagtcatccaactaccactaatactttaattaccatgttctcaagttttgaaaatcttggacttttaggtatagacagtaatgtgttggtttttgaacatagctgtctacgtaagattattttttgcccctgccgtttgtcccaaaataagttcatttttaagcaatcattgcatcggagtttgaaaagggataaatgcattgggagtagataaggagatgaataattgcattggtattttataaagtgtgggtattatagtatttctgattttgtattggtatgtgtgggatgggtgaaaaatgagcttattttgggacacaaggagtataatataacaaaatcacggtcgtgtataattatgccatgaaccttgagcaaataaacatagaggtcaataaatcaatctgttattgccccccccccccctcgcttttctttattatttgacagccatttgaggcaaatttcagcgttgtcacaggaaaaatcacatcagcctctaatctgtaactttcaaagtatgtatgacaatagtgagagatgacctcttacgactatgaaatatgtttgtttcttatatacttccttcgttccacaatgtaagactttctagcattacccaaatttatataaatgttaatgaatctagacacatgtagaaaacatatatattaatcaatggatgaatctaggtaagtccaaaaaatcttacaatatgaaacggagggagtaattgttaaacaactgtggatgttgtgtagtgataatctactctaagaatgctggaagggttataaacacattttagcttttgttttggtctttgtcattggaaaaatcgtgttcagatcagcgaaggtaatttttaacacacattattctttattcctgaggtatatattttgatgatttcgtcctttcgtatgtgcagaaaatcgcgtgtgcataaagggcaccaatatgtacacgctgatatagttcggcacttgctttgacttattcaatcatatacagctttattaacttaagttgggtagtagggatctgtatagttcaattaagcagttgacctaacaactaatgacacgaaaacttatgctttgcttgttcattttaacctcctaattattgcgccccccccccccccccaacattttgtatgaaattgccacaagttgccctatctttgcaagcaaacacaatgatcattggatataacctcataagaatcgtcagtcaactatgttagcatctgccaaatgtgcatatctcatcatttccccaaactgccatagtttttctatcctttaagtattataattttgaaacaaggaccatgccgtttaaataagtacacctgatctcaaccgaatgtggtttgcagttgcagaaagttcctcttctcttcttttttatctacttgccctgtgaaccccataaactaagctagaggaaagggaacaggccagcattttcaattccttgtgagatatggcaaggagcatcgccattggtagtggtaggtactactactactagtattgtttagggagacaggctctcctacctcctccatgaggtggccaagttcctgtcactagctgaagactgaagagaacaacaaatggactgcacccttcactatcccaaggcttgaaaggaacccccataattgagaagaaaaagaaagatcagctcctgtgatcccaaagtcttatctttattttgcctctcttttcatggcgtcaggttagtcggatcttctgcttgtggcattcggactttttttttccccttcgtcgagaaaatggtgcgccggaggaacatttgcatctttccaccccagtaagagacacagaagtcgaccttcagagacgacgaagtgaaagccgaattggtgccagcacgtgcatgatgtgtgcaacgaggctcctggagtctagggaacaaagaatctcacgggcatcattaaaaacttgaagaataaaaacttgaagagcgttctagaccgtgtttagttccaatttttttttaaacttccaattttttcatcacatcaaaattttcttacacacaaactttcaacttttccataacatcattttaattttaaacaaatttttaattttggcgtggactaaacacaatctaatggcgatattgcacaaatggtttagatagaaatgcccaaaaaagatttaaataaaattctgcgtgtttcaacaacatataggcaccgtttggagtgatgagactatgatggaaagcatcaccctcgatggagtggaggtagggcacgtcgccgtctgaagaagggccaacagaatccattgcacaggggaagcacataggaagcacataggtttattaatggattagggaaatgattttgcgctgatcaaagagtatgtttaaatcgtagtcatccattatccctctctcatttcatggtaaccctcaacccattccctgattcctctaccccaatctcactcctcttgtgccgttatccagataaaccattaggttgagatgagggatgcttacaatgattaaaatgtggaagtcgataagaaagaaaaataaataaaagaaggttgtgattggttaagattagaaaatagataaagaattgtcaaacaaatttcaaactttgtgcttattcatggttagagggaacagtaacatattaaaaacgcacgactaacaaatactcactctgtcccaatatataaacaactccagcatttaaaatttgtttcaaaatatagtaatttcttatctactttctcttcttaatcaataacaaccatttgccattcatatttcccctctactttctcttaccaactaatcacaacatttttctattagtcccacctattccatctgtcctaaaatatactccctccgtttcataatgtaa

SEQ ID NO: 31201 - DNA, 18088 bp, Oryza sativa
cattatgaaacggagggagtaacaacttttagcattcaacatttgtctcaaaatataacaacttcttcaacaacattttcttcctaaccaatcacaacctccacaattcacttttcttaactacctccacttctcaaccaatcataacatcttcgtatttaattctccctactttcttaataaccgtacccaactctaaaactttttatattctaggacggaggtaatacttctcaatactcatttcttaccttaaaaattcttatatttttagataaatgtagtaaaatttagtcacatgaaacgttctcgctgttaagtttgtcacgaatcaatttgtggaggagctctgcctgttataagagcaagtttaataatagagacaactgctctcgttataagagctatctataagcttatattagaactaatatataattgatactccatccgtcctaaaatatagcaaccttgtactggatgggtcactattttaggacggagagagtaaattataaggttatctctgattgttttctcttatccctttctcatattatataatatacgtagtatatctttattggaacatgttaagagttaatttttgcatggaagctgactcttctcttttccttttttttacatacttcctccgtcccaaaagataataacctataattggatggataaaacgtttcttagtataatgtatcttgatagacttcttatctaaatatgttgtactggaaaatggcttatccaatcctagatttttatattttaggataaaagtaataagtttttatggcttactccctctgttctaaaacacttatttttatattcaaatatggatatacactatatctatatttggcaaaattggttatgtttagatttaaacctaggccgtgtttagctccttcaaaagttgaaagtttgggttgaaattggtacgatatgactaaaaggtgtgtgtatgacaggttgatgttatgaaaaaagttggaagtttgaatctaaacacagccctataaatgttttttttttccggagggagtatagctttgctactgtactcgctctgaccggacggcacgctggctgacgctaccaccacaaggatattctcgcgatcacatcacatcgtcgcgttggtggggaccggccggcggacaacggcagaaacgccatccccaatatccccccatatcccttctggtgggcaagtacggtggatgtggatgctctccgcttccgctcgcccggtcaacgatcccacgcatcctacggtgcgcgcccgcgtcggcgtgacggtctctgccgcgtctcgtcgtcgcccacccaaagccgcccgcccgtgcgccgcgcgcgtctcgcgcgtttccgtcgcacggcgcgcctgggcgtggggcggcagcctcacgctgatccccgacggcgaccggagcggccgctgcgattctcaaaagtccaatctcatatcgtctcatcttgtgtgtgtgcgcgcgcgcgcgcatgctgcgtatcatcgccatcaccgtccactcaagttcgtggacgccagaggcgaaaaaaaaaaaagagcacagaagaccagtctctctggtctctctctcgatcgatgagcagttgcccccacaacattgggaggtagagattccaagtaggtgcaccccgtgctgttggtccgaaatgccgcgtgcatgatcctacaaaagcgcgtgcgtcgcatcctcgcaggggcggggcggagcgtgtggcgatgagcgacgcagcctgtcgattagtggctttctcggtggcatgtgggcaaatgggcgatggtctacccgtatctgcaagttgtgcgtctccatataaagttgggctcacctataattcattgagtcttgtaccttgggcatacccttagagaattatactgatggagatgattaaaagcaagactaataatacagccagctgcttactgtatagatccctatagtttatctctcagctcactcatacagtggctaactctttactatgaatatatggttcacctatctgtctcatagatttttttgattcctgtgcctaagccaactataaacttatatcctgcttcttatctctctcctttcctctcttatccacctcagcatttagcttttttatagccctctattatacttgctctaatatttgttcgcacctataattcatatatcttttcaaaattgtaattaacaaactgaatttgaaatacaaatactatagttgactaccaaaagaccactatcacccgttgcctcaaaaggctcaaagcctcaaaccggtcatggggttgaaaaaaaaaaagaaagaaacatgagaagtaatctcttatttttcttcttttctggagaggaacatgaggcgcaatatatttatctctctagcgttgaaacctagcccttggaacaatttgtttatgttgtcaggctagctgtttttgcatctccacggaagtgattatacgatgatttcctgtattttgcagtttggatcacgtcatgcttctgtcgacggggatacccgtagaccggatatagagggtattggggtacgctggtacgaggatctacataatacgacatcaagcagacagaaaacaaaaattatactggttaaaaccccttgataggtaatagcactaatccagttgatatgggattatatgatggaaaccacatattataaagggaaagcggaacttgatgataccgccgagatcgtaatcgagcaggtccgattagatctcccggcgacttggctcctgcaggcttcaactccgtagatggtggtggatgtattggctatgagattcgatgccttaggtcctcccgggggtcccttttatatcgcaggccaactggtctccaagtaggacacggaggcatcggacccggcacgatacaatgacgacccagttccgtccgagtaggactcctttcatctgtgaactccatgataaatttccttaacgtatgcaaaaaacgtccgtatacgtgcaaaggtaccatatcgatatgtgacgtatatcgaagggtagagggtatcccttacccgtaaccctgacagcttcggcaaggcatgatgcccttttctaaccttttgacaactcgaggtattagactagttagagcatcccatcctagcagctcatctaaatttaatcctccatattctcatatggatggccatccaaaaaagattccttcttcatataccttcctactccaatagatcattcatattacatcctccatatcacaacctcctatattttactaatatcttccaactaaccatatatttgtgttattttttaagggctatatcttgaacaactaaattttaacggtgttatttatcacgataatgtaaataagtgtattttaacctatatatttttaatggataatttaatgcattaaattgtgactttctcccagactatatttctctttttctctccttttctattcctccttctctctgcttctttctacactcttctccattctttccccttctctcttctgccgactgccgcaactctcctctcctctcctctcggcgtgggagacggcggcagcggggcaaccgagctggcagaaagcggcggcaggcgtgtagcctagggacggcggcggccgggcgggcgagtgacgggggcggcggcggaggcgagtggccgggcgagcgaggggcgggggcggccacggaggcaagcgaccgggcaggtgagggccgtggatggtcggggaggaggcagccggcggcaggcgagcgaggggcggaggaggccgcgcatcttgacggcggcaggcgacgcgagcaaggagcagcagcgcgggcgcaatcccgataggggcggcacggatggcggggcctccactccgacgaactccaacgacagacccggtatgtccatcctctctattccccatggtacaatccagatggtggcacgagttcatctgagctgagtagttgggggatagcgtgaggagagagaaacaccaaatttggcatagggagggctcggtttgaaggacctctaaaaatgacgtgtgtgatggaggctttggtggagcgtgttttttcatctccatacgctaaaaatgggatggatggctagatggaagagctgctcttaggctgtgttcttgcgttatgattggaacttcttccctagaaacgtaaaacgaaacaaacttattattgcatattagcttaaaaaactttgaagtggattaatataaatttttaaagtaacttttctatagaaaaattttataaaaaaacatatcgtccaaaaacatgtgcgcggaaaacgagccagtcgaaaaacacagcctgatgcttcggcccggtttagttccccacttttttttctcaaaataccacatcgaatctttaaacacatgcatggagtattaaatatagataaaaacaaaaactaattgcatagttagggagaaaatcgcgagacgaatcttttgagcctaattagtccatgattagtcataagtgctacagtaacttacatgtgctaatgatatattaattaggctcaaaagattcgtctcacggtttccaggcgatttataaaattagttttttcattcacgtccgaaatctcctttcgacatccgattaaatatccgatgtgacacctaaaaattttcttttagcgaaataaacatgcccttctacctttctcccttgctacgagtactagctagtactcgtactttatttgccggttccgtgatgcttcattggtcacaaaaaatactcgacatattgcataagcatgtgatgaaattctttaaaactttgtaatcatatttagatagttgtacgcgtgaggctacctaggcctccaatatctctctagacgagtgttagccacgcacgtggatgtgtgcgtccttgagtttgcctaacttgtactcgaaaagaatatttatatatttttttctcagaacatatttttcatgatagtatagtgtaatattagtttttaatttctcatttattttttgtatgagagagtagattgttcaagaggtcgtcttgatctctggacttaattgtggagctaacctttacccagatatacacctggctcaaccaggtattaatgccaaaaaaaaaagttattttctgctaaatggatgaatgtgcgtgtaacctgaactcctaaaccatgcgattgttgcaaactttttccatatatgatttgttgtaatattgtttcaaatccatttttaaactttaaaatgattgatttattcatttgtgctattgaataacttttgtacaaatcttccatcgaattaatcattcagcccaaaagaacaccggaatgggtagtacgaaaaatattaatggaaaactatatatgcttcacaagttggaaaagtcatattcatcattatatagttagaatctttcccccaaaaaaacggaggcagacaaactgtagttgaatattgcaaaaatagagggagcgttattgttgctagttgtgtatgcctgtgcgtcaataaacaaaatcaatacgtttcgtgagcttgtaaaataagattcattgattctcggtagcgtgacactgcagataggctgtggagtattatgcatttattatgttccgttcatctcaaaattagcacagcacgaaaattaattaattaacgaacccgatttaatccatggcacttgacaccattcgatccctatctggagggattcactgatactgaacgctgaccattcgatccctatctggatggattcactcatacagcacgaaaattaagtagtaagaatgattaattataatacttctaaagataagtatgagatttgatttccccgggtgtaattatcaaataattttgtccagttttggaacagatgtgagtgtagtaggtaaggtgtgtgcggtgtatgaattgggacgacggagcgatgtaaagaattagataagttagaaagggaaatgctgtattacaaatttacgagccctctcatccacgtaaaaaaaaattatactactagctctgtcacctggcacgtaaatgatagtgacgtgcaattagttgatactgtgatttttctcattggttagatcgcacgtgcacggtaagaaaaacgtaaagaaaatgtggttgtgcattcgttgacacttgggtgtgttcttctgggctgaaggaaataaaatgcaatgctgaataaaatgattcaagggcacgacaaaatgaagtatttagtataaagttaaagaaaggatatagaataatattttgagaaaactatatgtagaaagttttctgaaagctcaagaagcatgtgtacttattattatatccaattccattaggtggaaaagaagttcaaaattctaggtttaacacctgtggccgattatattttataactttatatgcatgtatatacatgtatgtaatgatacgtgtatcaatgctcttaaagcatgatgagcttgtttagttcagtaccataccaatattggtagtgctaagatttagcattactacttttttaaagtagggtgcaattgtatttggtttgatgtcaatttagagtcaaactttgagtagaatcaaaaatttttggggagtagctatatttatgacgccatattttttattaaaaaatagtcggcatgtgtttacattgtaagtccctaaattacatatgtaattttagtgtatttacaatgtaagtctcaaaattacatatgtaagtcctaaaattatatatgtaaatttcaaaattacatatgtaagtggtgtgtaagtgggatgtaattactatgtaaatttgtataaatatatgagaagtgtcttttttttttaagaaaagatgtttgctaagctggtatgagcgtgctatgctgtactcccggccttagcatactgctgttttagcaccaatcttgacatcaattcaatgcaccacaaatcgacatatttttaagggaaaaactgtcaccactttttatagcgtttctgaatttaaattagacattaacaacaccaatgattcgacttgaaacaaaaaccattatccagactacccaaatattaatagggcatgttttgacattacggatgtctcaaacaatatttaaagcacgtgtgcacggtacacgtgtcccagatggagtagtttacccaggggaaagggacgccgccgcaccggacgaagctgctgccataccactgccagatggaggtggcggagcaccgaactaacgacgaggccgtccccgttcctgttggattggactggaccttcgcgtaggagcgcgccgatacagacaacgagacaagccgccgtcgcgtatctcatctcgtgtcatcgagtggtgtgtgacgctcgccgaacggcgtctccccaccccaaatctcacttggttttggacctcccgactttggtacacatcacacaacacaacacaacacccggaccaacagagaacaaggcgccaaaccaaaccgccgcgcatcctcctctcgccgagcagcagccagccgcggcgcacggccgcacgcacgcgcgcgcggcctcacccgtaaaaacgacgcgggagcacggcggaaatcgctgtcgacgacgatgggcggagagcccccccgaaccgaaccccaccgatcagtttcttccatccaccacgtcgcggccgcccgcccaaccgcctcccgccacacacacacgacacaacccgcgcgcggtcggagaggccattctcgccgtatgccagttggggccgatctcccgggggaaaaaaagaaaaaaaaattaaaggacacgaaacgtttcccagtcgacggacggagcaaagcgagtcgtccggatccgctttaaaaccgcgaccacctctgcttctccccttctctctcctccctcctcccatgtcaacggcggccacccccctcctcctccacctacacctttagagagagaaagccctggcccaccgccgccgtgttcttcgtcgtcgtcgtcttcttcttctgcggattgtggtgctcggtttggtcggtgagtttgggtggctggcgatggcatttcgcgggggacgcgcggatcgtcgtcgtggcggtgcggcggttcgtcctcgttggcgtggcggtggaggggaagggggaggggggaggaggaggaggggtgggggtgtgcttcgagaggatattcagcttcggggactcgctgacggacaccggcaacttcctgctctccgtgccggaggacttcccggaccccgcccgcagcctcccctacggccagaccttcttcggccgcccctccggccgctactccgacggccgcaacctcctcgacttcttcggtatcacccccctcctcctcctccttttcatttcatttttcttcagatttttttttctctcatcctgccatccgggaccgggacccccttcggcttccctgtttgttttgtttattctgttggtgtcgggtccccctctggtaaaatctcctacgttttggtggtatgaatggatcaatcgatgcagcaatctacttgaagattagtagtagccgggtaattggattgattagttactactttttggttcttggtttctctccttgatgaatactccacgcgtttgatttttcttcaagtaataaattcatcatcgtttcttcttgtgagccggcataagcggtgtggcgatgatatagtatgataatttccactgtttttgtatgcctgcaatgcatcgaacaagaataagccacaaatttacttgtgtctgcaaatttatcaattggcctcactgatcataacaatttgaaatgcgcgtgtggttcagagatgtgaactagttatagcaaatttcactgcaaaatacccaacttatacagggcgtatccgcaaaatctgcttaccttccccagtttcccccaaccaacagaccatgatggcatcgtcttcttgaacaagcacacaaatcggtagctccaaccaccactgaatcagcattcacatcactcacgtggtcaacacttttattgcagtcttcccaaattttgtgtcctttgctaatagtatctgttccatggggttggcttcctcatgttcttgtatcttagcagctgctgtcgctagcttcattgtccttagagatgacgtgcactaacattcttttttttttctttgcgtgaccagcggaagcatttggtctgccgttcgtgccgccgtacctggctggcggcgacttccggcaaggcgcaaatttcgcggtcggcggcgccaccgccctcaacggatcattcttccgggaccgcggcgtggagccgacatggacgccgcactccctcgatgagcagatgcagtggttcaagaagctactcactactgtctcctcgtcagagtccggtacgtcaccctcctgagacctggagttctttgctgttgctactagtatgtcggataagctgatcgatgcatgagccgttattaaccgtgttagtagacgccaaggaaacatgtgagcgtggcatcacagcatgccagtggatacagtaaatagtgtccaaacatgctgaaaaccgtgcagatgagctggccacctactggccagaatggttgttcagtacgagcaaattgctgcatttagtagagtggctcctttccctgtttgcaacttgcaagcaagcactttgtttttagttggcttgtaagctaaagttcactagttaaatggcaccgcaaaactgctacttggagccttctgattaggtgaaaacattctgtgtccttatatgtgatgagatagccggctgtgcaaatattgtaggatatttgtggaaccatgtttaaccagcaggctggtttgacaggttttaaccagcagcaacatgttagaaaatctttactgggttgtcaaagcaaaatcatctcgtctaactgttctagagtggcactgaattacatgcatggttgagacataaaagccaagtccataattccaaaatcgatgaagtacacatagtggaactcaaaagccaattataatactttctcagcatcttgatactatgcatacaaaatattatgaacgaaccaccttacaacaacatacggggggtttcatttttggtttctcctcacaagtcacaagttgattccaaaatacctgtgcgtttcatttttctgatgtcacaagtttaaaaacctaaatctcgagctacatgtccgctaaattattgtctatctctgtgcagaactcaatgatatcatgaccaagtcacttttccttgtgggagaggtaggcggaaatgattacaaccatctaattgtcagggggaaatctctagatgagctacacgagcttgttcctaaggttgtcggtaccataacctcagctatcacggtatgcatatcacctgcctttacatttatgtgcgatggtgaatttttatgaagccgtgttcatagtttacagttttgcaggagctcataaaccttggagcaaagaaactagttgttccaggaaactttccaataggctgtgtaccattgtatctctcaatctttccaagccaaaaggaagactactatgatgagaaaacagggtgcattaaatggttaaatgaattcaccgagtaccataatcgattgcttcaggaggagctggagaagctcaggaatctttaccccgatgtatccatcatttatgctgattattatggtgctgcattgaatatattccttgccccactccagtttggtgagttccaccttccaactaaaaaattattaacacagagagcacattttataagtggtaagaatatttgagatttagttataggtcaagcataccttagtcaatttacatgagccttcaaaacttccaagcgtacctggcctgcattacattcatttcgtgaataaacttcaattaggaagaagctgatggttatagtcaacatggatctgatagtatatgctaaaacctgtcagtatttactggatatagcctgtattggccctccatgatatacaaagctctctgacttcgatgagcttctatagacttgatgagtccatgagccaattaaaatttattctattaaattttgctaaaactgttaacatggctagcatatatcatatgaactttatgtatccatattgattctcaatgttctaaaagttacctcatgtccacaaagacatgttttggtgacagatggagtaacttgttgactttaggtataagtaactaatggtctgtaaagttggtatattcttgtgctatattttttattagtaacactatatgatcttagataattcagataggcgaaaataggtattcttttacctatgctactgaataagttgcagaaacctatttcgtgctccactgttcttgatcttattgtgaccttgatgatgcagcacagtctgcaccccaccagcagggatctaaactagccttgcacttatcttcatatgcataggcattcttaaacatggtcgaggtagtttttaatcatctgaagtgttaaataactactggcgattaatcgaaatcagagcttgaagatgcttaacctatccacgtaacacatacagaagccaatgtttacaacataaggttcactagtcgcattcatagcataaggcccagcatttgatacaaagtcaacaaactcgtcggcccccccccccccttttctctattttcaaactgaccacttttaccagatggaagagaagtataagcagaaatagaaacacaggaaactatgtattccgcataaaacttttggttattgacaaaaatggggctaagaaaggttttgtgctattgcaggtttcactgtcccgctgaactcgtgttgtggaagtgatgctccatacaattgttctccgtcaatattgtgcgggcaccctgggtctgtggtctgctctgacccatcaaagtacacttcatgggatggtctccacttcacggaggcaacctacaagattatcattcaaggggtgctagggtcatatgccaaccctcctctttcagaaacttgtcggggtggagcatacaaagtctcacaacttcatcaatgtacagataacccaacaaacactgtaacgtatgattctatgagctcttttatttgatcctctgagctctagggcatgtagagtattaaggagcaatatagatataacaggccccatccccttggacacttctcaaaggtgagaagagcattggttggggatctttgtacttctcaaatccatttttctgctacaggtagaaaagagattttgtagagcagaaatttgcaattgccatgtccatggctttgcccaacccatttagtttctcagaaatttactgcaacgggaaacagaaagtacaccgtatagtttttcttttagtatggtcaggttgccatgctatatagtatactctatataggaaacaaggttcatgattcatctccaaaaggacaatgtattcagtactgtaggcctaatttccttacaacaaaagcgtatacttgatgcttgcttgttcagcagtctgctgtatatgatcaccctgcaatgttcagttccatatctgaaattggtcctcctgtcttctaagagattgggcctgttcggaggaattttagattatggtaaaatgataagcagctagtgaatctgtagaaattgggaaaattggattctgtcttctaattcattttctagattctataagcttagcttctcagaatctgaatgagaagtagactgtttgaagaagttctgattccgagagaagctaaagctgtcagacgagcacatgaatcaactctgaatgtttggcaactaacaatgtccaaagtcaggctccatggagcaattctggcacggttaatttcatcattttgaccaattagttgccaaatattccgagtaggttcatctgttggtgtcatgttgatcaggaacaggaaactgtctcatactcgtactacctagcaacagaatgaaccattcaagaggatccatgtcggccaaaccaatgaacatgcagttccaaacttcacacaaccaggtcaggtggcacctggtattgttcagatacttcgttcctgacatgtcattacatgattcaccctgacacccgacttcttttatttatagtaatcaataatccttcaattaaatgaatagtaattagaggcaacaaattaggaaaatgggcaggacgataccactttctggtattgtcgacggcgtccaaggtctggtcagtgtccactttctggtttcacaaacggaattggaagccttgtctctggtccaccgcgccaatctcctcatggctgcggcccacgggccgccgctctcagctgctcctcacgacagctcccgtggatgatttcttttttttttcagaaataaatacaacttcaatgaaaaattggcaaaatagatgttagttgactgaaattacctatcgaacaacggttgtttgatagggttagcacagtaaaaaaaaaaggagaaattgggatgcgtgcgtatacatatgagtagaccgaaaaggctaacagacgatcgattgcccctagcgatcacgtccccttctccacgtggtttctttttttttttggcaccgattacttttctatttttgtaaatttatgcacctaaagtttgtacacctcaagtttaaacatctaaagtttagagacccaaagtttataagtcaaaagtttatatatctgattcaaatttgaatttgaattcaaatattttttatatatagtacttttatacacctaaaatttatagatctaaaatttgtaagtcaaaagtttacatacctaattcaaatttaaatttgaattcaaatattagtttatagacccaaagtttataagtcaagaatttacatacccgttttaaatttgaatttaaattcaaatattttttatatatagtatttctatacataaattttttcagctttgtttttttattttttttaaaatttatggtgtagcagaaagagaaggagaggagcgtattggggggggggggggggggtgggggtgatcactgtgggcaatcatccgcccattagccacgccctgagtagactgctacatgtgagcaacacctatcgaattttgggagttcgatttatggaactttggggtttcgatagtccacctgcatgcttgctcttttcgtttttttttaatcaagtcaattcccatgcatgctctttttgataggatatgtcaagctacggctgtttggcagggtgctaaatttgtgatttcagtcgaccaacatttattttgcaattttctattaaagttgtattatttctaattttttcccctcatctatcctccgccgccgcgaggcgcgtccacgcgtgtccacctctcgtcatcaccagaccagctttactatggaaacatgtataatgccacatatgtaatggaaatgtacgtttgctgcatatcaatgtcaccgtaaataaaacttttacaatagtaataaagtttcattataagttttcctcatacatgaagtaaaagtttactcatactgacgtgaataaatctcatctaattttacatcctatggtccactatatatttttcctactgactgacagatctgtcgtcttcattcagattggcagatccctcgtctgcaatttagattcagctacttttgtgcttcattgggatttctagaatccttatatgtccgtcttcatatacaatgtctttgtcgtagatcgtaatgtctcgcaactatggtttttaggtagaaaattcgttctgttataaaacttgttcggattgttgatctgagccggtttagtctttaccgtttactatgatacatttatgtttcggaattgctaaccatcatttggtagaattttagggtgaattttctgtctaattctccatcattggatccacaccatgattcgtgttccaatccttcttctctagctctagcacaactccgacgagatggccacaacctgactagttagagtttcgggattgaggtttgggttggaaggggggagggagagggggagagttccccggtcttagagggatgaccgtggcccgtggaggcaacatcccaacagtgggcggtggaatgggtgagcggggaaggtggcgtcaccgttgccgctgaagccacgggggcaggagagggcggttgactggtgttggtagcgggagcaaagctaggagggggcagaggtggcgtctttggtgggggactatcggagatggaaaagatgacgggtaggtactctctgccgatggcttaactgggggggaggggaaggggaaggtatggtggacctcgttggcacgattgactcgtttccgatgctagcaaggctgggtagtgacgtggtgggcagtggcggatcgggaggaggatgaggctgactgatcgattaaagagaagtggtggtgcatgaagggaaataggaggaataggagagagttatggtcaaagaattacacgaatattaaagcagatgtaacgataaaaaaacgaaaattgtggggtggattttctcacatgttgtatagtcaatccatttaggttttcatatagaatgacaaactttgtcgaatgattacgttgacatttagttccttgaattttttagagacatagcacaaacgcatatactctcaatacgcgcacactcgtccctattagcacctccgaaaaactggccaacgtcactgtaattgtctcgcaatcgacgagtatgttgtctatcaatgaaaaaataattagtcataaatgtgaacatccatgttaagttcatgagctgattccaccacaagaaacctaacaagttaagctacgctcacattgtatttagttcatcgatattgatgcaaagcgtaagttaatttttgcactggcttgtttcttgacacgtggactttttgtgaagacaaccgaaatttacgagaatgattcacgtcggtcgcccggcgcggggggagccggattgggagctcccctcgcgcgcccctccccccacgtgtgggcccacccacttctctctccttttttccacaaaagatgtttcatctagtataattacaatgtttcactatttataaatataatgttgcagtgaattaaaatactctttttcaacaaaaaacccacatattttggaaactctctattaaggaaatttggtttattttttattctaccaaaaatatttcacctagtgtactcacaatgtttcactatttatagatctaatacagtgaacgaaacattccattgcaacaaaaaaaacccacatattttggaaaccccctattaagggaatttggtttattttttgtttcaccaaaaaatgtttcacctagtgtactcacaatgtttcactatgtatagatttaatgttgtagtgaactgaaacattctttcgctatttgctgaaatattgtttttatataaggtgaaacaacacccaatttaaacgagtgaaacattttcgatctacttagtggaacaattctgatatacttggtggaacatcgtgcaacatttaaaaataattcaataataagctaattttttttgtcggaatatattcatgtgtggtcttgttttgaagatttaattacaacaaatttaatggtgcaatcggatcatgatttagataaataatttaagagaaaaatcagtgcgcctgattttttttccaaatcgattgggcgaccgatccataggcgcgtcccgaaatttattcttgatcctgaaattctatcttagaaagaaggtaaacatccaatatttctcctgtgaaatgttctgccgtactgctgctcttctgaatcatgattgtggcaacgagtgtgtatccatactcattagttgagaaaatattcccatgtttttttgcttaacccaaacgtattgtggtcgtttacatttcattgtttttctgtcttgctacagcgcaatttattataacttatatgtttatgcctacagaacatcaaatatctcatccatttatgtgctaacatgtgaggcaaatatccaactgtctctgaagctctacaaataaagacctaccggattccatgatcattatgacaaggttgtgtttgacacaacatggtactcgctctatagattaataatactggtccttttgaaaagaacacggtcttaaaaaacaattttaaccactattcttttattaaaatatatatagaaatatcaataaatctatgattattttgaaatgcattttaagacaaatgatttagatgttatttataattaaagtttttaaaatttgacaataatcttatccaaaacaatgagtattattagcttggggagagtacttcctatagcataagatttgactaactttgaatgttttatcattacagatgtatagtcatgtcgataaatgggagtacgtagtatttttttatgaaaaaaattcaaatgtaactatattttaattaaagtgtaattacatcgtaactctgttataattatactataactacattataactacattgtacattgtagagctacataaattttgataataaccttttagatagaaaacttttaaatgtaactatagtgtaattaaagtataattacattttaaatctactgtaattatactataattgtaacttatatatgtaagtaataagaaatcgtcaatagaaaacttgttcagatagctagttccatgcgcttgtaacgtcgcaccatttttttcccgctttcttgcgcgaatctcaatgcaatatggttcatgaaattatatgttttggaagaatgtcaatagttttttttagcaattccttttttttttctttctagttgtttagtccatcaagccaatttaaatactactccctctgtttcaggttataagacgttttgactgtttcaggttataagacg

SEQ ID NO: 31202 - DNA, 2122 bp, Oryza sativa
aacgccttataacctgaaactgagatgatccgtggcgttggacgctgctcttaactgcgtccatatctgggacgttctttttcacctcgtccttcccatttttttaattcctagatcctaatcaccacttatttaattattaaagggattattaattattctatgtatagaaaatgggatatcactgatatgctgagataaattatgtgtgtgtcagtgtgagatcatcgtttcatcagctgaaacggtcgacagcaaccgtgtttcaaagatgcgccgtcgattacttcttacatgtagaagtcaatcacacgctcgttcacgcattcatgttctgcaacgtacgctctgaagtctgaagcacatactagtactccgtcgtagaaatactcctattaaacattaaaattgcagttgctgcttccttgcagcaaagaacttctgccagccatatgtcctgaacgagtgaatggcagcaaacaacacattactacatttcagttgagagttgacaacacaactgctccctccgtatcataatataagctttagagttgaacacagttattaaaaaagtaggtagaaataaatgttggagggttataattggatgtgtagtgaatgtagatgggaaaaatgaatggtggaatattgtgattggttgggaagagaatgttggtggagaagttgttatattttaggacaaatcctaaggtctaaaagttgttatattttaggacagagggagtagacgactagatcttgagcgaatgatttcaagatgatcacgagcttggtctcctctgaatttctatacctatactcctttaaagaccctaataatgatgatcggtaggtctgtcaccacccattacccaacaaggtaggtggattttatccctttcctagcctcgagccatcaaacatgaaaaattttcttttgacgtggagtaaaaatgatgacaaataatatgacctcaatattttacaataaaattttattttaatttttgaggctttaaagtgtatggtggggttctctcatttaagagaaaattccttgtataccccttaaagtttgctcaatcccttctatatccctgagatttgcgtattcccttccatacctctaaattttaatttggatcccttctatacccctttcatcagttgactgttagttgaccgttatattcatatcataaagtccattttaccgtttagtatcaagaaaatataaatttatgaagtatattgatggagtgtataaatttattgtatacaactattatatttatgagtttattttgtgagatattatttaacaaaaataacttttatctcacgtaacaagatttatattataaaaaattccgtattactataacaaactatgctatatatacagtttctaatagtaaaaaaaatattttttttgttttatctaaaataaattttgtatagataaaaaatagttttgttttcctttcgcgaggcgaaactaaaatattactcttgttaaaaatatctcacaaaataaactcataaatataataattatatacaataaatttatatactccatcaatatacttcataaatttatattttcttgataccaaagagttgtcatacataaaaattatttttgttttcccttcgcaaggcgaaactaaaatatttttttggtaaatattatctcacaaaataaactgatacatataatagtcgaacacaataaatttatacaattcatcaatatacttcataaatttatattttgttgatagcaaaaggtaaaatggactttatgatagaaatttaatggtcaactaatggaaggggtatagaagggatccaaactgaaatttagggatatgaaagggaatgagcaaatcttaggggcatagaagggattgggtgaagttttaggggtacacagagaattttcttctcatttaattcctattgcaatgcatgagcattcaactagtttctttaaaagtctctagttgtggtgacatggaatctgccaaccctgtagttttacaatttgtctgctaatatattttagggaaattttgctacaggacactgcttacgtgtgattttagccttagga

SEQ ID NO: 31203 - DNA, 20793 bp, Oryza sativa
taagcagtatggtgtagcacaatttccctatattttaatattgtgagttactccaacatttggttacaagggatactaaaatatttgataaaaaaaatagtttgttatgaaatattataatacctttgtctcatgttcctagcaaaatatggcattttaccagtatatggaataagtcccaacacttccaacacagcaaagacttttcagctgtgtcgatggattttcgaagaaatttcaaatgtttttctggaaagaaaaacactatagacttttggtttgaagttcaattcctaaaagagaaaaatcgctagggcaacctgctcaacttgataatacatgctaggaatagtgttgtttcacaagccaggccacccccctagctagtggaaaataactttataagaaaatatatgttacctattcttgtctatctatctattatcttataaagatatatcaaaaagcgacaccacgatcacttcagaatcttgaaattctcatttttattttaaaaatacagatacatatattgattgtctgatcatgataggtaagttctcgtattagatcggttattaatatatttgtactgaaaatacaattagatttaactctactattataaaaattatatatgcttttgccggtactttggtatgtcatccttatttgagttggtttttagttttgttcgattttaaaaatatagatttatgtttgagtcatttttcatatttgttcgtttttggaatacaaaaggagtcaacttacatgctaacttgacacgaaagtctagactcctaattgcagctcatgattttctaaaaaaaaatcaagcgaatttccagagtaaatttcaccctagctaaaccgtataacaataataagttaaaatagccttcacccgttacaacgcacgggctttttttctgataaaatagaagctaagatttacatatgaaatatggaatccattcaactttagtacctactagtgtatacaattatctatgggaacaatatgataagagttgtatatggaatccaatttataactttatctattgtacatcactagcaaaaatgcccgcgtgttgccacgggtgaaaaaattctaatgataatatatgtttttcatgaataatcatttcaatgacaatgtttgtattttaatgagcagcttgtttttttataaacaatgtttttttcttgcgcgattttctcaaaccattcagaaatagcgcatttctttctaaagttttttttctagcatgtttttttttcttttttatttacaacgaaaaccataattttctcccgtttttgcttttcttttctcgtgtgttttttttgcctttttttacaattattttctcgcgtgtttttttgcttgtttttttttcaaatgttctttttttttgcttttatcaatacaggagaatatatgatgaaataaaagccatgtagtaggtggcaaaaaatcgatggatcctatccgactcagagcgatttttttaatagactgtgtttttttcttgcacggttttttaaaaccattttttaaaatggcgccttttttctgacagttttttcctcgcatgtttttttaaaaaaatcaccgacggtggaaataatttttcttgcgtgtttttttatttttttttattttcgctggttttttccgcctcttttttcttgacgttttctttcgcccggttttttagatgggacaattttggttttttttcgcctcttttttctggatcggacagatttggttttttttgcactttcttcgcccggtttttttatctgataaatttggttttttcatccggtttttttgacgaacgatggaagcacctcttattttttaagtaaaaaaatagagagttgcaaacatatttttaaggcttgtataccaaattcaattgtacttttatcgagatctatggtccgggttaatccacttgttcatacacaatactcggaatgtttttatgtatctttcatacgtttactggatacatctttgatatgtacagtctggattgatgtccatttggatgtattgtgtacttgtagattacattagaacttctacacagctccatctaggacaagtttacaagcatgccgacatgccgtcacaagcttctcgatctggcgccgttgtcatatctggcgggccatcaggcacgcatgcatggatacgtaccttgctgcagtctttctatgcaatttcggagctatattaaagagtttgagaaatatactcaagccacagctgtcattaattcaacataattctaagttgaaacaacaaaatggattgaattttctgcaacagtaccgtgttatgatactaattcagtaaattgaggtgtgttttcaataaatgattttgttttcacttcagctcctgaatatttcgttttactgaagatgcattctatttttttgtgaatatagtagtacgcatctgtcatctgattttgtcacaactacaaaatatgccttatgtgctggttgggaactctcatctagtacgaactcttgtttgatacatgttgtatatctttgtggtttaggcttccttctgaatcaatttactcgttgtgaggtgcttgaaagagtaacttacaattgcccggaacttcataggaagaaccacagaagttccggatagctttctctgctcggcaagaaaagctgtcatgaagtttcggaccatgtttttaactgctggaatttttaagtaaattttaggaatgcctattcacacactctaggtgatatcaaggtcctttcagaaaccaccttaggggttgagggtattggaaaggttaggggtagaatacctagtttgagagtggggtgggggcactgtgccaaaaccacctagggggtaaagtaaatggttttgttaatgctatagtttaattaaaataacctactaattttatgaaaccgactaatcctttgattgtagattatgctaaacttgaccagaaatacaagccaataatatatccagtctcgtcttaccctttttgtccgtgtaattctagttaatttggcccaaatcaagtaaagtgtgaaaacatgtcataatatgccacttgttgttaaaaagatatgacaatattaatggttgcatttttagataatggaactcattccaactattgatccaaataagctacaaccaattattatagatattgtagctcgaacgaccacaatttatgtatcatagcttgataggtaacaagaaaactaattagaacatcatcagcctacgcagatataacactatctacaaatgataaaagtttgcataaccattgttttgagaaatggattgcaggttgtatgtaatcctcatcctcctcaaaactgaaaatagactccctaaaatagcgtccgactgttctgcctatcggaacccatacacatcactgccagcaccaagaactgaagcgaatggtatcaccgaagagtaactgaattgcaaaccagctgctaagtcccaggccaacacaaaattccaccaacggtctccgctacacgaggaaggttctctaaagcaacgcccccatgggagatacaacatgattcgccaccacctctcatccgaaagctggagcgaggttttcaccttaaaattggacaggacattccccgcttccttctgcattgtttttacaaagcaggcactttcaacaagcttcttttctttggtaataagcaaaagtgtatggaagaggagagaaacacattaatgacgcctccaaggaggggaacgacacttaagggtgtcgccatcgttgaagcgggccaatagcatagcaaggctttcgttagcaattccctaccaaccccacatctataactagcctgtacattgcctacccgaagctccccgcgaccatgccctggaggaagctaagcatgagaggaatgtgctgaagccactgcacagaagatgttgtcaaccaccagccaccaccacatgcacattcaacaagtgcctctggaggcacgtagggatggagcctcaagaccatcgggtctctgaagttgtgcttcggtcgtagctggctaaatctggcatagcggcaccacatccggttgaggcggcgcttcagccgctgccaccctccaccacttgcagatgccatcgcctattcgtagttcatctcttaaaaccccgcccccaccatccctggtgctgcgcccagcagctagctcggcggtggcaaggcagatgagaggattttatgttttttcttcaaatacatttttaatgtaatggaaatggataatatctccttctatcgttaggcacactacaactaagtccttattcaagtacttggaatagaattcacattatttcaaccatctatacattgtaatcatgtagtacagtgcagtgccatcgacaggccacaaaactgtatttggctgcagtgggcctttgattgaattattttagatgtacacttagtactttaatttgtacaaaccaattacttgatgaattattatttttaaatagttgggactgaaagctcaacatgggtgaagccgagtacattggatctcatatctagcttatagttccctattgttgttaggttcatgaccgaatgtatagttaggctcgatctcaaccattgatatgttatgtgcaattattgctccctatttattactataaatccctcgtatctagtttattttgtactccactaattaataactactatatgattcatttgtttcaaaataagttaatctagtatgagatattctagtactataaacatggacatgcttctatacagataaatagtattaggatgtgtcacatcttataataggttaacttatttaaacctagttattacgaaaaactgcatgcacacattagatgtatcgtagtacaaaatagtttgtacgttgctaattgttgctaataatccccctctcccttgcgtagacgtaaaaaaaaaaagtacccactcagtatagttattgctaattattctcactaatatgtttggaaacattttattccgattattttttacaagtgaaacaagtgtgtcgatcgtctagttgtatgaattatgaacgtcataaattattaaatctgtaattcatcatcttcataaagtgcaaacggccatgcatggtacgttggtctttttttatactggacatatattttcttcttttttttctgattacattttcacgtcttaatatcttttatgtatataagggcatgtgcagatgtgctctcgcatggttctgtgtgaaccaaattaatattaaaatctctaaatttatttcataatatctagatacaacagacatataatatctagtaacagaattgaaagtccaaacccaatcggcatatcgagagagaaaaaaaagagagagagaaaaggataaatttgacatgatgagcagtatagtacgtacttaccctgacagacttcatctatcgccaaagctttcccgacatatagtttggcagcatataagtcctctttgctgactagtgggaaaataagttaaagaattttggggcatggtgcagtgagtgtttacatgcactcttacatatactcaatgttttttggtaaatgtgtaagtcaaattaatcattactacaaaacctcactttggtgctggtggaaaccttacataggtgccagattcctcaaccaaaaccatgaaggcggcgttgatgacggcctcatcagtgtctaattgagaatcgacaccgatgaggtgcacgatttaaaaaaaaagtggattggctcaattcaggccgatgtgttgcccacaaaagttctccaaattgttcttcatcaaacacaaattattttcaacataaaaaatcaagtgaaacacaaattttggcacaaatgcattatttctcaaatcagaatccatctactacccaatccgtaactaactatccactacaacaacaaagggaaaaacaacattaattagggaatcgacaagggaggtagaggaaataatccaacagataagagaaccggatccatcaaaaatcccaaatccccaagatcagccgccgcttctgttagtggttgcctccgtctcatggtcccacccactgtttaaaggatccagccccaagctcgtggcggttagtaggccatggtgaggtggaggccgagggagtgaaatgctctgccgccgaatgggagaaggggatggtgttgtccccgagctcacgacggtggatgtagccacccttgagcttgtggcggccggatctagcgactccaagcttgtggcgatgctcatggcacggtggtggatgcgagtaggatgagacactcatagcagcgctcttcgagagagcgagagagcagcgagcaacaagccaaattaaaaacgtggcagttggctggctcatcagcttgactcctactgagggtgtcagtttatttaaaaaaccggcatcaatgtccttcatatgagtgtaatttttaattcagtgaaataaaaaatgaatatttccaaaagcatttcatgtttatgtcatcatttcttaattgaactgtgcatacagttgcacacattctcttgtgctaagagatgtaaatgaaatatgcaaagtgaacttagctcaactgattaagtttctggtagtggaatctactcatccgggtttaagttctaagacttggtacgatgcccacatttatggctaattattctttcaggggtaagtgacatatttgtcgacagcgagacgtctgcgatgaattcatgaatctcaaaaatatgttggttcagcattccgaggtgtctatatgtatagggtgagcgcgaggcgtctgcggtgactttatgattctcaagatacgttggtttagttttcggaggtatttatagggataaggtaaacgtgagcatgtttatatgagcattgcttgtgtattgcgtttcgtaaaaataaaagtactccctccattccaaaatataaggcataatcacctttaactcaaagaccaagaaataattattatcatcttgtagtttggattatcataataaatacaattcatgcatccaatagaattagagaacatgagagtggaggatttaaaaaagtaataatttaatggagaaggggccatagttaattgtctacatgcatgcataccttagagcacccacaatggtaaagtaaggtgctctctataaaacatgtacatctcagcaatagactagattaatagtaaatcacctcaatagtatgtctacatgggtatctatagctctctaatacattgcatcgttttttactatagactatctccaggttagtagatagttttgctctctcttcatttaatctcttccaagtaggaaaatatgctgatatggatctcttgtagagagactatagataactattgcgggtgttcttatattatagaacatctaaaaaagtggttgtgacttatattatgaaatggagggagtagaactagcttgataatgctgtgagaatacagtagtactaattggataaagatagacagatagtagtactccttatcaaaagactccgcacggttattgaagtatagttgtatacgtttggaaagtacgttgaaagtccaaagtacaaaatatagtacaaagactccccatatattttacaaccttcatgccaacttgtaatatcaagctcagatggatcttcattccttaggagaatatattttattgtatatgccacctaaatagtcattattttttaaaaaaaatataatgtgatagatcaccatgagataaattattccataaatacgcaagtttacattcgaactatacaagttatattagaataaaaataataaatataactaaaaaataatatttttagaggtccgctttgttctttttgtttgaacttacatgggtcgaatttaaacgtgtatgtttggagcatatctcatagtaatttatcttattattttttaaaaaatattttgatgactatttgagttgcacgaaaaatactggtatatccccttgacatagagttgaaaacactttcatcaagcctatctacccatgcattcatgctgatgcttgcttgcttcagctgcttataaatacacatgcaattctacaaccactggcgatttcaaaccaaaccctagttaattcaagtcagtttcttaggcttactgcctcgcgccatggatgggcgagacgagctgacaacgaagcccatcgagatcaagttctcgagctgccgtggcgtcaccttcgagcccaagccctcgccggcgagccccttcgccatcgccgccgccgccgccgccgcatgccctgccaagccgccaccggcggcgccgagcaccggaaggtggatctggctgcctctactgtcgtcgagccgttactcctccttctctaggatcattccggcgaagccggactgcggcgttggacggtcgcagagccgcgccagcagccacttctgcgacctcgacgtcgccggcgacgaggaggaggatgatggcgtgtccgtctttgacggccacgacgaggagatggctgtcgccgcggccgcagctgccgacgtcgaggatgatttgaaagggaagaagaagccgagcgtgtcggcggcggcggcggcggcgccggccaccgccaggcgatcgaggctcgccgtcatactgttcgaccagggactgttcaccgtgtacaagcgcctcttcgtgctctgcgtcgcgctgaacgcggcggcggtcgcgctcgcggcgtccggccatttcccgtacgcggagcggcgcgccgccgtcttcgccatgggcaacatcctggcgctcacgctgtgccgctccgaggcggcgctccgcgtcgtgttctggctcgccgtcccgctcctcggccggccgtgggtgccggtcgtcgccaagacgggcgtcacggcgatcctccagtccctcggcggcgtccacagcggctgcggcgtgtcctccgtcgcgtggctggcctacgcgctcgtccaggcgctccggcgccgcgacgagatgccgtcggagatcgtcgccgtcgcgtcggccatcctcttcctgctcgcgctctcctgcgcggcggcgttcccgctcgtgcgccacctccaccacaacgtgttcgagcggacgcaccggttcgccggctggggcgcgcctgccctgctctggacgttcgtcgtgctctccgccggctacgaccgggaggccaggtcctacgtcccgctcgccggcgccgtcctcgcggggcgcgaggacatcaggctcgcggccgccatcaccttcttcaccaccctcccgtggctcaccgtgcgccgcgtgccggtgacggtgaccgcgccgtccacccacgcggcgatcctgaccttccagggcggcgtcagggcgggcctcctcggccgcatcagccgctcgccgctctccgagtggcacgccttcggcatcatctccgacgggcggcgcacccacgcgatgctcgccggcgccgtcggcgacttcacccgtggcctcgtcgccgacccgccgacccacctctgggttcgcggcgtccacttcgccggcctcccgtacctcatcggcatgtaccggcgggcgaccatggtggcgacggggtcgggcatctgcgtgttcctgtcgctgctgatgcagccgagcacgacgacggcgacggagctgtcgctggtgtgggtggcgaagggcgtcgaggcgaactacggcgaggagatcagggcggcggtggcggcggcggcgggcggcaagagcatggcggggcgggtggtggtgcacgacacggcggtgatggggcggccggacgtgcgggagctcgccgtggcggcggcgcggcggtggggcgcggaggtggtggtggtgacgagcaacccggaggggagcagggacgtggtgagcgggtgcaggaaggccggcatcccggcgttcgggcctatatgggattcatgaatttgcatgcgtttggaacgagaaaacgaagggcaaaagcgttcaaaaggagggagaaaagaaccgagaaaattaaggttgtgtttgtttttaccctttgtgtgtcaaattcaaataattatatatttatatattgtacatatatacaagtaacacttggcagtttctattcagatggtggttaattaattagcgctaaaaaatgcgtggtaaccctggtaccatcaaagggccatagaaatagagatcatgtattatcttaattcatttttctcggaaaactcaaatcatgacataagaggatatcccctcatttttgcatgttacttaaaaagtcatcaaaaaaattaaaaaaatttagtaggatagatcaatatgtgatatgtcactttacaacatgccaattaaaattcaacttatacaagtagaaataaaaataaaaaaatttaactatgaatagaacgcgtaattcacggtcaaatttgttatttttgtttcgaattttgataactttttgaatgacatgcacaaaacgaggggatgtcccctcgaggaaaaaaattcacttccattcttctctcattacacgcatgtggatgcgcatcgcactcccgccatctcgtgaatgcatcctcttcaatggggacatgctggactggtgggaagcttgctgaagagaactgatcaaagaataaagacgaaatttcaatggcttaatcatctacatgactttgggtatttggcttcaaagaaacgatagaattttcaatggtgcatatagtacggttctgcaggtggttgactctatcatcgccatgtatgcaaagcgtatgacaagctcaattcttgtaatcccttatgtccttcgctgtgacacctttctaagaggtgaaccttgtgattctctcttcttctataataaaatttgcagagcttctgccctaatccctcgaaaaaaagaaaacgaaataacagtaactccctaacctcataagaaacctactaatcttagccataccacttgttggtgtgtgctcatcgttgagtgattttttttaataattggttgtagctacgtgagtgaagggtgtaatttttaatcgattatctaaaaatcacaccacctatgttttctcttattaattaaaaaaatgatcaccccttatctcgataattaatttacaaatatataaaataatataccatgcaaccaaaatatattgcatgataaattggtaatacaatcatacattttttgttcatcagaatctgtagaacaatttgaaagtgtgatcaggttattaaaacagcatcaatcaaatgtttcaagtaaatgagaaatggaggaagtgtttgctacctaagtggagctacgtcctgtcctcttccgtcgtcctctcctatcattgaccaagaatgtatgcatttatatattgttccgtattcgcgtatgcgaataaatctacggaagcaaacaatcaggacaccgtagcatctcttaaagtccttcgcccctcactatagaagttctaccacacagcatatcgtcatcttcaaactgtaaatgtctcattgccttgtgcactcacttgctgtcagtcgtagctaggatctcaatcggatggatggataggatataatcagggcaatttgtagaaaacgccccgctttttcaccagtggtttcgcaaataacccttagatttctctcttctctttatctaggctcctgctacttctcccccaccttaattgtctccttccccgtacgtgcggcaagacgtcggcggcggattgaatcttctcggtagaccatgctcacgggagattgcttgaagaagatgaataatcaagatgcctcccgcaatcaaaatccctgttagaaggtgtctatgctcacaatcaatggaagattgaagtcagtgtcgtcctcatcgaaggtgttgcacgcctcctccttgtcgatcgatgctggtggcagcggcggcggtggcgacggcatcggcgggatcagagtgggttcgtcgtgatgacctctccctattgcatggtcggaaaaaaattatgtgcatacgaggtgcaaacctcattccgttcaacccggccctacgcagatgcatgacgtacgcgtggatgagtcgcccatccgacggccagcccccacggctccatccgcaccccgctcggctcggctcacgcgagagatgtcaatgcgcggcgctcgctccaggttcggctcgatctggatcgatccacgaactgtcaatcaagcaattcttcttagcagttcttttccgtcgttcccctattcctgttttgcgatcccgctagctatcgcctctctcgtccgctgctgggcgtcgtctgcctgtccgctgccgcttgtatccaaatgccagagggatccgccgccgctttccaccgaccacggccacggccattttccaccgaccacggcgtcggtgacgcaggatgccgtctgccgtgaaatgtggctggctggctgcttgccatcccgaggtcatcaacaatcgattgcttcgggaacaaacgacaggtgaagaagcgggcagttttctacgaaattgtcccgtttggatccaatccatccgattgagatcctatggtcgccagtgcccagtgagtgagtgtataacgtagtaactgcattaggatgtgtgcacatagaatatattgtcctacttaaaactctactactagtctagtagtaccaaattatttggtaaggctgggattagatgacatggatctgatgtaggtagctttttttagaggatgtaggtagctaaatctattatatctacatagtaatagaaaaaagagtctccacattcgctctcacggcctagaaaatcccacgttaatttaaagaaaaaaagaaaaatagaaggagtacttttcaaaaaaaacaaacttagaaacggacaaaaaaattccaatcggacaaaaaaaacttagaaacggacaaaaaagataaacctaagagctgaaacggacaaaaaaaaacttggaaacggacaaaaaaattccaattggacaagaaagatagaaaatagtgaaaacggacaagaaaaatagaaattccaattttaatcaagaaaaaagagagaaaaaataaccattgggtcatagtagatccagattataacagtttagatttaatatagggtgtgtttagattccaaaatttgtttgccaaaaacgtcacatcaaatgtttggacacatgtatagagcattaaatgcggatgaaaaaaaaatcaattgcacaatttacatgtaaattgcgagacgaatcttttaagcctaattacgccatgatttgataatgtgatgctacagtaaacatttgctaatgacagattaattaggcttaataaattcgtcttgcagtttacaagcggaatctataatttgttttgttattagtctatatttaatacttcaaatgtgtgtccgtatacttcaaaatttttacacctaaacaactaaacacggccataatagttatatagttatataattttttttacggaagcttaaactaactataggaatcggagtaaaaaaagcttgagatggacatgaccaaacaaaccacattcacaaagtttatttctaatttaaccaattggattaagaactaatgcattaacttatttaagtaataaggacatgtttagatccgctaacaggttttttcatcctgtcacatcgaacgttttaacacatgtatgaaatattaaatatagacgaaaaaaataactaattgcacagattgcgactaatttgcgaggcgaatttttaagcctaattgctgcatgatttgacaatgtggtgctagagtaaacatttgctaatgacggattatttaggcttaataaattcgtctcgcattttataggcggattctgtaatttgttttgttattagactacatttaatacttcaaatgtgtgtcagtatatccgatgtgacagggcaaaaattttcaccctggatctaaacacagcctaagaaaattagactccgcgtttgctgggcctagaaattctcatattaattaaagtccatatagaaaaacaatttacatagataattaaaaaataatgaatattggaagagaaggctagagttcatactggtgtacaatttataattaattaaaatatggaatcagagaaaaagaataatagagacaatatagaaatacaattttaaatagccaaaattcgaaattaaaaaaatattgaaagaaaaaacaatccatatcagtatactaaaatttgaaattaaaaaaagaaaatagaagtagacgtatgagtccgtatagaaatacaatttataactttaatttataaaaataaaaattaaaaaaatactaaaataagagtttacaatctatataaaaatacaatttagaaaaaaatgaaaatttagaatagaaaataaggaatattggtagttagccgcgcagtttgcataggccgtgttcgttattaatcgtacgtaggagataacaatatgattaatatgacacgggtaagcacataatcggtgacttaattttctggataccatgttgtcgcgactttcgtattcagtcatttaagatatgtcttaaatcaaatattttattttttaactagtaatttttataaactcatatagtttaatattttttagaagacatatagtttaatttagatgatttatattttaagatccgtcatgagaaataattttataatacatatttcacatatagttaaactatatgaatttttaaaaattagtggtcataaatcataactttagctaagaaaaaaaattaaaataacaagtaatttaaaacggaagtagtatagcagtgatgttttagcagatccaactacacccttcgttttaaaactataagatggaacttaatttgaaaacagagggtgtattctgcaactccatttgaccttgatcaacaatcataatggtcacacgatggctatatttcgtcggcttattgaaacagcggaaggatgatgatgatgatgatgtcagcagcatcatcccccagctgcctcctcctcctcccccgcccgaccaaaccaacaccaccgctgctcccctccacctcctcctgccgccggccgcctcgctgccggatcagatcccttaggccggagaacccggcgccgcccgccgcaggagtagcgagagcggtcgcctcctcgtcgtctcccatggagatggaggcggcgcagacccaggcgtgcggtggcggggaggggcagcaggaggccatgaggctgctgttcgtggagatgggcgtcgggtacgaccagcacgggcaggacgtcaccgccgccgccgtgcgcgcctgcagggacgccatcacctccaactccatcccggccttccgcagcggtagcctcccccacagctcgcctctcctgtctctgagacattccgtcgaacacctcatccgcacgccaaattcttcacctgttctttttgtttcctatcgttgattaactgagctgtttttggtgtatgaaggatccattcctggggtgaacacggagcagatgaagctgcagatcaagctcggggtgccgaggccaacgcagcacttgctggacgttgagagagtcaaggccgtcttcccctagtgagcactctttctgtgttctcttcgtgcttattagtaaaattgggatcttcttgttggaacgctgaatcagaaatggatgcaatgagtacccctacaagtttattgagcatgttttggtcggttgtgtaccatactagctcgcattatagtagtaagtttgaaccttggtatgattggcaatatctaggttaggtaactcatggacatggtgaacaaatgtggtgtagaggaacatgagctatcatgtttatttgttcagtacaattgttccttgtgattatgttcataaccatatggcaagatcaagtacggatcctcttcattacccaacattgctcagttgctcactatttccaacactaatgattttcataagctaactgtattgaaaagagcccttagctctttaataacaaaatctgaggcagtcaagggcttagatttgaaaaaaaaaaagtttaatgtgttctagttctttcaaaattgtaaccagtttcccataactacaaaagatagatgtggttatccaatgtgtttaccttcaaattgaatgcttattgagtgtagctgtgatctctaactaagattttttatgtatataataaagtagaaccgggtagttcagtgaccctcgatcaatacagtctcaccttttagcatatttgattattttttctatcaccacctgcttttccttttgatcatatttctataaaaacttcatccttaaagtcatcacagcgtcttaggcaaataaataccatcttttatcaagtacacaagacagtgtggtcagcactatacttactacataagagggttttgaatgttcaacaccagtgctccagaatgtccttcagatgtgaaagtattacatggttacagcttacagtatctcagacaaaagccaaagtggcaaactataacattttgtgctaactagtgtgcataacaagcaggtaaatccatgttgccatgacaaattgattcacattagcgttgtaggaatgtttaatagttgcaatactgtgctgtgtgatgtttgctgagatagaaagcagccatacaaaagaaagccatatggactcatacgattttcacgacttactgaaaatgaaagatcagcaagagaaatatttagagtgcgcagacagtttccatgaactcgtattcatggttgcattttacagtaatattagatatttagatgtggcagtaagcatgatcaaatatataaaaggaagaacacaccagaattattaatggcctggactcagctgcttggatgtaaagcatttctttgctaacaacaactcgtaatcaaacaatgtctgagatactcaatggatctcatttgtccagaatgatcattagcagcgtgtttatagccttaatctgatgatactgatagtgtgcatcttgatttggtttacatatgacgtagcaaaagcgccgccttatgctattttctcattgtttgcagtggtaaaattatcagctttgaggttgtggacggtgggatgatctgttcaagtggcgtatgcctagaagcaatgggagataaaaacgatgattgctatatagtgaacgcagcagtttatgttggttactaatattatctcgatgaatagttcctcttcgttggaacagtaaaaagacagaaaaatgttgtgcgcaataagcatgtcctgaattttctgaatcatcttttcttaatgtgtacaagtgcttatttgctccatccattaccgacatcagtttctttaactgcatatgtcgatacagttctggtttcataatcattttatctactatatactccttaactatggcttaatagcttatcacttagaagccagacgcccacacatattacatatttgcattaggcgtaacattcttatcaatattagtacatatttgcatcagtctagtgttcactgtccagtgctcagttgagctagctgtccatggtcgggtagaaggcgtaggtggcgatgccgcagttgccgccggcggcgccgccgcgcgcgacgcgcatgtagccgccctcgccccaccacgtcccccactggttcttcaccagccagtactccccgccgccgtccgccgccgcgccgtagcccaccaccgtgacggcgtggttgagccgccgcccgcacgcggcgctcccggcgtagaccccgctcctgtagtgccggaagtccggctcggaggcctccacgaccacgaccaccggctgcccggcggcgagcgcctgcagcgcgccctcgtcgccgtacaggcgcgcccaccgggcgccgccgacggctgccgccgagttcggcgcggcgaacccgccggcgcggcacgcgccctgctgcccgccgtacgcgtaggccgcctccgtatgcagcccgccgctcgcggcgatgtagcggagcgccgcggacacgtcgccgccgctgcaggtgttggcgccgccggtgcagtcgagcacctgctgctccgagagcgacacgaggttgcccgtggcgagctggacgagcccctccgtcgccgccaccgccgcgaacgcccagcaactccctgcaacgaacgccgtacagtacacatgagctgatctacagtgtaacggccggtgtcagacgacacgacaccgacgactttcagtaaacctgtagttaaactgtttatccatgtattataacatcatgatctaagtataattagcatattatggtattagtagatacgttatgataccaacgaatcaattttcgagatacgccactgcgtgagctatgccatcgacgtgtttgtgttcgggagtggttctcaccgcagctgcgttggttcttgacctcggtgacggcgccgcgagccctccagtcgacgctgtccggcacgtccgtgtcatccgccgccgccgcggcggtgccattctcggcgcggtggccatgccggtgcgacggcggcggcggcgcccagctgtacccgaggtgcgtctgcgcgaactcgtcgtcggtgaggtcggagaactggttgaggccgagcgtgtaggtgcggtcgccgcccgcgcggttggcggcgtcgacgcgctccgcgttggccgcgaacacctccatccgccgcgccttctcggcggcgtccgcgtacgcgcgcccgaacctagccatccaccgctcgtgccgcgcggccatgctatgcccgcgacgcggctgatccccgcgcgccgccgccgcggcggcgacggcgaccacgaggagagcaagcagcgcgacgcgaaggtggcgagagacgggaacccgtgccattttttttcactctgtgttgcttgtgacttgtgagctgaggatcgtggcgcatttgcctcgtatttatagacgacgcacggttgatgcatggtcgggtcagtccatattgcactctggtgtgcatgcgcggatgcgccagtgtccagtgggatggttcattgaattgactgtccggtggattggcgtgcatccgggaaagagttttcatcctcgagaggtttattacatatcatctaaaaagttattaaaatatttaaaagaaattaataagtaagattaatgagttatatcactgtgcaaacatgtaagtcattcgacttctacgagtcgtacctaaactaataaatataaatgtgaatgtatgttaactagtttcactttgatttggggcaggtttagtttggggcctaaattaggcttaccaatatttgtcaattttaatagtgtttagtgtctatttggtttgaagcaaaattttgacatgcctaagaaaatgagatatttaaccgtttgccatatttagatgtggcaattaactttttgccactgggcccacatgtcatagacatatgtggacccacatgtcattgagatagaggtggcaaatagttatttgccaaatctaaaagtggcaaatagttaaaagccccctaagaaaataggtcatttcaatagtgaacttagactattttggcttcaatccaaacacaactttaccttatcaaaattagtcatgccaaaacttaccaaaatttggcattgacaaaatttggtaagacctatctaggccacaaaccaaaccaacccttgttctttttgttataacttgtagatagtgaatttaactttgcatatttatgaattaatatgtctcataggagggccgcacacttttgcttactcataggtgggctgcacctccgccttccaaatcttccaagtcctcggccctcactatgtttgtccgagagtagagtggttacccaaagtgaggaatcctacttgtttttcatgaggagcctagatctagccactagagagtagaggaagaaagcggatctggccactctgagtagaggaagaaggctaatctagactggtaggattatgttgaacagtttttttagatactgttacaattcattgtttatcttgtttcatcttattatattctttttttttacatattgttgtacttgcaaatgatatgtattgtcgcattaaaggcgtgcgctcaccatattgaagttgattgtcaataattctttttcttcatgttgttgattgtttctcgtacgtattggtttttttaatgttgcattagtatatttttgagttttgcatctggttaaagcatctcaaatgttgcaattagtgatggaacatctcaaatgatcattgattctcggcaaggaagaaacaccatgcatctgacgaagtgtctccaattgcaaaaagaagtattaatatatattatcagaaaggattagttgattctatcttaggaagtgggacgcataccgtaagcaagcaggcagcggagcaacaaagccgaccagcgccggagccaatcaaccgatcgaaaaaatcccattatcccgacgcacaatactccaacttcaaccatacatgcacaccggggaaactcttttaaacactcgggtggatgttcatccgtttattgcatgtcatctaaatggttatgaaaaattttcaaaaaaattgacataataggttaatatgtaatatatcact

SEQ ID NO: 31204 - DNA, 9919 bp, Oryza sativa
  unsure (1)..(9919): unsure at all n locations
gatatattacatattaacctatcttgtgaatttttttgaaattttttcataatcatttaggtggtatgcaagaaacgggctggacgtccacccgagagattagaatccatcctcatactcataatcatttagatggcatgcacacggccgtcaatcagtccagtaacctgcacggccaagatcattaccgactccaaaaatcggcgtagattttttttagccagcgatctaaacaatgcatctcgttatcaccatgagtggcaaactacacagtgcatgttattgtcaccatgaggatggaagaagcaacaatatatcggccgtcgatggtgacagatgtgatcccattgatgtggacggccggtttcaatctcaggctcagcacgattattccatcccatccctatatggctattacactgataacaacaattagaggcttacccctttctataaaagatatacttcatccgtcctaaaacataaacattcatagaaaaaaaatatattttgagacgaaggtggagtagtaaatagctactttaaaaataacatatatttaactatatttttttatatgaagttaactatattttagtacaaagagtactatatatcagccgacgaatttcttccttcaacataaatcaatttttttaacaattcaaattgattcaacattcatgttaagcgttattaccaaaactccacctctctcatcgtttcctccatacccaaccgtcgccacctccgtccaccttatcgacattagcggcaaggccaatcagtcgcaccttcctggccacttccctcctcctttcccccttcccccaagattagatccataaacactgtataaactatggtgcctttctccggccatgcctctcatccctatctccggcggctcacaccgctagatccgctgtaaaccccgctcatcaccctcctctattctcatggccccggcaccttaacgtccgccgctggttttcaccacccttaacacttatttaaatcgccctctccgcctcccaaaccccctcccaccttcaatcctaaaaccctaataaaaataagccagccggttcaccggcaccgagtccgcaatacccctccctctgccctattcccgcctcccccagtatagaaatttgaaaacgatgtcacctgacgaatagcaaaggagtaacaatcaattaaggtgataggaagatgcactcctgcgtttcagcgtttgcttgcaccagatcgatgcatccccatcctgactaagcatgcgcgcgcgtagtccatttgtacattattattgctagcctgatcaatcctgatgacactcctccttggcggcgggcacattacattatactactatgctgggttgtgggctccgttcatatatgggctagctgccgctgcgcatgccccggccgtccctgtctgccactctcgcaagtgacggcacggcggcgtgcatcgaaccacggcccgtcccgacgacggcgcgcacgccggcaccggcggcacgcgcgctccggcccgctcgatcgggcgcaaatgcaacgtgatgaaacgagctactagcagctagctacgcacggcgagcgagcgagcgaatgggcagggtggacgagttgttgtcctgatattggaagaaaactcggcgtgcgaatgcgatcgctgaggttgcttgcaataactaactactactactgctcgctccggcctgcatgcatgggtgcaaaggagcagcgccacttgcatgcgcgagtggcacatgtggcacatgcgtggcgcgggtgatggagaagtggctgagcggatcaaaataggcaaatgacaggggacgagggtatatccactttacgtccccgactatcacaccagtataaattgaatctctcgagtctcgatggtttggaattggatgattcgtcctacgtggcatgttaatctgattttcatctaacatggtgtctacgggacgcttacgtagcattaccattataaaatttaggcaaattttgctaaagtacgtcatgaatttacggttttagctataagataccgcacgaagtgatttttggggaagacattctcaaaagttgaatatttgctggtcgacaccgcacgtattaaagtaataatttcctgttagagaggagagagaaatcacatgaaatgtcagtaatagggccaatatatcagctctcctatctctcttctctctatatcccctccttcacttctctctctatcccacatgtcagtgacgacggcggttaggcaaggtctggcggtggcgtgagggcgagggaggagtggccgtggcgacgggaggacgacggctccggccaacggcacgcccagacagcggcgtcgaccatcgacggcgcccctccctcctcactctgcgtgggcgacggctcctcactccgcgcgctgcagccgttgtcgtccaaccacgacgccgctcctccacacgcagatgccaccgccgaacctcgcccgctgtccggccagcgccggcgctcctctgcacatcgctggtcgcgtccgctctgcccttgccctcacgcctctgcctctgccaccaccgccactggacctcgcctgcccaccatcgtcgctaacatgtgggatagagagagaagatgagtgatagagagaggatagataggagagttgacatgtgggcccaagggcatttttgatatttcacacgatttctctctcctcttcaaccggaaattattactttaatgcatgcggtgtccgacagctaaaacgcgaagtcacggtgtcgtatagcaaaatttgcctagaatttaaaatagttagtgggtcccatctgtcagtggcatacccatctctcttcccttttccctctcctctcttcccctctttctccatttacatgcagatgtctcctcctctctccgccagttgtttggaccactgcacatcccctcaattccaccacctcacccatcctcaattccaccgccccaccagccgaagaccaccaccctctcctacaccagtcgtctagtactcttgcgtggcgccggtggtggtggcggcttttgggtgcttgagctccttagccgctagccacctcccatcagcaggtagaagctccctatcatggcctccataggtgttgctgcttcaccccacgactctacattcctaatcccaactaccgacgagcttctcctatgcaagtggttgcctacatggagcggcggtggcatcctcaagcaagccatggatgcagaccctgatctggacgactcgtagatcatgcttcgtggtagtcaacgatgtggtgtggtggatgtggctgcttttcgattgccgtcatgttgcttcttggtctcctgttccactccctacgaatgcggcggcgcacatggctgcttctctaaattggaggctaagcttcttctgctgctccttgctttcctctctacatctgacttcgtctagcttcagcaagcactacacccttctcatcctcttcaacctctttgccttcgacgtcaacatcatgagagggcaagtggccacttgaagtctgtcatcgtgctgatgggatgtggctatcaagagcttcaagttccttgcgcacatggcgatggagatgggggagacgagggatggcatggtgagtgtctactcaatcgagctcccttctcgctagcctctttgagctcctatgtcttcgcagccttcctccatttggtgcagccttcctcaatcgagctcccatgggtgcagccgctggcgagccacaatgagagagagagagagagggggggtgaagataagaggaaggtggggtagccaggttctaatgcgtttcttattttcttctttttctatctaggatgtcacgtcaaccaaaaccacaatcaatactattgaatgactcaatttgcattggtttataagacagggagcactcaatagctggttttacagttgagggtcacaaataacgcagcccatagttgaggaacgtaaaatgtacttagccttttccaatagtagtgggcctcgctaatttttggcccctgatcctcctccaatgagccccggccgtctgtggccggcaattaaggttgcagtcgttcaggagcacacgccacacgggacggacgggactgtccagatgagttggaatgtctgttggggctaacacgttacagttttgtacacatgcaagaagcgcggcataatctactaccactacgcatcatgaatgtctgtgatatgtattcaaggaaaaaagaaggatacaacgcatgcatatacatacacttgcttagtacaaatgggttattgactctacgatatactcttatatacatgcttccgaatttcaagcatgtatacgaatataatggacgaaattacggtaacttagtacgaaacgaggaaggaaacgcgacagcgatcgacgcacggtatccttagttattagacgaaggggtaggcggggcggctggagacgccgcagtcggcgtcgacggcgatgcgcatgtagccgttctccccccagtcggtggcccacgagttcttgagcagccagtacggcgtgccgtcgctcgccgtcccgtacccgaccaccgccaccgcgtggttccgcttcttcccgcagccagcgctgccgcggtacacgcgtcctcccttgaatcccctgaactctgggtcgctcgagtccatgtccgccgccacgggctgcctctccacggcggcgcgcagcgcgtccttgtcgtgcggcgtcaccttctgcacgccgcggatgacgacggcgacggacgaggacgacgcggagccggagccggcggcgcaggtgcccttctccccgtcgtacggccggtagctcttgtccgtgctcagccggccgccggcgctggcggtggcgatgtagcgcagggcctcgtggatgtggcctcccttgcacgtgttgtccccgccggtgcagtccagcacctgctgcgccgacaacggcgtcacgttgccggtctcgatcttgatcagcccctccgtcgccgccaccaccgcgaacgcccagcagctgtttgcaccacacacacacacacgacacatcatagattcatatcaccccggccgccatgaacgacatgatgaagatgcaagatttatgtgattctggaaacgtaattcggttggaagatgggttgtaaatctcttgggtgattcatgcatgccaatcaaatgattattaaaaaaaatttaaaaaataataaaatagattaataggtagtatatcactttacaaacatgcaaatttaaattcgacttctataaattataataaaaataacaaattaaactccagtatatgtacatccaatagtcaaatttctttttttttataatttataaaaatttaattctaacttacatgtttatggagcgatatattattaatatgtcttatcagtttttttaaaaaaaaatcatactaacatttagttgggatgtaagaaaccagtagacgtccacctaaatgcttaaaagagtttccctttcagttaatattttcattgcaaaagttggggtcttttctatcacatcattttgtttattcctttctttttacttcaaagactttttttttggtttctacgacttttttttggctgcgtactcactgagacagaagatataatccatttttattattaataaaacagtttaattggtgcttactgcaattattcttgccttgatcctggacaggggtgacggcgccgaggtcacgccagtccttgctgccccacaccgcaggcgggcgtgagggagggagatgctgcttcgccgccttctcctcctgctcgaacaacaccctcgcggtcgccggctcgtcgacgtcagcgtcgggcatgaggtgcctggcgcggaactcgtcggcggtgaggtcggcgaacggggtgagccccagggtgtaggtgaggtcaccggcgcggttggcggcgtcgatccgctccgcgttggcgcggaacacctcgaagcggcgcgccttctccgcggcgtccgcgtacgtgcgccccaccctcgccatccagcaccggtgccgcgccgccatcggcatgcccgggtcgtcctccggagctggagcacccgacgccgccgccgccgccgcggcggcgagtatcaggcagagccagcggcgagcagaggccatctctcgtcgtacactgggtgtccttgagcgtgcgcccgtgctggactggactgctggttcgcttgggctgtgctgtgcatgcatgcagggtagctctagctttttatatataggagattgggtaggcgagctccaaccatgggtcagtgaagaagtcaagcaaaggtcgtcgcctctcgctgtccatcatggtcaaggtcgtaatggtaaagccttgctcgatttaattggtgtgtgcgtgtgtaccgtactcgtgtgttgtgcattaaccaatttcataatttgtggccaattgagccggaccaaactggtacatacaaaattgaagatgaagccgaactgaacacacacgctctgaatcgtaccgatgaccgagggaacgttgctggctggcccgatcgatctctctgtttttttcctctttttttcttctttgtagccatcttgattctcgagctccatgccgtttccgtcccggtagggtagcgccaatggacggaagcgactagtgccggccgtatccccgactgctgcgtacgcgtggggttcccgtctcgcatcgctcctccattgacgtcgtttgacccctccggttttacttgttcaactgtaaggccctgtttttttagagagaaatggaataaagaatacccgggcttcccgagctcccgaagggtacgatttttacacacacacacaaaataataataataaatctatatatagatttcttagaatactacaatttattttttatcaactttataatatttaattcgttcgtacgtaccttcaaataattatcacagatcatttagttattcattcagccactcagcacaaaagaacaggggagattatcatcgccttgaataacacaagaaataaaagaactgaaatctgattcgatggtgaaattaaactatgagcacaattgtttttgtatattttgttttcaatgaatgaagcaatgaagctagctgacgaagtgcaagtgggcaactgatgctacagtttccccatacaatgtattgaacagggaaaaaataggagcgagatatatacctaacatttgagaactgagatttcagcatacagactctacattttctgttagaagatcaggttccacgaaacgcctatccgatattagactggtcagggcttgaatcaatgaatgcggatcaaaaataatgcccgtctttccatcgtgtatagagtccacagtaacctgcaatatacttcataagttagcacattaaaacgacaatctcaatactgtttatgcacaagctacaatacagaagaacgtggaccagtatcgcgtacttctggaataccgacctacacattgagttttcatatttatcttgtgtaaataacagtgtgccttttttctaacatgtaatggataaatgcctaagtatgcaaaagtaagcttgtttaaccaaggctacagagctcaatgtgacccaccgtgcaaaatctgcaattattgtagttttatcatgtactccctccgtttcaggttataagacgttttgactttagtcgaagtcaaactacttcaagtttaactaagtttatagacaaaattagtaatatttatagtaccaaattagttttattaaatcaataattgaatatattttcataacaaatttgtcttgggttgaaaatatttttatttttttctacaaatttagttaaacttgaaacagtactttgaccaaagtcaaaacgtcttataacctgaaacggaggtagtagtaattaataagctgatgctagatatcctctttcattggggatgaaatgacggaagtaacatggtatcgcacacagaaaagccaactaggaaagaagcgttaaaatttcggagcatctcgaccattcattttctttttcgtgattgtttctcagtaaaagacctagaatctaagtattcatgtaacctttggctgtatatatccattcatggatatagaggctggattttctatccattctcgaaaatattacacagttaaggactcgatggataactataacatttttccacacattttacacttaatgatcactgttttagcaaacacaaacacttaccacatgaaagattcctttagaagacaagttttttatatccaaaggaatttggcctccttttggtaccaataaagcattcacatagtctttgggctgcacaaaatgaaaaagaagctgtcagatggaaaatcttcacacagataatgttaaggggcaggggcatatgtacatctttaactgaatcattcaagatgtggaccaggggacgctgatctgtgggatattcccatcctctaaagctagtaaatgatatgatgcataattcctccaatcattagctgaaaatctgttcaaaggcacagtcaccgaacttacaagattctttagacttttgtcaggatatccatatgtacggtttagagaatcagtaatggcagtcacaaagccagaagcaggcaacccagttgtttctctgtcatgcgacccattcaaaagaagtacctagattcagaataaataattttagacaaaagcaccaatagccacaagcatgatcaaccaaggggctaaaaaccaagaaaaacaacattttatgtgaagaaaaactcccttcacacatcaaataaccccatgagtccactactatggaggtgaatccactattctaggttgctattaaacccattctagcataatgaaatcaagagcatgaagcaagtcaatatggtttaacaagaatgtcaggtcttagtaatgcttttatttacatgatggaatcaagaaaaaatgaatcaacacaaatacagaacattgtattaaagcatatgaaaacaagacaatatttttttaacatgactaccttcggaatggatcttgatgctatagtttcaccaatgccacgcaatacctgcacagccttaaatttcagaagaagacaagctgatgtggaaaacaggcacaggtaaaaaagcttaaagtcagtatcagtaatcagatgtgcacggcacccatgtttgcttagtactgcatgtagtataaaaatgaacatatctgatatcatgttaagacttaagaccatcaagtcaatacaattatgtacaaacaaaaaatagagcagcatggttaccaatgatggacagactgatgtaaagagtgatcccatagcatatacaatgcagtccaccttacttaactgctccaaaactgtacggttagcttcaggaaatacctgcattgcaaggttagtaggaacagttaggagttttaaaacataaaaaagggttgtttacatatatactgttgtgaagtggctaatttgatacatgtcatcccaatatgcttacatggttataagtgcacacccttttaagcccatgatattcacaaaacataacagcctactatatgaaggagttgtcccttctcatgcctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31205 - DNA, 3335 bp, Oryza sativa
  unsure (1)..(3335): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctttcttttttctgctcggcggtttattcttgcatggattgctcattgcaaacgtgcatctactcctctgcttctaattgtgtttgccctgcgtgtagatgtagtccagatgagccacgagcaaacgctccactaggcaatcatcttcttcgcaaccttccactctaccatcgtagtttcccctctccacaacctgtgccacgatacccacaacatgatggtaaaaaatcggttaaagatacgttcaattaatcaaattacactacttcgtacatgcaaatttatcaaaggaaaacatgtcgtgatgcaacatgatatcaaatgtacaactgaaactaaatttaaaagaaagaaaaacagtttttttccttcaccttactggaagctttgctgggttcaattggcccaattctaccaccatggcttatgctgatgggaaggagaagtgctacaaggcaaatggctatgaccttcggtgacatggcgtgttatgtttgtgtaggactagtatcgaataggtcatggaacctgcatacacaatggtgtcattcagacgctttatataggactcaaagcaggggagaaacggtgtcaatcgtatcaattcttttacaaggatttttgtttcaaaccgatttgagaaaaggaatatactgtagacaagtatgggtatagttatgctgctgcggtggcaagtaagagtacagttgataggtttcctgaaaaaaaaaattgccacaaagaaaacatacaggagtatattcgttagttatggacgtgcgcattcagacaattgacaagtgacgatgcttctcgtcgtttattataccggttcatccacgaagaaaaagaaaattaatatatgctcttagctatttacaaattaatattgaagaataaactacgataaaaaatcttaaaattatcttgaaaataagttccaaactattttttttcggctgataagtcaataagcaaatgataaaactgtgtatatggactccacttgtctataaatataagtattccaggcatttagaacttgttcacaaatggattcgtgcgttgcatcaatcatcttagattcatttttttaatttactctatttgtttcaaaataaattaactattggatattttcatatttgtaaccataaattgctttccaatcttactcatttgttgcttcatcaatgggaagtatctaaaaaaactgtcgcattttctttaggaaacactttcaaatataaatatattataactatattgtaactacgatataacttacgtaaaacttgtattttcaactatggtttgtttggctagtgccgggatcttacgcatgacatgtaaaattttctttatagcaattttttctcttcatgcagaaatctcaagatgatcgagaacgaccacaaatctataagttttggaggaaaaaactagcgaaggttttctagcgattccggtgtcaatataattgcagtcctcgatcgttacctagatagtcttgtgcatgtgagtatccgatcaagatcattcataatgttctcaaaaagaagagagagaaacctttcggaaacgaaactgaagtgtctctttcattttaagttttgcaatccttcattaagtagcactaagatactaatcacttactcacttatcactttcattttaagttttacaatccttcgttaagtttgcaatcttattaattaccaccttatttttaaagtgtacaacgttattaatttttctcataaggtttaatattcttcttattaaaagatttagtataaatatataaaattataaattaagattatattttatttgataataaaacaagtcgtaacaaaataaataatattatactacttttaaataaaacaaatagtcaaacgttacatgaagagttaacgatgtagtagcttaatttaccagtcctatttagagcaggtactcagattataagctagctagctataaatatattttatagaaataaaagagaagagagaagagcaacagtctatctgtagccagctgcagtacggactttaatacgtaatgtatatatgacatgtggaactaggtattaataatacagtaagcaattattatatgaattaagagtattaaattagctataaatattttagagctagtggttggttataatataatattaaacttgctctaagctggggccggtcactatctgtgtccatgcgcagacgaggatcgcgtcgctttccccgcgatgattacccccggcccgatcgagaagaagacacagatgatcgagtgggtgaccaaggacgacggcaagtcgatccaacagatgagtaggtcgttctttaattgactcccattgcctacaacctggggaaaccaaactctggttttcccaggttaaaagccccaaacgagagcggctagccacagtaacacgataacgtacataacaattccagctgcgcgcggtgtatggcggcgccggcccgactccgccggtgcacagcccccaccaccagcctaatttgttccaacgcgcgcgcgcgcgacagagagatcagcgaagctgagcatgcagtgccctagtggccgcgtcgtacgtacgcatctctaccttaaaacatacgtgtctttatcactaccacgtgagctcgataaatactcatacatccacccgtcaatgataaatgtatggtgcttttaaagataaaggatctgaatcagagtgtgtttagttcacatcaaaattagaagtttagttgaaatcagaacgatgtgatgaaaaggttaaaattttacgtgtgtatgaaagttatgatgtaatggaaaagttgaaagtttgttgaaaaaatttgcaactaaatacagtctcagtcgtacgtcgagccgcccgcaggagccaaaccacctaaaaatcccacagccatcaacgtactcgatcgatacagatatagatggatggatggatggatcgaccgcgcgcgcgggcaacgacggcactgatcgatcaccttaatttggttgcaggttgcgacgtcgacacgggtgcgcgtcgcggggccgggggggggggggggggg

SEQ ID NO: 31206 - DNA, 25939 bp, Oryza sativa
gggtatctgcggccgcggcgccgggatcgttgatcgtgcgtgccgggacatcgcggctttggtgggccggcctggccatgttggctttaacttccgaagctgtggatcgttcggacgtatcaggcccattacgccatcacctgtatgtattcctgtactcatgtagttcgttgggagaggatcatagaaaggaaaagtccctcagattttcgtgtgcacccttcctattctgctaaataatatgtttttaatatattttctatagataaattattgttttgagaaaaatcatattaattcaattcttaagtttaaaacatttacaattcaattaattatatcctaatggttaatcctgtttttgcatatcttttttccactctttttttaatccattgctttccatctacactacaacaacccagctttccacacatcgccggcagcatcaacaacagcccttctcttctactccctcggtaaaaaaaaaaagacaaaccctgagtttccgtgtctaatgtttgactatccatcttatataaattatttttataattactccctctattcctaaatataaggcacaaccacccttaacccaaagaccaagaaatagttattatcatcttgtaattgaatcatcctaataaatgtaatgcatgcatccaatagagttagagaatgtgaggatgaaggatttaaaagaataggagtgaatttcagaaaaccccatgttttgaggctaatataacacataaccacaggttttgtttattttctcacataaccccgtgcattcaatccaattaacataataccacaggtttaagtaaaagaaagtgccacaagggcaagtgatatggcaaacctgctccacatcagctggccccacctaccaggtcaatacatggcctattagggtgggatcacgcgggagaacagaagcgcgtgttccctgtttctacgcacacgacacggcgcctcccgtctttcttgcgcacgctggcggtggcgacgttccccaaccatctcttgcatgatggcctccggtgatgatggtgatgttgacctagctggaggaagagaactcgttgggtaccattcctagcaggtaacattcatcccttttcttgtgatgatcatatgaattgactccaaagcatgctggttggtgatttgcaaggacactctgcttcatggttctttgacgaggaattaaatccagccattttgatcatgtttggcttgtcaagaaattaggcctagtaaaatgtaatttaggggaaccattattgttagggcattacaactatgcaatcgttcttctgtttgtcattgcaaaattgcttttcatcatttgaccataattttttaaataaaaaaagcatgtagattggaccgtgtataagactattgtattacaactattatattgcagtcagatataaaactaaccacaattaacatttaaaggcctgcaacatttttttctgcttcacaaaagagcagacatggcttcctctttttttttctcggtaaataggttgtatttttctctgcttcacaatgtatatatttcagatatggattcgttttgcaaatttcctatgccctggacctgcaatgggtcacatattaactgttgctatggtgcttttattcagacatgggatgtttttataacgtttgctccattgttctgcttaatgcatagaaattgtcagttttttcctttcatttttttttcataggaacacagtgtcaggcaccttggtgatcgacctacttacaaaaaattcgagcagaaacattgtcaggtcctgccgtcctggccacgtttaatcaaatacacacacaagctttgtattagaagataggaagtatatgtacagtttgatcagttgatgcaaaacagaacaggcgatgcttgcctttgcatgtgcacgacgagctgcccctctgaacttgtaggaggaggaaaactgccgcagcgagcacgaggaagacgaggggtgcgtcatcgcgtgcgcgggaacagaggatgggtgcttccccgcgctaaatagcccacgcattgatctggcaggtggggccagctgatgtggagcaggtctgccatgtcacttgccattgtgacactttcccacacttaaacctgtggtattgtgttaattggatagagtgcattgggttatgtgagaaaataaatagaacctgtggttatgtgttacattggctccaaaacaatggggttttctaaaattcactcaaagaatagtaatttaatgaagaatacatgcatgtcttatattatgtaccataaaaaagtggttgtgttttatattatgaaatagaggtagtagtatttttattattgttagatgataaaacatgattaatactttatgcgtgacttatctttttaattttttttcatattttttttaaataagacggacggtcaaaacgttagtcacggaaacccaatgtttgtttttttggacggagggagtacttgccctgcccgtacggtgtatacgtgctgtcgtcgatcttgccttacgagactgacaccggcccactcaaaagggataccataccaaccctgtaagactcttaacatttttttttggcaacattgctcatagggttagtacacagtacttgctgatccattgattgacagccgtttcattgggttgatattcaagggcgagaggacagtacattagaagtactagtaatcaacaaaaaaaaaagcattaatttcttcatgtacgtgggcgtgcttacttttacatatgtaccacgcatgcaccttaaattctcttaatttagagctcatcaacagtttgtatgtacacaactacggctgtctgccagctagcttttctacgtatacccttggcaaaataccctaatttacggttatgttaattaattgtgatgaaatatatatcctcctaagtcctaataacagtctattgccacatactaagttctggaggggtaaaacatttcacacacaattcagagaataattttggtacagctccacctttaatggttcttgtctagctctaacttcaattgttgcgatgatcggatggacgttgtttgcgtcgtggatgtaaatttcttctttgtctagaagacattgtcatatgtttcttggtcattggttgtacatacagttgtttattcataggaagtcagagctgctcttttgagctcgacaacaataatttatgtgttggaattaatacgtggctaaaacttatatggagattaattctttgaaaaatcataaaagcccatctcataataaggtatacatataaatctttagtaccacctcacttattataggagagggatgcctcctaaaaaaaggagattgctcttctagttacttgagccatgtgagatgaagaggactagagaaacgcacgtgctcccagacgaggcggcgtgagcatgaatggtcacaaaaacggtatttatttttggaaaccagttttaggaaacacaccgaactgcgtggaacgacatcgagtttggataagttacacacaacttatccagttcggttatacggtgaaatttggtgtttgttatcggaaacataattgtaggaaacacgctgaataatccgttgcgtggagcggcgtcgagtccggataagttacgcgcaacttacccggttgggtttatagtgtaaagatcgtgtaggtgtcctgatcacacgtcttgatatctctctctatataaaccgagccaccacctcctcacaacatacgccaaaacaacctagggtttgtctcctcctctatactacattattgctcgtaatctactacatcccgctcgccggcattcactgatgatcgggagagcaggtctccgaaaccttcgccttcggtttcatgcaccgggagaaggcgacgataagagttttgggaaacgattcgtgcgactggtcgctgttctttcacaataatttgtcttcctctacgcttgacgtaagattaagtgagaaagctattatgttcacattttagacaaggtagtgtcttaaatcactttattttagtctacaaatgtcatatttggcacagctcaggatctgacattttctggagctgggtgttcctagcttcacaaatccatggattggatttaggattacattgataatatatggatgaaccattttgttcgtattttataaaatttcaaactgtactataacttaatatacaaactttaaatttagtgtatctaggatttagagctgtaccataccaaaccagaccaaatttagtacacactccatatcatgtaagaatattaaaaaaatatatagctctaacaaaaatctgaaaattagctagagctctaccaaaacccggagttttcagctgctggcagcccacagacgacaaaagcacaaaatgccatgatacagcgcacctttccctttgggcaccatcatatcagtccagcgcaagtttaacatccgtgacataatttatgtgtacctaatgtggcccccatgccatcaccctacccacaaaaagagacaacaaataactctagtttgctttgctagccactcccttgttttatgaccaaacttaaactttttattagtggccatcaaattgaatataacggcttcccttttagactagaagaggacgacgcagagagaaaactgaaagtttttttttcactaatgtcttgattaatctcaccctcagtgacgatgcgacactagtttcatatctagattgaaattcactaagggcccctttgaatcacagaaatgaaaaaacggaggaaaaaaacataggattttgatagaaatacaagtgtaaaacaggtgattggaaaaaacaggaaaaacataggaatgactgttcgattgggccgcaggaaaaacacggaaatttaaggagagataaaagactcaaagtattctttccatgaggttctacctcatgttaaatttactctaaaacttacatggggaaggacaatccataggaatttcataggattccataggatctatttctttgattcaaaaggctatatagaaaaaaatcctatagaaatgaaatactctaaaatttctatgaatttcctttgaatcaaaggaaccctaaagttttatatcaagtacaaattgggaaattaccggttggtaggctagctaactttaacttaactagtggcgccaattaaggatgtgttcggacccaagggttcccaacacctctccatggttttccgcgtgcacgcttttcaaactgctaaacagtgtgttttttgtaaaaagtttctatacaaaaattgcttaaaaaaatcatattgattcatttttaaaaaaaaaattagctaatttctaattaatcacgtgttaatggactgctccgttttccgtgcgaagaagatttgttcccaacctcccccagcaaacacagcctgaagaagctttcgtgcagcgcggcgcgcgcgcgcttgcttctcctttttctttaagattgcagctaaagcaaagagctaaaaggtggcgaaacgggaggcctttctcgccgcgctgcgccccctcttcttcgtgccatcgccattgccgcgcaacatctgagctcgggtagccattgctagcccatgcagggcctcgcgtccccgcggtgcgctcccttctgcggccgctccggcgccggcgcgggcggggcgccacgcgcgcggcggcagcagggaggtggctgcgggcggccgctggaccgcgtggccgggtgggtcggcggcggcatcgccgcggcgttcttcgcctccctcgagcggtgctcctgcgtgaacgtccgcacgcacgacgagctcgacgacgagacgagggactccgaggcgctgctcatcatgttcgacgtcgtcgacggcagcgaagacgctgcctccgccgccgccggcgccggcgggaggaggggcaggaggagcgagaagagcaagcgaggtggcggcggctgtggcgggcagctatggtgaataattaattagcagctatatataatttttgctatgtatgatcgagatcttgatgatgatcgatggatgcttgttaagtttgtgcaagattatttacgtttatatatatatgtctagctttcatcttgtgaaagatacatattttcttggatgtatggatcgatgataaattgtattcaaggtggttttttgaagttcaatggcaatggaacactgattctcccttccttttcattgtgttctcaagatgtattttccatcctcaaatgatacactgttctattctcaagaaaagttttaagttatatgtaaagatcaattatatggcataatatgtttttatatggttagattgttaaaaaattttagggcaatcatcctatattttgttagttcattcctctctttttttaatgtgcacactaaagcagtggtggttctcactgcaacaaaaagcatctctacggattttttttttcaattgaacatgattgaaaaaccattttcttatggggtaacccattttcttataatccacctaggcgttcaacccaaatgcttcctggctctacgttctaacataatgtcgtgtgtgctccgattttctttttgtaatcatcaggagtttcgttctcattgatcgcatataagagaaggaagaaagtgttccattttctttaagaaaaacatgtgctatttcatgtttttaataataggctcagagcctcagattacaatcggtggaaaaatatattacaatgtcgaacaaaatatgctcaattgccggaagcacattgctcaaccaaacagccaagcttaacacttcctctagcaaacttatttaagtcatgaaagacatgagttattcaggctaaattggagcaaaattaacatcccaacaaagcccataactttatcgcaacgtaccaagttgttctgttcgccagcattcggtttggcccatcaatgtaaacccactgccttattttgaagcccagctttgctttctcagctatactacccatttaacaaccatcattgatcattcccatcatcatctccattttagttgtgcaactcaactgacagagatttcaacaaagcatgaatgcatcacacatgcacatacacgcgagtgcgtccctttagcacacatctctgtatataacattcacattgtttgcttatcatttgagtcttactaataaacaaattaaggaagaacaagaaaccaaataactaataacagacaaagtaagcaaaagtatgaaaggcaatctaaccaaagctgctgtgcccaaaaggccccaagacactatatcggcatgctcttttacttggacacctgtcccaataatctcccaagatcaaagctgcatatgcatcccccatgtctgcctgacaaacacaaccaaaaacctctcacatgcaggcctctggaaagctcaaaatactatcaaattcccaaagcacaatcagggagcagctagccaacagcctttatcccacaatctcgatgcatcccatgtgtttggctacattgcgtgcaacttttgcttcaaaataaactaagtacttcatccgtcccaaaataagtgtagccatggttttccacacccaactttgatcgttcgtcttatttgaaatttttttaaaaaaaattaaaaatataagtcacgagtaaattactattcatgtttatcatctcataacaacaaaaatactaattatataaaaaaataaataagacaaacaattaaagttgggcacggaaactcatggccgcacttattttgggaggaagatagtaaaggttatggagaccagtaccctcccatcaatcatcatgcatgcaactaactctctgcatatagacaggcagctctggcatataggcttggaatgatgccatctgtccttttgcaagtttgcagtctttcttttgcatatatggcctgtccgttgcagcttaaacatctccttttgtagttttgctagctaagaacaagcttttttagttagttaaataggtggctagtgacacttatatcaacattcatctcacagatgaatagatgtcgttatgtaatacgtgcagttaaacctcgaaaccttaaataattaatttataaaatatattaggagttgatacgagaaaagtgtcaataggtgcagtcaaacctcgaaaccttgtatgattagttaataaaaaaatattaggatttgatatgagaaaatgtcatttgtagatttgtcatgaaaaacacatttatattgtttacttttaatggtttttaataaatactacataagagtaaactatgctcacattacatgaactttcgtggtaggtgtaaataggtaaaaaaattacaaaatgattagtctatgagaatagggacgaaatgatccacgcaaacaaaattgttgcaacgttgcaaactgatggcacgacagcttacatgtatgaccatgttttagagatcttatttgaaatctaaagaaaaatagaaatatgtgaaagttcatttttcatgtacataacagaatttatttcatgtcttggaaaaaatttattcactatataactcatataaggttaacctatatgttaaggaccagggtaatttctgccatgcctttgtacaagtaactgctgaaaattacattttaattttcatgctcagaaactcatttcaccaaaaaaatgtttttttaaaagcttactttcatggttgggcatttttaattgtttcgctttttgtcgatctaattcttaaaaatatcaagcgaataatagttacacattttgtccatataaaatttgatgtgcaataataattactcatcaatatgcaccacattagatcatattttgcttgcagagattgtattgacccaggttcacacaggctaggcatgttgtaaattgttgtatctatttatacccaccatacaagctgatgtaccgtgaatgtaatttactaaatatgtaatttagtgataagatatacgtattgggaacaacgtgtcaatataaaaaacgacaaataaaatagaacagaggcagtccgtgtgtagtgtggtgatcatgggcaacggcaacggaagggaggtttttaatttaaggttcctttaattcaaaacagcaatttctttcggttcctaccgaaaatgaactgttttatgcgcaaaaatcatgcattctaaggtagcgtactcctgcatgcatcttgggcatcttttttggctcaattgatctctcatgcagcccacttggtgcaaatgttggagagaagtgggcgtccatttaggagaatgctttgggcgaaaggaggtggatagctttagagagagtgagacacttgccatttggattggttataaaaatttccctagtgcagttaatgttacaaaatatatatagccctgtttggttgtacatcggatgtttggacgttaatttagaatattaaacatagattaattacaaaacccattccataacctttgactaattcgcgagacaaatctattgagcctaattaattcatgattagcctatgtgatgctatagtaaatatttactaattatagattaattaagcttaaaaaattcgtctcgcggattagccctcatgattatcatagtagcagcctatttcttccttgcgccctgaccctaatgattggtgacattgcagcaactagagctagattctgtgtgcattaagttgttatatttatggggtttcctgcaagggatcgactaatggaacatgttgtccactgtccagtggtttagcatatcaccttcacaaaagtattatttttcgcaaagttcaatctttaatttgtatctaacatatcttttgatagataaagacatagaagaatatcgtatggttctatcaattatagtactcgaaaataaaagtagaaaattgacctccaaattcgttttcaaggcgtacaggttattcctaccatgttaatcaaagaacaaaggagaagggaaaaaaatctaacccgttgagtgtggtgtccggatgacaataatgtatatttatctgagatggcatattaggtgcatgtcaaaagaaaattgccaattgaattagaaatcttaggtgcaaatgattttcaaaatagagtatcaaatttggtgcatgctacagttattgagaagtacccctccatttgttgataattgacaattttaacttttccaattaaactttaaccattaattattcttaaaattggcatatcaaagtgaacaaatgttctatggacatacagcactctaataacattgtatcatttctagtatttatattttttgaaaaagaaaaagacgagcaattaaagttcaaaaatgaatatatgttgtttaaagttgaaagagaagaaagtcaagaaaccttttctctcttttcttaataaactggccagtccaggagagattggccggagaaaagaagtgcaaacagagtgagcatggtagtgtgcgtgagctatgcacaagtttggggtgattttgatggaagacgacccgaagggcaaaatcttcaaccttaatcacgaaggaaacgtacggcccagatatttaattatctcacagcagtccaccccatgatgatttgaagttactctgtctgatggccctgtatcttgtcagtaattcggtatgccggaaactgggggcaatgtcaaagtcttttgggcctattggttaattaactggcagcttaaactggacaactgttttattggctcaaattttgcctaccacttttgttcctatattatggacttgccaacatttttgggtttgttaaatttggtctaaaagcaaacaaaaccatactttggcttgtcaaatgaagacatggaacagaacaaaccagacacgcgcattggcatactgtttaataaggaatactcataatacttgcgaatcattttattaagattttgcgcattgaaatattacatccgattcataacaattgacacgtggcaatattccctatattccaaattacaaaacgtaaacaattcaactctaataatatttagctaacaattaatttggtataaattaaattttatttgatgaaaattatattattgtattcatatttggatgtgcttccttatggttatcttttgctactaataaacattgtagtaatacgagaaattaaaaatcaaatattagttttagagaactccgtcaagtatggaccgtgcagtatattctaggacgaggaatcaatagcaaatgcaaagctaacttaaccacaaattcactcacaagaattttgggatattttattttaacatgaggattatggaatatggaccccaaaaagtaagaaataccaataatacccctcctaaaccatctataaataccccagcccttcacttcttccctcccttttccctcactcccgtctctcccactctaatacgttcctaattaccattatgcccgtcatgcacctcctggccccaccagcgcaagccttcgtcgtcgggcccccgcgcgtcgcgcccgcgttcgacggggcccccgcgccaccgcgtgaggacgacccagccgccgaccagccgccggagagggaggccgacgccgacgagcggcgcctccgccggaagatctccaaccgggagtccgcgcgccggtcccgcgcgcgcaagcagcggcacctcgacgagctccgcgcgcgcgccgagcggctccggcgctgcaaccgcgagctcgcggcgcgcggccacgccgcccgcggccgcgcgggcctcgtccgcctcgccaacgcgtggctccgcgccgaggccgccgccctcacccgccggctcgcggcggcgcgccgcgcgatcgcgctcggccagctgtaccgccctgccgcggcggcggcggcggcgtcgggacgttcgagcagacgatcgcctcgctaatcgcgtagcgcgccgccatgcacgcacgcatgcacgttcttgatttgattggctgcaggttaattaatggaaaggcaaatggatttaaatatatcctgaaatccaagcatagcctctggatataaatcgtcaagtaaaagaatgagaaagaattaatggcatgactaatttgtgagcctaaatcggtcagaatgtttaattactggccacctgtatttcctgagatcgttggatatttctatgcttaggttctcagattattagcactgatgtcaactggcgagacacatcagaactgatttcatttttgaccttcttcggaattgatgattttgtcgggaattgaactgattttcatggaagtctcttttaagttttttgcattccaatttccaaacgatatctgatagtcttaagagagcctacgtgtgaagagagtactccacctgcagaaagacgttttggacaaagatctttcataatctcataaagattactatttggcctcgtttagttcccaaaaagtttttcccaaaaacatcacatcgaatctttgaacacatacatggaatattaaatgtagattaaaagaaaaactaattggacaattagggaggaaatcacgatacgaatcttttgagcctaattagtccatgattagctataattgctacagcaacccacatatgctaatggcggattaattaggctcaaaagattcatctcgtggtttccaggcgagttatgaaattagttttttcattcgtgtccgaaaaccccttccgacatccggtcaaacgtcctatgtgacacctaaaaatttttatttcttaaactaaacatgccctttgtttgtaaatttattttgtacaaaattatgaccaaatttgcactgacaaaaaaacagttcaaatgtcaccttttttaatcgtagggagtaacgtacaaaatcaatatagaagctctcgacacagtccattccaacaatatgattccaatataatcatcctctaaaagttacatcgtcggctacaaacatagccaacacatacacctacaataaatggtgaccttgtttttttaaaaaaaaacaaaaaaaatcaatgtcaccccaacaaaaccaaattgacaaaatttaaattaagtcccgtgcacaattagaataagatcattaagccagttgctcgacaagttaattaggcgcatttgtcaaagaaggtagattaagctggcccacctatatagatctcctcattagattattcttttcgatgaaatggttaatacattatacatacaactgaataatatttcctcttccttgttagatgaggagcactagaacatatctttctcattacatcgtttttgttaccgaatctataccactacatatcaatccagcttccaattggcttctatcactatcttcctgcccttcttctatatatccctcccaaccacggctttggaggcatcacttctgctttaccacttatctgtcaaccttccatcgccccaagttcggtatatatggaagtttccactctaaatccttaatctggcaggacaccccatcactatcagttgttagtttttaccacttaggttctctttggaggtaggaatgctaaaagcatataaataggaaaaaaataggatttttatatacatgcttatctagaatagaggaacgtaaaattcaagataaatgtatactctctccgttctttaatatatatatatatatgatatgttgacttttaaagatatatttgaccattcatcttataaaaaaaatacataattattattcattttattgagacttgatttatcattaaatgttctttaagcatgacttattttttttatatttgcaaaagaaattgaataaaacgaatggtcaaatgtttataaaaaaatcaacgacgtgatatattaaaaaacggaggtagagtagtacataaacaatcatttagatagaccacatggaaaaacataggggttagatggcaaagatggacccaaatgaaattttttgagagtttgaaccttatgctaactatcctggaaagatctccattcgttgagcatttcatagctagaattttaatggtatccaattctttgtctcaaagtgtcatttagacacaaatattagggaatgacctaataacaaataattagaatgtgtgaggctttaaacccaggtcgtctagcccaccaccttgtggagctagccggaaaatccctaggcgtttctcaaagtgccattcaggacaacaatgtcctatacagggacccaaatcctaaaaaaaaacctccatttgtcatttggatcatttgttcccaagggcgcaagtaaatagttaaaaatgtagcaatgctatagtcacaaacgtttcaaatcttaccatgagcaaatgaattgatggtacaactgatacagtgatactaaaaccccaagaccgtaagaaaacttattacgccataattaatgtgcaaacactttggatggacaacggccggtggatggatcttgatcagacaactgaacgttctctcgtacgcgtgtggtggccaactggccattagttcatgctagatttgattggtcaaccgatcgatctggtgcatgcatatatgatgatctgatcgaagtggacgtcgttgtttaattcctgtgattaaaagcgaggacaggatgctttccagattaattttgccagcagagcttaatgcgtcttaaagctgtgcctgctttgggcgttaatatcgttttcgggtgcgattaggaacttattctgtgggtgggctgttgctatcgccacgtcgaaagctttgctgcctcaaatcgtgttttaggactcggtactattgacgcctttcagataatccgaaagaaagaaatatgtcctctggccgagaaaatatatacaggtctgtttagattaatttgctgtggcaaattattttggcaaaaattttggtggaaaaagatttggcattgaagttttgctagttggtgtgtaaatacatggtagagttttgccgacttttgctactagtgtttagatccattttgacaaaaggtgctctaaaacagcaaaacttttactattttagaataactaaacaggggggcatagtgaaaatcacgtatgtagtaaaaattatcgtaagatataatagacgtatgtgatttatctacattactataagttctactgtggtaaaatttttacccatattaacgtgagccaattcttatcattcattttttttcatcttacaataatttccactacatattttctccctagaccttattggtttgcgatgctaacatgcatggcccacctagtcacccgctgtctcgatgggtttggcccaattaaaacaagcccatttggtatccatttcacctccttttctcccgaagatttttctttccattttgttctagcgaagaaaaaaatactaaaaatagattaatccatatccaaatgtataataatatatttggattcatagtattagattgcgtaaaatataatactagattgctactccggttgtcccggaaaaaaactcctagctagcatcccaagacaacaacaagagtagaaaagatcgaaacgttccttattagtagaaatttagaattggtggatgagggatatggacagtggtggtgccaagatttatggaagactagagctggatagagcggtaccatgtgatcgtgggttcattccccacggacggtgccagctgttgtcgattagacaatatatagcgtctgccgaaagacaatattcactcaaatatttggaaaatatgaatggtaaatgtattgatttcttaataattggatcccctattacacatccattggggtctatttatagttttatagtccaggtttataatcctaaggttgttggttactcgggaattgacttggcttctcttatgatagggacgtttataggggtaataattgtcttttgtcccagtttacaggcccatgggccctaaaggcccctcactaggccgtttattaggttcgcagggcgaaagcctctacgaagagctcatcctccttcgtcgtatggtgttcctttgtcccatgcttggcgaaggtcttttgctctgttattccatgggcgctaagccactagtcgcttgccttcattacttatgcgggcttcgcccttcaacgtctggcttcgtgacttgacaggtgtttcggtagtctgatcaaaggtactcacaacatgcctccaacagttggttgaagacattcatgacatgtccctgacagttagttttctataagatttatatggtgatttaataaaatatagtcgagattttagaggcatgaagctatcctaggtctacctctgaccctgggtatatggaagggatatattttctcgatttataaaggtatgtactctctccatttaaaaaacagttatggatttgaatctgaaaaatgtgtaaaaggatagaaatcggtctattttaagatgaaatttaaactgtacgagttttttttttttaggaagcgtaagcagttaagctgatgtggatgcagagttgcagacagtcacaagcaggcggaggttggtttcttggtttcagtggagagattgacaggtggtaggagtagaaaggataggtgtggtgtaggagtacgggcggaaggcggcgaggacagcaggaacgaggccggccaaattcccccaggggggggggaccgtggtttggactttttaaagtacctatcataactatctatcatatcggatgtttagatgctactctcttcatccataaaagttaaacatattttacatttgagtttttctaaataagttgatttatagttcttatgcattcaaaacttaaatagagagataaattaaatatttgattagaacgtaaggagtcatctaaatacttattgattgcatgcttgcattcacttcttgagtttgtaatatccaagatgatttaatttctccttggtcgtaatgataaaagtaatatgtgtaaattttgtggatggagtaatttggagtattaaacatagactaattataaaactcattctataactttggactaattcgtgagacgaatctattgagcctaattaatccatgattagcctatgtgatgctacagtaaacatttgctaattatgaattaattgggtttaaaaaattcgtctcgcgaattagctctcatctatgcaattagttttatcaataatctatatttaatactttaaattagtgttaaatatccgatgtgagacagactaaaatttaatccttgtgtccaaacaccacctcagtgcccgttgctgtacgccgtgagccatcagatcaccgccccaaaactatgagcgcctttgcgcctttcgcccgggccggcgtacgcacgccgacgcagcttttgcacaaccacaacactgctgctgacatgttctatgctactgttctaccttgtgctaagcatgggccattagtttagctctactacttcagttactattactactgctgttagtttgttactgtactagtactactccccccatgctgtgcctgtatggtcaaagaaaggcttgctggttaccacaggtgccagcatcattcgcttcagaaatcagtgtgtgttttttcatagaaatggaatgtcagggaatcagggatacaccgttcaaagggaccaaaacacacacacacacacacgcacgcacaaacacacaacaccgctcctctgagttctatcctgctcccattgagctgtgtgtccatggctctcattggaactttcagctagcaataaatttacacaacaagaaatggaaaggccccgtcctccccaacgagaggcaaggagaggactgtcgtcttggttttggttggaggctggcacaactctcacactcacagtcacaggcttcacgaatcacgaccatgagctatacagtactggtacttgcactagggcccagtttagtttctaaaaagtttttctcaaaaacatctcatcgaatctttagacacatgcatgaaacattaaatataaataaaaacaaaaactaattgcacagttaggtcgtggccccctgtatctgtctctcaaaacacacagaaaccactaggtgtgctatggtttattggtttagagcctctttgaatcgtatgattgaaaaaacagaggaatagaaaaaatatagaattctgataggaatacaagtgtaaaacagagaacacaaagaaaatacaggaatgatcgtttgattggaccgcaggaaaaacacaagaatcagataaaaagagatagattgaagggaagttttccaagaggttagagtggatgctaaattttctacgtttttcctctagaatcgtgggaataggaaagtttcctacgttttttcttttctcttcctacaaatcaaagacatgaatagtgtagggtttcaattcctttgcttttcctctatttatcctccaattcaaaggggttatgtttagtttctgaaattgggaagaagtttgggaaaagttggtagtttggaaaaaaaagttgggagtttatgtaagtaggaaagttttaaatgtgatgtaatgtgatgaaagttgggagtttgggagaagtttggtgcgaaggccttaacagggttagtaaaaatgtaaaatgcaggagcagaagccatggaggaccttgtcctgtgctgtgcaagaagctggctgtgcatagaaaattggagtagcagtagcatagcacctgtgctcccttgtgctgttcctctgaagaggggcagtgatgagagattttggggggcctccactactctatagtcaagctttgaactcaaaatattgcaaggtgcatcgtgcatggatacatatatactacagtagtatttgccagtactctctactaggcgtactacggagtactatactgtagtatccgtgaagataacatttttatgctgttccttgtaatctactcaagtagttcagtaaacaggggaaccagcgcttctaccaaatcacccttgctctgaactgtcgcgaaagcttgaaattatctgatgcatcgagtagaccattgcagcgtgtgctgtactccgatgtaatgttatccattcggagtactactatcagtgttccgtactgtgtcttaagcctaaccatgagagtgtgttttgctgcagctttatatggtcgctgccactgccactatagctgattcccctgatccgtcttcaggtgccatccaatcaaacaaagcctatatgtttagatacaaagtttgaatccaaacttcagtccttttccatcacatcaaccagattacacacacaactttccagtcacatcatcttcaatttcaaccaaaattcaaactttatactgaactaaacacagccaaagttgaaggtatgtttgaagagtttcacagctacggtttctcctagaattagagggtgttttggtgaaacacccccttaaaatcttgctaaacagtttaattttttttcaaattgagaagctatggttgtacaatctaaaacataaatcaaaatttagaagttaaagaaacccagattttatatattttcaaaagttgactaacaaccagttacttccaaaatctcccgagccccattggttgccctaataaaccaaaactgaaactaaaatttgaattttcaattctcaacatggtttcttttctagctttgatttttaagttgttaagaacacacatataaatattttacctatacattattttttattttttaataagccgtttttgttctactagagaatatatatgggcgacagatgagatcccccttctctcaaatgccagctgacctgcttcaagatttgtacagaaaccctgatcccccgaatgtgtaacatctgatgatactaagttggtttttttatagaacggaagggaaggagtaacttgttctgtttacagcgccgtcagtagccaataaaacgccagcgaccgcgacgcatcgtgccttctccgttggttttactccttcgcctcgcaccgcaccgcatgcggcgagcgcgacacaggacacactcggacgctcgctactcctctccgctccgggcggatggatggctgcgctacccaacaagtaacagccatcgtccgtccctggggaccccgaccgcagagcagacgccctcctcctccctctcctctccccacccatggtgttatgaggagaagaatactatgatcctcttcttggcttcttcttgcatcccctcctcctcacatgccaacaacaacaacccttcctcctcctccattcgccacccctcctgcttccatccatggacgccactcccgtcttcttgattgctgattagtcagctgcctgcgctgcgttctccttgtgcttgtgtgcgtgtgagagagtgttcgagcgaaggagaggaggaggggaggcaatggcggcggcgaggaggctgtcggagctgctgcaggagcagcaggagccgttcctcatcgaggccgccaagatcaggcggctgcggcgcggcggcggccgcggtggaggtggaggtggagcgtgctgccccgtggccgcgtgcaggaggctgctcaggctctgcaaccacgggttcaagaagaggcgaggctgcggcggcgtcggcggcggcggcggtgtcggcgggggcggcgtcagggggctgaggtcggcgctgagcaaggcgctgtgcggcaaggccgtgaggagggtgctccgctgggacagccttggctgcttccccggcggcgtcgaccgcgagttccgccggctgcggcggtccaccggcgacagcggcgagtgcgacccccgcgccatggacttcagcggccacagcaacgacgagcggccgccggggaggtggaaggcgcccggcattggcatggacatggacgtcgacgagtcgtcgcggcagctcagcccggtctccgtcctcgacctgcactccgacgacggcgactctcctgtgcactgccgctgtaagttctctgacctctacagtgccctctgcactctgcactactacgctttaccattttaccaacccgtcagtacttttgattaggcattcaatgtgtcttaacatttcgatttaccccccatgtttattactcttaccaccttaatcaacattttcccctctctctctccagcaacaatggttaaaattaacctttactacaaatgctacttattaacatgttaactgcacatttaatgtgtcaccattgccattaacccgatgtttatcagtactccatcttaagattcatctttcccatcttaacactccatttctattatcacaggggaggatgcaaagccctcgacctcagggagctcgccaccatccgagggcttcatcggcgccacctcaccatgcttcacctacaacatccatggcaagatcatcccaatggaggtagaagaagacgaagaagaaggcgacgaggaggaggaggagatggccagagccggcaagtccatcgagcagcagatctcctcgtgggagaggatcgcagaggacatctccaacatcccgagaatggtggagatggacttctcccagtcgatacaacaatggggcgagctcaagctcgaggcagccatggagatcggcacgaggatagagaccctaatctttgatgagatcaggagagaaaccgtctgtgacatgcttgcttcacactgtacattggcagctgcaacatcttgttgaccacagaaaagagagagagagagagagatagtagtatgtggactgaggaggaggagaggggggtgtggttaaaaaaaatggaggatctgtataatttgagagggttcatgtggaattcatttttttccctaactccaaagtcttggtcccattgttgtcccgagctccatgtttttcattctgcaaatattatatatatatctttagatgatggcaaatattagtatatggattgaaaaaggacggatttttattctttcttaaaagagcagcagttaagaggcctaacaaacactaaaaatatatcaagagatgtgtagacttttacatgcctgaaaactctctgaacaagaacactacagatgagtgcttgtcttgacaaagaaagtggggcttgtctgtccatttactctcattgtaaattcaccaggaaacacgccattattccaggtaaacagaaggagacaaatctgtggtctcaaaagtcacaggaccaaagctttgcattgcatggacatatagacatatggtcatatagtataaaagcaaagcttagcctttttcattaagtgatcagtttttgtccatttcacaaaactaacaacctaaactgcacatttggaatctgaacactgcattgaaaacaggtgtggcttccaatggagactctgtctgtagggaaagccaagtcctctgctaaaggacagggcatcatgtataggataccctttgctgctactagttgatgtcttaattagtgggggtcaaagaagcagccaatgctgctggcactgacagtaccttctttgcatctccccatggcataatatactgctaattagctcttagattaaggagactggtactaggtgcacccttgtactgctgcttaactaaaggtttaagatgcaactgaaatgattccgcatttccactagggaggagctagagaattctctcacaagattagaccaaagaaagtagtagtaggccacaacgtgtggactagtgctcacaattacgccacactggaagaaaaaaacgtgacttaaaatatgatgaagagatcgtgcgtggttgctccaggtaaggagtacaatatgaagaatacaaacttaggagagttgagtggtatcagggttttgctttcactgaagtaatctgaaatcggccgatcgagcttgtctcttgttgatcaggaggaggttggtaggacagaaacctgagagagatcgatcatagccaaaacaaatcggcagttagaggggaagggggcaatgcaagagccgctccgatcgccgtcgccgtcgccatcgccgtgcacatgcacactgcactgctcggccctgcgaaaaattcagagaaccaaacagaaaaaaaaaaagaaaaatacgtttgcatctaccaccagtctctgtcttgtgccatgaatctctcagcagctatacgggcaagcgcaatgttagttgccgacttcggcaatgctgtgggccaagggattaaacggtattaaaccatcgcacccttcacattgtttatacgcgttggagaggaataaggtgggcccagctaaataaaaaaatcaccgatagtaaaattcccgtgactgctgcgtgactccttctcgcgagttatgtcagaaacattgtttatctcttgttcatcagtagtagctgtatgaccaggttttaactctttgctactctcacaatgctttctactaggtaggaagagagcatgtattgcttattaccggctaaaaagcgacaatgtggatgccgtacgagagtaaaatgcgtgtgcgtcgcggaggtagctgagcagagtgaggagaagcggagtggagtgtgaagtggggcccaggtggcagccagcgtggcgggggccatgtgggcacaataaatggcccggcggtgaggcagattgcgcggttgcgtcgcacaaggctgctactgaagtgatgccccacccaaccgccgctagtgtccgtcctcgtcctctctctctctctctctcctgtggctgtggggcccgtccgcccatgcactatgccttgtacgtccacggtacaattatgtggtctctacactcgtccggttctccggccccttcccttcccttgtggccgctttgtcactctttctccaaactccaagtggaatccatccagtggaacaatggaagggatcgagtttaactgctttgagtggtgatagggaaatcatacttaatactatactatgttgataaacagggaggatcgatagaaagagatcattttgattagacaaattttactacagcacatctaaagtttatagtcttcgctaaaagacaccgtaaaacgtgaaacaattggtagacacccctaaaaaattactctctccgtttcaggttataagacgttttgactttggtcaaagctaaactactttaaatttgactaagtttataaacaaatatattaatatttataataccaaataagtttcattacataaataattaaatatattttcataataaatttatcttgggttgaaaatgttttttttctacagacttagtcaaacttaaagcagtttgactttgaccaaagtcaaaacgtcttataacctgaaatggaaggagtagtaatagctatgggacaccgaggctattattattttttggtccaaataaaaagagaaacatttagaaaaaaaacaattttgcctctagggccatatgcttctaacctaactgggtctgattaaaaaatagggtttggagaggggatcagggatgaagattggcctaattcttgttgaaaccaaacccagtcgtcttacaagcatttggccccatcggtacatttgtcttttccacattgtttctctcttcatttgaaccaaatataataaaataatggtttcgttgtcccaccgctattaccattttttgggtgcccgccagtcgtgtcatgtttctgtgcgatgttattttagcaaataccacaaactaaagctgcgtttggaagtaagggttgggaaccctcactccccagcacgaaaaacggagcagcgattagcaagtgattaattaagtatttgctatttttttaaaaaaatggattaatatgattttttaagcaactttcgtatagaaactttttttaaaaaaatacaccgtttaacagtttaaaaagtgtgcgcgcggaaaacaagaggaggagttgggaacatgtccttgcgaactcagccgaagtgtcagtagtaaattttgcattatcctgcattaccacgaagtgtgactatacaggcctataaaaatggtgcattcttagtagagctaaaaaaaaaagaaaattgatttcacccacgtgagttgaattgttatcaagtttctaaaggtcactctataaataatggaggagactatacttaacaacagtaaattgattccgaacaaagcgggcatccattagctgaacaccggccaaaaagagaagcagtgcacccataattgaagagtatcccgcacgccccggataataatgtcttaggaccaaaatcataattgaataacaatgtccagagaggagaaaatctcgtatgtcttcttccctgggcatttaaacataagccaacaaaaatgtgtgtgtatatgcatagatcaaaatggtccaaatctatttgtgaaggatatgtaacggccaacggggccgttgcatgcaacagcagcatgtgctccaatagtttgcaacatgtaccagcagttattaggtttaggcaccgcctgttgccttgttgtcgtcgaacggtacagcgctagtacgtccacacattttgtagtttgtcaaggcaggattaaattaaaccactaaaattgcaaaggttaatatttttaatgtgaaatgctaagttaagagccctttgattggtagggaaaatacatgacatttataatcctttcaaataagtaaggatggggacctgaacactgctggagaaaccatctttgatcggtcgaccaaatttcataatagtcctggttgtattaaaaatcgggactaaaaatatctttagtcccggttttaaagctccaggggtact

SEQ ID NO: 31207 - DNA, 25806 bp, Oryza sativa
tctattcctcgccttctcctctctacacaacaacggtggggcgaggagatgccaggccggcgcgagggcggcggggcacggagggcggcgcgtggccgccggcggcggcctgcggcggtggcctggcggccggcacaagggcagcgcggcagctcagcgaagcattagtacgccggcagcagcctactggatggggccctgacggtctggcgcgagggcagcgcggcgcgcggcgaggcggtggccgccggcggccgcctttttgaggcgggcagcctgtggcggcaaggcacggatggccggccggccggcacgtcgaggcggcgcctagcagttttttctttctttttttttgagaatctgagctgagattgttgtgagatgtattttatttgtgtgtgatatgaatatgtattttgtagaagttgtgatgtaattttttttaagattttgtgatgtatttgagatgatcaatttgtggatttgaaggaaatttgaggatgattgttttgggattttggggacgggatagggttagggtgaaatcaatatattaaaaataatgaagagaagaaaataataaaaaagcaaccggatctgcctctttagtactaaccgggactaaagataaaagtatctttagtcccggttggtaacaccaatcgggactaaaaatcgatttttactcccggttatctcacccgggactaaatatagcgatctttagtcccggattcgtagtcccggttggaaaaccgggactatataggggttacgaaccaggagtaaaaaccacttctccaccagtggaacaatcctaccaaattcctatgaaatgacttaaacaaatgagaaaagttaggcctggtttagttcccaaaatttttttcacaaaaacatcacatcgaatctttggatatatgcatggagcattaaatatagataaaaacaaaaactaattgcacagtttgcatgaaaatcgcgaggcgaatcttttgagcttaattagtccatgattagccataagtgatacagtaatccacatgtgctaatgacggcttaattatactcgaaagattcgtctcgcggttttcaggtgagttatgaaattagttttttcattcgtgtccgaaaccatttctgacatctggtcaaacatccgatgtgacacctaaaaattttcttttcacgaactaaacaagccatgtgaggtacaaccgcgcgctcacagaaaaaactttttgagtctttaattatctctctaatttctatgtttttcttatgatctatccgaatgtccatttctttgttttatctatgttttatgatccacttgcattcctgtttaaaccttataaatcttatttctatctgtgcgctttctcaatctctcgtttcaaacttcaaagtaccctaacttgccgtggatagccgctgtatgcatgttggaattttgagtacttttattcaggtaaacaacagtgaccaagtcaggagcttagctgttgcatgtacaacgtatgcatgcagcttttcggccattaattcgaccgagatgtttgctggtttgacactgtggtgatatagctagattgctggaagagagactgtttatgatgtggcctttgtccttggtatatgtttttttggtgaaagatttggtggtacaaattaagactccatttggaaggcataaattaatttcataaagaaatagtacgtgcaaggcctagttcttaatagatgacggatggaaatgaaaccgagtttagataaccgtttcgatggcgcaaatgaataaaataaatactatatattttttaaaaatgattatatatattttttaaagatactttggtgaagaaagtttttgtaaaaatcgcacggtttagaagattgggaagcatatatacccccaataatccataagccaaaaagaacgggactaaattgttgtagcaaacaacctgacaaattttattcttcaatttttatttttatctaattttctagggagtgggtatatagggttgtaggaggaacaattaaagaaaagaatgagtatttagagagacaaggatcaaaattacacatttttttagcggactaaattacagatacctaatataggacagaaacatattgttatgatgaaaatgcctttcaccctacccgatactaggtaacttagatttctcaactaatcaactagtcatggggcacacactactgtttgagatagtactggatgttgcctaattgccagttatatgatactcgaagacaaagagaaggattgaatgtgtgtgaattatgcatcgagcagcttgtgtgattggtgaaggacatccacttgaccactcctaatttcatttctttattcgaacacggatcctatatctgaatatctaaaaatctaatagcaatcaaacatatcactcatctgcagtgaagcagccagcaagctgcaagcctgcctgcctccatccaatctgcttggctgcattgcattgcatggttccaggcttccagccagagccttggatgctctcaggctaaaacacaatagacaccatcttgtcctgttgcgccatccggctgtgcacgtgcagacacgagagcgacaaagcaaaccaagtgccacgccataaacaaaaaagcaaagctgtcgtgtagtttatagctggctctctctctgtgtgtgttcagcggccaacgacactgcgtcgtcgttctgaatttctgatactatcgctgcttgtacgtacttcgtatttctgatggcaaccgtgtcgccgtctggttctatctctctctgttttctttttttttcttttgaagagtttgattcttaacttagcactacgtaccagtgcctttttaattaatttcgtcgtctgcacatgagtagatcctccatctgtttgtgtgttgaccgaatttagttttatatttgcaccgtgccttttaaaaacaaagcaagacaaggagaaatggaaccgagtggctgtgtactagagtatatatctatctgcacttgcttttgtttgtatacgctagctcttagaaactccttaatgaaacctataactcgacttaggtgtggggtagcgagcttttcagtttgcaaggcttgccgatctggttgacccgtgctcaagcaaggttggtgatcgtgaagtcggagctgcggtatcggcggggcgcgacgtgcggcaacgataacatgatcccttttctgttgtgcttcggcgtgggtcgggtcattgacatgacttggcgtttcttagtgaagtcggagtcgcccgatcacgtgagtgatggtgtgatgacgataacgtcatgtctttgccaatgtgggagtcttgttttcttcaagtttgctgcaagtttgctgcttggtcttatcgttcttctgttgagcaacgtttgttgtgtgttttgcttggttgtccttttctgttgccgtgattgtttaggctagttggagagtctgtgtagttgtggttttcgtttagttttttctaattaaaatgggatattcttctttgtataaaacgtcggcaatgcactggtagaggaaccatctttgatcggtctggcaaaatccacaatagtcccggttccaaaaagaaccagaactaaatattgtttttagtcccggttataaaaattttgaaccgggactaaagatgatatttagtcccggttcatcccctgtcagatgcaagtcaggggaccgaggatctttagtctcggttggtgttaataaccaggactaaagatcaccactttagtcacggttggtattaccaaccgtgactaaaattgaacacgtagtatataatccctatctgttatcctctcctccacagttacaacttagcggatcgaatctctccctctctcctcatatctcacctctctaactctcttcctcatcccctctcctccacctcctccccttctcatccggcgggccggtgggcatcggggccacgcgcggcggcgggcggcggggtgcaggccgacggggccgcgcccggcggcgggtggtgggttccgtggcggcagccacggccggcggggccacgcccggcggtcgtggcgagcggcgacagcgacatcgtattttctttttttttaaatttgtgattcactgagatgtaaaaatttgtgattcattatttggatctgtgatgtatttgagtaattttttaggattttgtgatgtatttgatttgtgtgtataagtaactttatgatttgtgatgtggatttggtgatgtgaatttgggatgttactttgatttggggatttggggatttgcctacttgattcgggagaaaataaaaaggaaaaaaaaagaaaaggggaccatctggtactgtcgttattgtctctttagtcccggttggtaacatcaaccggctggatccttactcctggttggaaaatcgggaataaaggggttcccaactgagagtaaagatggtttctacaccagtgatggtatgactgttcggaaaaaaaaaaaaagaaacctgtaactcgaacagaagccgtcgagttgtctctacatctaagtggttatcaaacctaaaaaatctaccaaattttgaaaaggttctaaactaaacacatttaagcccgaaatgtgccaatatttgatagcgttcaaagtgtcaacaaataaaccagcccgaaaaaaatattttcactacgtaagagtccagagtgaggctctccgtcagtgagttcaattttggtccctaatctgttctatactgtatttccaatcaccagaaaataaatatcttatggaagtattagtatcaggacaggcaaactcgaacaattttgttatatatttgtcaacaaattttctcccaaaaatttgacagatataattacagtacaatcatagtgtagctacactgtaacttgcatgtaattatactgtaactataatgtaacttgtatgtaactttaaaaaatctctccgtaacatcttatttcagtaaaatggaggtcgtgggacaaattctttcacatgtgtgtgctacgatttttttcctcaccagaacaaatcttgtaatagatctaacgattcaaaattacgtgaaatttacgtacaagttacactgtagttatatgcaagttacagtgtaattacactacgattgtattataattacatctgttaaattattaggagaaaatttatcgacaaatgtataggtggtcccaatacgaatatggatcctctctctttctctctacgtcgtgaaccagtagatgggctggcgcgaataggcctttcagcacgaaagaacatacggcccagaacactgtgagcccatgatgagtcctgcgcggaagtgagggagctggctgaatccgggagaagcccaccgtgcaccagtcgacacggccctggtctaaatgggctaaatcacgggcagatgcatctctacatatttaaaaggaggaataaattcacttaggaccctcgtctttgacgttaagtttgactcacgtcctgaaaccacaatataaaatattacatacgaggtcccttaacttgtcaatgaatccgattttcgtccctcaaccgaaaaaccagacgcaacaggtccctcaactatcaaaaccggtgcagattacatccctcggcagttttgagagtggttttggctgacgtggtgcctacgtggctaatttgactcagtcttcatctgacgtggcattgacgtggcgcttacgtggcaattcgatccggaaaaataataaaaccggtaggacccacatgtcagtttcacacacaaattaataaaaagagagaatccactcagtaccattgagttttcttcacttctacaatctaccactgactttgttaagttgaataatatgccattgtgttttcatgaacctctactgcgtgccatcgccgtccatgagccgttagttggcacccgtttgatgaagtgaaaaattttttaatgactaaaataccctttgactaacatacactaacacttcttgactgaaaaccctagacgtgcacccaaaacgatttgctcagtataaggcggcgccgactcccatcgatggaacgccagccgcccaagtccccgacgcgcggccaaacgcccggctccccatcgacgacacgcagtcgagcgcagggctcctcatcgacgcgcggcggcggtcggtcgccgggctccccatcgacgcgcggccgggcgcagggcttcccattgacgcatagcgcatactccagcgccgccatggccgcgtgcggctgttccgatgtacctgcggatggattagctcgccgagttttctggataacgggaatcatccattttaatagctcgatcgtttttacctccggactccggtgtatgcgaccgcgtcgccatacggtcctgcgtcatccttccgtcaccagtttcttgccgatgaggaagtgacatcacgcgtgtatatatatatatatatacgctcccgatatacgtggccgtatatatatacgccgggatatagtaggtgaccaacgtacgcaactgctggccatcggcccatatgcatgcagcccacacgagctgcttgtatgtttcttctcccttacaaaaaaaaaaacatgtataatgagttaggggcaaatatgtctttttacagctgacggcgatgacacacagtagagatttaagaaaacacgatggtatattatttaacttgataaagttagtggtagattgtagaagtggggaaaactcagtggtactgagtggattctccctaataaaaatggtggggccccacgtatcatgctcacccctcctcttcttcttcctcctctctctccccaatccccatctctcctctcttcgtctctctcctctgctctctccaggcgacggagaggtagcggcacgtggcggccagcggccggcgggagaggaggaagcggtgcgcagcggcggaggcagggctctggcggttgtgggcggaagaggaatcggcgacgggaggtggctctggctgcggcggtcgcggtcgctgcacgtgctcgaccccttcgcggccgctgccgcggccgccgctgccgaggctctgtccggggaggccgccatcgccgcggtcggagcggcggcggaggaggcaaccccgacgctgatcgacgactcccctcagcaagctcaacaaccaccttgataagatgctgaagtaagatttcttatgttatggcaaaaactgaaaattgattccacaacgcttgatgcattcctaaaaaaatgtattttctgttgttgaaatcgatcatatttttaataaatttttggttctggtatgttatgttccttttgaacagagacatggaggaatcatggctggggccatggtaatgccttctcttggggtacgaatgtacgatttaactgaccaacacattgaggcagctctgacaaacctgattgctggtctggaatcagaatacaaatttgaagtaaatccagtgctcatcaaggtcatccttggtgttgctatgtcagtggatgaagtgcaggactgtgtttctcaacttatatcgtgtaaaggctattttggccgaggagggtgttgtgggaaagacagacttagagccttctcttcttgctgtattgagtctgaagctctggagacagtcgaatgcttaataaaaagtacaatgaatgagctgagtgaaccagttgatagagatccagtcatttttgttctcgaggaacctgctgcggccacggccacgaccacgatgacacttccgctcccgagataccgccacgtagcgagccctccgcctccagtccacgccggggtcgcgggcttgggcgacgagcagcaattggagcagctggcgagggtgctctcctcgctgggtacaaacgagatggccttcgcggcgccgctcctcgccaactcagcgttgctcgcggtgtggacagggtcgatcaccgtcttcgcggctcccgacgtcttcctccgctcctcttgcaccatgtgctcgcgctgccatgtcctactggagcacatcgccctgggagagaggaggaagaataggaagggtgagttctactgacatgtggggctcacgtgggtcccccatttttattatttatgtgtgagactgacacatgggtcccatgggttttattattttttcggatcgaattgccacgtaagcgccacgtcaatgccacatcagatgaagaccgagttaaattagccacgtaggcaccacgtcagccaaaaccactctcaaaaccgccgagggatctaatctgcaccggttttgatagttgagggacccgttgtgtctggttttccggatgagggacgaaaatcggattcgttgaaaagttaagggacctcatatgaacttattcctatttcaaaggaggaataaattcacttaggaccctcgtctttgacgttaagtttgactcacgtccagaaaccacaatataaaatattacacattcctcaaatttcaaaacatgtgtaagttaggttccaaaatggtttggatgtcagttttagctaatgtggcacttacgtacgtcgctagtttgacttggttcttgtcttatgtggcgttgatacgatagtagaagcaaaataagaatatttaaaaaattaaataaaatatgtgggaccatatgttagtcaaataaaaagataaagaaatactaggatgcacatgtaagtaggtcccatcctccacctcaccctcctctctatctttttcggccgatgacgcatctttccacttctccttctcactcctaacatttcctcctccctccttgagatcgctcggtggttggacactgctgctgcctccgtcgatcatggaggtcgagcaccaacgatggttgttcccctgctagggacgaactcaatgacgacgcaactgctagggacgagggtctcgaagacgatgttgtcctacttgccagtggtgtctgtgaccttgtcaaggcctacgatgtccatctgcttgtttctcctagcggcggtcggaccgtccttagccgtctaccccagcacgaggtttacgcccaactatatcgtggttctggatttctcggtaggaaccgatggtttagggcaggtttcaaaaattccatatcggttctatcaaaaaccaactacaatattatttcgccaatttttttttgatgtttttcaactttttgtgaatttggcaatattcgtacacatttgactaatttttattaagaacgaataattaaggatcaaaatttcggaaattttgaccatgtcgataccctcgatagaaatggtggaaacagaagattgaacccatgtttagggttgtttctttaggcgatttggcgagcaaggcaacatcctgttgctcgccggtgttggatctgaccgtgaggaggcaaaatattggttgttgagaagggccagctcggcctcacagtcgatttgtttgccttgggttgaggctgcggtggcgattgctgagacgcttcttgatttgagctcattcttgagtttttgcgtggtgatgctttaataatttaatccgtcgccattcaattcttccgtatctttttttttccctaaatccgcgttcttactgtcgtggttctcttgtgctgtttgagatgatcagcaccgccttgaacgaccgttgcaggcttgttgcatcaagatttgctcatctcgttgtacgcaaagtgcttaaaatgtgggcaccctcaccctatataaacacacacatacacataagtattaaaaaaacatatatatgaaactaaagtgggaaaaattaaacttgcaaccacttctcaagcctttcgtgcaacatcgactactactactattaggctatgttcttttctccaacaaaagttggataagcttctagatactcgtggcacgcttttcaaactgctaaacggtatgtttcgtacgaaaactttctatatgaaagttgttctaaaatactccgtatcagattaatccattttttaagtttctaataattaaaactcaattaatcacacgttattaccatctcgttttgcgtgaaacatttaatctttatctttatttttatatttatcttcagaagatttaaacaccaccttagtatttggtgattcaccaaaaggataagaaaacaagagagattttatagcaggtgaagtctttggtgatcgattcacgagcatacgaacataacgagctttaatttgttccggtcaaaaaaaataaaaataaaacggtaatactttaatctatttacagtaaaccataaggccagaaaaatggcgtgatcaacttgattcaatcgtcgttcagggcttgaggaggcatcgtcttagccagcctcaccacgctctgcaccacaccgccgggccccttgcacgacagcccgagcccgagcccggacccaagcccaagcccgagcccgagcagcttgctcccacccttgggcgtccccctgttcccgcgctcggtgcacgccaggaacgccgcgaggaacgggtcctcctccggccgcacggcggcagcggcgccgccgcctcgccggccgccccgacccgccgcccccggcggcggacgcactcgtatactgtgcggcaccgcctccttcttcgccggcggcagcttctcggcttctcccgccgccgtcgtggcggtgccctgcagcagcttcgacacccccggctcgtgctcccacgcgaacgccaccgcgccgccgctcgccggcgccggcgccgccactgctcccgccggcttcatctcacacgtactctccgggctctacctagctagagatctcaaccagcttatatataatcgtggatggtttttggagacggtggtcagagctagcagcctagcatgcatctttgttgttcttgcttcagtttttatagcagcagcagcagcagataaatcgatggagacgtcaggttgggcaaaggtaagggggatcgtcgtttgatcgctcatcgctgacgtggacatgtaacaatggtggcttagggctatttcttttctccaactctcggcttcctcatttttcgttattatatgttttttaaactattaaatggtataatttttacgaaaaaatttaatataaaagttgttaaaaaattaaataaatacacttttcaattttataattattaaaatatgctaatgagttttcttattttgtgtgcgataaaagtttctctctaaagatggatatcgaacgcagccttagacttgaccatcatctcttctctcttcttctctctcaccttgtcgtcagtattttcctttgggcatggcagctggaacggacacacgcaagcccggccggcagctaactgcaagtggttgcgatgcagcttcgtatcgtcgacgtatgagtagtttttttctctccgtgtacagatacagtcgatggaatctgtttcggatcatatcgtcatcatgtagctggtaaatttctttgtcatcgatcgacgacccctgccttgattaacggatgaatgaatttaattgtttcctaattcctatttgttactacgtataggagtgaatttcactttgagcactgatgtttttctttgtaccataatttaaccatttttttaaaaaaaattcgaacgagatagtcttatactccctccgtcccataatataggggattttggtagggatgtgatacatctgtactacgaatctggatagagagcctattcatagtactaagatatatcaaatcccaccaaaattttttatattataagacggaggatgtatttgtttgtactttataccaccctaactatttccttaagcatatgaatgactttgagtatacatgctcctacttgtaaataaactctcaaagtcacagttgtatgtactactcctttaatatatgataaattagatgtagataaaattgaagtgttaatattggtctaaaatgctacaaagataaaattatccgtttcaaagtgaaaatattgagtaaaaaatataaaaaaaaacatcgataataagtggcggacgtaggatttcaacgatggagctacagagttatagactacggactgtgtacgtaatactaaggaaactacttccttcgtttcacaatgtaagtcattctagcattttccacattcatattgatgttaacgaatctagatagatatatatgtctagatttattaacattaatatgaatgtagaaaatgctagaatgacttacattgtgaaacggaaggagtacttggtattccaatgcattttagaaagcttggtaacaaagactggaaggttattgaacaaagaattgagaaaaaaacttagtagttggaaaggtaagtatatgtctgttggtggtagattggtgttgattaattctgtacttttaagtttacctatgtttatgatttccttttttgagataccgaaaggggtgcttcaaaaaattaattattatagatctcgtttttttggcaaggagatgatcataagaaaaaatacatacttactaggtgggatatcatctgccagcccaaagatcagggtggtttagggttcataatttggaaatacaaataaatgtcttttgagcaaatggttgtttaagttaattaataaacaaggggtttggcaagacttattgaggaggaaatatcttcataataagtctattacccaagttgataagaagtaaggtgactctcatttttggtctagtctcatgaaagctaagggtactttcttagacatgggttcctggattgtgaataatggagaacaaactagattttgggaagataaatggttatgtaacttagcctttaaagataagtatccttctttatatgccattgtccgaaggaaaggtttttcaattgctagtgtttatgagatctgttcaacttaatgtttcttttaggagagcttcaattggtcagaatcttatttttgacatgagttgtgtacttctattgtacatatccagttgaaccattcttctgattgttttagatggaactttaatcagaatggaaggttcttggttaggtcaatgtatcttactttaattaataatggctatattgagataaataaaataatttggaagcttaagatgccgcttaagattaaaatcttcatatggtacttacttaaaggggttgtattaatcaaagacaatttagcaagacggaattggaatgggagtttaagatgttttttttatgaaaaatgagaatattcaacatcttttcatggattgccattatgcaaagtttatatggagagcaatgcagtattcttttggtctatgccctcctagtagtatatcacatattttttatggttggcttttgagggtggacaagaaaaagagtaagcttatacttgtgggagcctctgcaatatgttgggttctgtggttgagcaggaataatttggtttttgacaaatcaccatctattacatatatgcaggtaattttcagagcagaatattggttccggtgttgggctcagctacaaaggtgtgatgaagatggcgagttaatgaaggttgcatgccgtaggcttgagacgacagttatgtaactttttgccaattatggttggagattcacaaatagacttcgataacgtgttctccttatcttagatgggttttttttttattttaagtgcgtgttctcaatgttttgttgaactacactcattttcagtgttctccttatcttagatgggtttttttattttaagtgcgtgttctcaatgttttgttgaactacactctttttcagtgcaactttataataattaattgtagctcgttttgagtaaaggccgagatattctattttattagtaaaaaaaaagtggttcgaagtgaaattcacctaataaactccatcgactgcgtcgtaatccaaaacgaggtaataaaaaggtgactaaaatcaaatccgtttttcttcatatgctgataactttagcgatatctctgtcgtgttcggcgtacgagctgccgtgatgaccgatgaaattaatgtggttaatgtgtctaatacacatggcaggcatgcatgcagcttattgcctgcagcctcgcggtcaagtgtttgcacacgtgaaggtacatatgttatcacgacattgacgctaggctacagcacaggagtcaataccccaaaaacacacacatgaagaaacttgacaagcttttggtcacattaattaattagagcacagacaaaactgtctaatacagtgctcgatcgatcgtcacaggccatgaaacaatggagaagacacagtggtcaaattaatgaaatggaattccaattgtcccctggacatctagcttcagaatttttgcatcaggaagaacacaaattggcgatggatgaaccgaacagtttggcaaattgtttcttcagaggttggccgggttgagagctggaagatttgctctgcacaacagggacaggtaggctgatttatcgatctgacagtgactttgtttggctacgctaaacctaacctagcttagttcgattgcaacaagtattagcagtggtaaaattcagatttgtttccacgcataacctgacatatccggaagaactggtcagatatcgatccaagggcacgcagacaaatctttcgcttttatgattcatgaatgcgtttttgccctgcaagatcggccggggaaatccccccacggtgagaaatccaatcagattaccattgtgtttatttcgatcagggggcgacctgatggcgactcgattctttagacagttctgacgaaagttcagtaatcctcatctctaccactttctactaatttaaaagcgtagtcgttctcctttcgtctccttctcaccgtgctcggatgtcgtgtaactattgtaggatccaatactttcatcttagcctacccatccaatcaatctccaattatatttgtatatagcttgtgttttatctttaatccacccatccaaccaatctccactcatatagacttggactatgggtgaaatcggtcacggaaattcccgatcgaccgagtgccgtttccgtatatggtgtaccgtttctgaccgtaccgtttttggctatttttaaattttgttttttcacaattctttctgcatcgtattaatgtcaataccgagtagtttaaatgataaatatggtcaattaccggccgattgagcatcgtttccgaagagatgctaccgattccgatcgtttccgaccgttttaacccctaacttggacaaattttctaaggggaaaaagtccactttgactcccttaaaaataggccgaatctaattcatacccctcaacaagaaaaccggacaggaacactccccgaactattgaaaccagcgcaattttactccctgagcggttttggatggtggttttgctgatgtggagctgacgtggcagggttgaccgggtcttcatctcaggtggtgcttgcgtagcattacaatttacgaaagagtaaagttcatcaccggtctctaaacttgtaccgttgtgtcatcccggtccctaaactcgcaaatcgaccattcaggtcttcaaacttgtccgactgtgtcatcccggcccctaaacttgcagatcactcgtttaggtcctccaacttgttcagttgtgttaccccggtccctaaacaggacggtctaagaactttatataaaaaataattcataactttttcatgtgaactctaatgaagacaaactttatatcaaaattgtagcccttgacgcaacctataactttgtagttgaaaagtttttgaattaaaactgtttagggtcccaaaatattgttgcatgtttatagattttgaaattttaattttaaaattacattttgggacaaaaaatgacttaaaataaaaaaaaattcaactacaaagttgtagatcgcatcgagggctacaagtttaatataaagtttgtcttcattagatttcacatgaaaaagttatgaattatttttaaatataaagtctttagaccgtcatatttgacccagatgatattcaaatccaagtttagagaccggggtgacacaactaaacgatttggagaacttaaacgagtgatctgcaagtttagagatcgggatgacacagtcgaacaaatttaagggcctgaacggtcgatttgcgagtttagggacagggataacacagcggtacaagtttaaagaccggtgatgaactttactctttaagaaatatatgtgggacccattgtcatttacacacaaaatattgtgggccctactgacatatggtcgtcctctgtctccaactcttcttcctcctccctctctctctccctcttatctttctcatttcttttccccttcgaccgtggcggtagtgagcgggacgacgggtgttggagcggcggcgctggcaagcgggcgaaggctggagcagcagcggcgctggcgagcgggcgaatgctccagcggcgtggagaggggtgtcccttgtacagcctccctgcagctgaaatgagccgcgatgattgctcacgctgaaatgcacacgcaaactcccattctacgaatgcacgcgtccatctccttcgtgcctcaccgtgttgggcttgccgttgggcgttgggagtccacagagctggacgtgtcgttggcgaacgagcacgtccgcgccgacaacctgaggtgatgctccgggatgcgtacacgcacttggcggcggacagcgtgtcgtgctcttgggattttgggagctcttcatgagccgcgatgatgcgcacctcgtcgacgccgagggagacgagaggtcaacgatggagtcttttacctctatgccactaaaaatgttgttgcttatctgtgtgtcacaaaaaaatttggagtcacctatatgccatgaggctaactttcgttgacccgtgtgccattccgtccatcttctgttagaacttaacggttccatatatctgacatatgagacccatgtatgaaaatgactaatttgcccctgctctattttcagctctactctcattctctcttctcctgctctctccctgtttttgccgcacgccagccgcaccctaaccctagccgcacgccgctgccgccgcctggcctcgccgtagccatcgccgccgcctagcctcgccggcgccccatcggcccgtcgccccgtcgccccaggccggcacgccccgtcgccgcgcgcccaggctggcgcggccttgcgccctcgcccccaggccggcgccccctgcctccaagccgcctccaggccagctcccgccccccgtctaattttttccctattttttccaccattttctaatttatcccacattttccttttttttcctggatttttaaacatttttaaaacttattctcacttattctggtttttaacttttttaaaaatttattttccatttttttatttttaacgccttttctaaattatttttcacttttctgatttttaaaccattattgtacacaagggcaaaattgtctttacacagcccataacatctctgttatgtctccatccatctaaaatggtacacggatcaacgaaaattagactcatgatatacaagtaacttcaaatttttttctggcacacaggtaaacagcaatttttttaatagcatatgggtaaaagactctcaacgagggcggccgctgcctgctccagctcaagcgagattgtctcacccgcacgcacggccacgccgaggacagcagtgagttcaagtttcaaggactccacggcacgtaccacgtcgacttcgtcacgcccaccagcaagatctctcccgggagttcacgggacagcctccatgctcctcggctcctcgccgtgacgacggggtccccagcgcgtcagccgtggtcatgctaggcctcgacggcctgggcatcgaagtgctctacctcaagttactgcacgacgacgatggcttggggagttcgcggcggccgacgacgtgctctggcgcgggcccgggtgcgtgcaacaattctaggtggagtgcacggagcagtgtccgccacgtggccggtaccggtatgccgctgccgctccggctgaaggggaaaagaaaagagagagataagggagagagggaggaggaagaagggttagagagacagaggatgccatgtgggtccatatgttagtgtggcccataatatttttttaataataaatgggtcccacatatatattttaagttttaataccatatgggacaaagaccaggtcaaccctaccatgtgagcgccacgtcagcaaaaccaccatccaaaatcgctgagggagtcaagttgcactgatttcaatagttcggggagttttcctgtccggttttgttgttgaggggtacgaattagattcagcttatttttaagggagtcaaagtagactttttcctttctaaggcaagcaaaaatggcgagattgggttcctgtgggcctcagtaatgggccgtggcccactatcaggactaacgaggttggcccggccagcagatccccgcgtcgaatcccaggaatggacggccgagatctcatctcccacaagccctaaccctaacgaagtactagcagtattaacaagcggcgagcgctcgagctgggtgcgcgagcggttggcggcgacggccggcggccggcggcgaggtcgagcgaggaggcgggccggcgaggcgcgcggtactttgtgcctcgaaacgagtgggcctttattttttttttggttctgtttcggctcgtcgcggatttcgcacggtttgcttcgttcttggtgattttcttgaagcgtcgtcttctccaatcgatcgcttcctgtagcttctccacccttcttctgtggtggatacagatttgttcttggaagcggctgggatttcggttaacgatgccattggtttctattctaacatatgctttctcttgtctcttgtgtctcttgtgtgttcagattgggcttgttggtgtcggatttgattgtggtttcgtggctgtgatgacaatcaaacctcgtttctcgatgctgagacttgatttgttcaaggaccagaactgtgctgaccttaatttgtgcgtgtctgagccaccccaaacacaccatgtccgaatcgatttctgcgaaagttagtatgtctgcacgatgccactcgatgctactactagtatttaggtgtctttattagctttttcctcttctatgtttattggctgtttcttgcatttgcgttgttgtagtgtggctgtgaggactaactactttgtttctcgatgctgacttgattcaatcaatcaaggaccaaaaaaatttgatgacctttgtgcgtgtctgagccactgcaactcagttttttcagtcttcgcttgtgtgaagatatcatcttgccttccgtgttttgagcctgaacgataaagaagagatgtttcttggtgctgattcgactcattttaggatggaattttgacgaggctcatgcgtgtctgaagtctgaaccattgtaaaacttggatgtagttgttgttttaggtgtctgaagtctgaaccattgtaaaacttggacgtagttgttgttttttttcctaaaaaaagagaacttttttctctcgttttttctctgctgtatttgaatttgttcattttttccagctgttgtacacttgtacttcatattgggatactgaatgttaggtgcgatcaatgtagtagtgcttgcatgtttgacaaactcatggacattaactcaagttatctaaaacattgagatccttggaatagttatgctggaactattgcatggaaattttacaactcgctatatgctagaagcgaatccccgtagttcattttcctcaatcagcccagtagatttctagctaatggtatctgataaggggcaaattgttttttcaaggatacagctgaattcataagaactgaaaatcgcaattagctggtattacattgcagaagcttgagaacagaaagaagggaataacatgcatgggtaacgccaatactaaagctatcccatggtgagctcattaacgacttgatctccatttcctgaagattcacattgcatgatcctcgaggttcagtaaccaaccatatggccttgcttctggtttcatgattgaatcgtcaggatttttggagtttgtcaagatctcacctagaggtccaccttgaggcatctcccaagaacttgagatgctatcctcttgcatttgtgccatattaggtgcatggcagctgacgcgtgggtcctctggcgaggaatagaaagttgatggaactgtcatgacattggaatctttgcttttctgaaactccattttctcgtccttaggcaagctgaaattctgaaggactgactgaaggcatccacgatcatgcatcttggtgaaaggaatgcttttgttgttctgctggttgctgctctcccaaggcttcaacatggtatttgaagaaatcgattcactgtctcctgctgtattgaacttctccggtttgttctgttgcttcaactgagagaacagggacaatgttggctgttgattcgttaaatttagcagtgggccattgttttcttcagcagctttgtttcctttctctttgttcgccattgtcctgcaaatgtgtacaggtcttcaaattaaatgattattactttctattaaaactgaaataatctagttgttttcctttgtccctgactatattgcagcatttgtattccattctttataagagatttttttccaccagaaccacaacgattaccttctatcatgaaaatgtaccagaaaatcttaaaccatcaataggatatgcaaaaatggtggaaaaaaatactgtgattcagtctgtagcactaaaatacttgcacgttgagaatattaaaccaagtttaaggatgtattaacctgttcaaactatctgtccaatagctgatactgcgtggcttcatttcattaacttttgccttcttgaagctgccctgcccgacagaagatggcaatgagccagcacacggtgtctctttcacagtctttctactttggttttccacaggctttcttgaacggtggcggtttctgttgatgtgcctctcacaatacttgtggtcggccatggcctcctttgaacaccgccatttcttgccatctgttcgacggcatcttccaggttctgggtcagagtctgcatttgggaagccttgatagagaggcctccagctcactgcagtacaataagtatgtcatgtttccatttgatttacatatcacgttgccttttgtcataataaacctgaactggtgagaactgagaacgtaacattgatacagcttgtatgcagctcctttttgttaataacatgctcacttgtacactcagatttgcaatattcagtttgtgaaagcagtattctttacatacacctaactgacacacatattggtgtatgtaatgtatgtatgtaacttgatgatcgtacgtttcaagttgatgtaaaatactgcatttctattttgctcatttatacttaacatgtgtttcatgtatatgcagtaacataagtaaacagttttttttctgttctacccaggatatgaaaatgtgagttttcaggtttaaagcatcaagatatttgggtttgaatacatacttctgttagctgatgatctgaagcttttgctgattgaaatgagcaggctggaaggtataggggcctttgcattgagatacttgtaaatgagagcctggtgctccagctccatccactgtgagggagtgaaaggcctcttggtcctagacaacaagaacctctgctcattttccctcccaaaatccaaacctggataagtcaaggaaaaacattttagtgtggtcaataatatattcgaaagaatcaaaaaccttatcttgagatagatatggatatggttaaggcatgcaccggccagagtcaagacaaaagtgtaaagttaaaataaagcaatgaaatgaaacagccttaggtttgggaagggggccccagggtttgtgctcatccccatgactcgttctgtagcactcatgagagctcatcaagttcaataaatgtatcacttgatttatcttttctgactttttttccctctcatttgtgcaggtgaacagaaaaaaacactgtccatcatgagttgcagagaaatacacagatcaatggccttacatacatacatgcacacatgatctttgcttctaacctattgcaagttaataacatggaagtgtgtatgtatgtggtgatgagcaaggccagacctgatggcaatgtgtgagcagccttggcgaatctgagcatcttctgttcatcaagaaagggggaagggtatgatgcagcagcagcctgggtgaagctaccagcagcagctctcttgatgaggctcagatcaccctccttggtggatggcactgtgagtccttgcaagcccaacacctctccaagctccatggcagcagcagagaagtcagcaaacatcttggaaggacaggaggaggggagaggaggaagaagaagaagaggagggggtgagcattgctggggacagtcacagtgaggctgaggttgagagtgaggagggtgtagtgtgtgctttctagtaggaggcaggaagtgtgtggtgatatattatgggatggtggctctttgggagactagaggtagggctaggtggtggcccttaaatagcaggagtcctttcattcttttagtggagtaactttttttgctgtcatttctttattttatttttattttattgattttttgggctcaatgtttctgtgaagtgatactgctgggtactgatggggaggagtaattggttcataaaaaggtagtagtagcagcagcatgtttattctcttcttttctaattaaggtctggtttagttttccaactttttattcaaacttttaacttttctatcacattaaaactttcctacacacaaacttctaacttttccgtcacatcgttacaatttcaatcaaacttttaattttggtgtgaactaaacacactctaatatataaattttatcttggttttcattgggaagtttttcaaactgtttaatggtgtattgcttcaatatatcaaatagaatcatttttttattttatgataattgaaacttaattaaacgtacgctaatgattttctcattctgtgtggatacttaatctccatccttgtcgtactcccttcgtcctaaaaaaaagctaacctagtattaaatatgatgttttctattatctgtccagattcattgtactagaaaacatctcatccaatatttgttgtactaggaaatatctcattcaatattaggttggttttttgtgggacaaagggagtaggtttgaacacaagcctcaagatcaaaatgtgattgaaagcaatgtatgtactgttccacaaaagcggagggagattttgcggccaaattgattgggggcaattacgtgagctgtaggggcaaatcaataactacatggctgtacacatcgctcagaattaaccctctatgcagtactactactacacttccaataagtgcagtgacccttgtgttctcttgcaagtaaatatgctcgaaatgaatggtcgagcttcatgtgatggtcagaggctcttctctcttgctccctccctgaaggaattgtttagtttttatgtaggagtatttattgtgtttttttgaagtcacacacacttcagtgcttttgccatgtcccaggacagacaaatttgattattcaatttagcaatatctgtacttcgcgccaagaagaagctcaatataacgcagagtttcactgtgctctaaggtatactcctacgtcgcaaagaaactaaattcagtacaattttatttttttgtgaaccattatctgtgtgtataaaatagtgtgattccgtgttttttaccacaacaccaaggatggtaggacgtccaaccaaagcgctgtgctcaccacaacaccagcagtgagtgactagtgaggcagacaagtagcagcagagctagtacccctggcatcgacgcgattgagcctctcatcgttttcgtattaatttttcagtcgtaactaaattctgaattataaaaacttaaattttttagttatttcaacgtagttagtttttaaaccgttagtgacacgcacataaaagttctacccataaatttattccacagcgatagtgagtttgctcttttttataatgcttccgtcctaaaaaaacattaacttttagggataaatcaagataagcatttgtctaaaattcatcctctattttatttacttatattcagtttactttctccgtaccaaaataaataaacttagcacataacgtgatacattatagtactaaagaatttgaataaacatgtagccccattcttttcttcaactccaaactttaactttttcgtttttcgtttttcattagcatgcttttcaaactgttaaataatactttttttctcttaagaagatgagatcgaacatactctctccgtttcagattataagatgttttgactttggtcaaagtcaaatagctttaagtttgactaagcttataaacaaatatagtaatatttacattaccaaattaattttattaaattaataattaaatatatttttataataaatttatcttgagtcgaaaatattattattttttttctataaacttggtcaaacttaaaacagtttaactttgatcaaagtcaaaacatcttctaacccaaaacatagggagtattagatttttatttttaattttgagatggaggaaatatgtgtgttgttggatggggggtggactcagactctgcatcgccaagtacggtagggcgtaggcgagggggcgcccccggtgagacgcgaagaagctgatagtcggctggtggcgctgcgcgcggtcacgaggttgagatgacgcctttcattcattgccggcagccgcccgtggccgtcgtccgtcgcgcgccctcgcccgccttcattcatgcgcgtccaagcaacaagatactgagacaccgtgctaccaccaccactacaggctcacatcacagcaacatgctgctactggaggtacgtagtaccaagcacacacatctctgataggattttatactctctctctctctctctctctctctctctgtgtgttctacctgaggtgtggagtgagtgagtgagtgagtgagcagctggcaaatctggcatgcatcatgtgagtggaaacagggggggtttaattgggtccccgatccccacactcagatacgtaatctacgtgtacggggctgcattctcctcgctccaatgggtgtacgtccgtgcttgatgatgttactcatcgggggaccaacaactgaagaaaagctcactacagattttacaggccaaactatcgtgccggaaattgtgtgcgccggtattttgaactacagttacgttaaaggagtaaaatttcagaaaactacggatctagttgatattattctacctgtgtactataataattgtatttttagaatttgaattaatttgttctaaaaaatagttgtcaca

SEQ ID NO: 31208 - DNA, 562 bp, Oryza sativa
acagatggaggcctgagacacacagcttccacctccccagtggtgagatgaccatcactctacaggatgtggctatgatcttggccctcccattacgggggcatgccgtgacgggcaggacagagactcctggatggcgtgcacaagtggagcagctgtttggcattacactgaacattgagcaggggcaaggggggaagaagaagcagaatggaatacccctgtcttggctgagtcagaacttctcacatcttcacgacgacgctgagccatggcgtgttgagtgttatgcccgtgcatacatcttgcacttgttgggaggggttctgtttcctaatgctgggggtgacattgcttcggcgatatggattcctttggtcgccaaccttggtgatctaggccgttttagttggggctcagcagtgttggcgtggacatatagacagctctgtgaggcctgttgtcgtcaggcaccatcatccaacatgagtggttgtgtgctattgattcagctgtggatgtggttaagactaccgggtggaaggcctaagtagaggcaaag

SEQ ID NO: 31209 - DNA, 506 bp, Oryza sativa
agttctctctactgaaagcgtgagaagatatatgttagggtctagggtgcaaatggaaataactttgacaaatgcaagaaaacttacgactctgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctgtcgttccttccagctgtcatctattcatcaatatatctattatgctctagcccccagtctttcaccttctttgttctcaccctgtcatacctagacaagtagaaggtgatgaaacatagtgagcatcgacaagggtttaaatggtacaaaattgaacattgacaatgaaagcaaacaaagataagaaatatttacttgtgtaattcaactccag

SEQ ID NO: 31210 - DNA, 5467 bp, Oryza sativa
  unsure (1)..(5467): unsure at all n locations
accgagaaattgcactataatcctgccctgtccatgggatgaacagggaatttgggtctcccagatgatacctagagattatttattcccacactgcatcataacagtactaggatctgcttgttttttatcgttagtccaatcagttgataagcactgatgtactgttagaggactgcctgaagcctctagctgagtggtagggcatatggttgcaaacatgtgatggttgtggatgtgtggttaactggttattctcaactcttttgagaaaaatatctcactaacaattggattgcaaaggtttttacataggaaaatacatccaggattggctagtgaggaactgagcctagctcagttggtcgatggtgtggatgtacgcctagaccacccaattccgattccttgttgaggcaaatttgggtgccaattttcttgttagtacaatgttccctagttcctgctaggttgatccctagttttgttaaagattagcaggtacggtcttggacacttgtcagttagacattatgttttttacttccagtatgcagaatctttgtagctttctagagcacaagatctttgtttaatcagataaatcgggactacaataagaacttggtacagccatttagaagttctgtgcactattttgacctaggtcatttgtgcatattgcttatggcctgtccccttgaacattcatatccttcagtatcagcgcctctcctgacttggcatgctagaaaactctcaatacttctgctaagttcttgtgcacaatctttgtattttgtagtgcttttgctcaccacgccctttgcaaatgtaattccttttttggtggttagtttgaatagatggcactcaaatttttaattcatgtgatagatgccgtcgcataactaaaatgtatatctgctaacagaccaaattaatagtgtaggtttgttgctccatgatactttgtccaatatatgaaaagagaattattgattgatcatagtcatagatatttgaatgaacacatttgatgtatctttatgttttccctgtttgtagtgataacttttgtcccatatctggaaagggattttttttcagatctttgaatcaatacgtttgttgcatcttcatatatttcccctgtttctagtggtaattttgttttttttttggcagactggtgcaaagaaggcttataagaaatttaaacatttcaagggcaccacagttgatcagagatgcggaccaattacatatagatgtggtctttgtggagcttcatcaaagtcgttcgagttgctgcctgttgaacctgagcaagagatgaaaaaacatgatgtgaaagattcagagttgagcttacctgataaggtcaaactggcaataaaattggttatttactgttctgaataaattagcctaaaacaataattttttttgggagatgaatgcaggattgtggtgctgcttttgtatttttcaaaactcggtatgcagccctggtcgtatcagaaattgttcagacatccaatcctatggaatgggttactagtcttgctccagatcgagatgacgtatattggtcaaatctttggttaccctacaagcagctttggattcgccgtatagttacactttcgggttctattgtttttatgttcctgtttctcatacctgtgacatttatacaaggtctaactcagtggagcagctgcagcaaaggctccctttcctaaatggcatattaaaaaagtaagtaatctaaacgctcaatgcctacctactgcttctttgctaggtgtcataaagaaaaaaaaaagattgattttcgcatcgagcatgtcagagattacttggatgtgtttatgtaccctaactattaccttatttgattggagagatatggctatgtgaaagtacatttttacatcatatatatgtgataattatgtcattttttacctttccatgtgaaatctggaagtccagggttgggaggtagacttgctgtcattaccgatttcttctccattagcagtttattatagtaacatatacatttttctagatctactatttggtgctcagggcgtcccctgtctgtttacagtcacaagtcacaggggacgcatttactactttgggggatgcttctactgtcgctgaatatttactactttgggggatggatttacattctcaggggtgggtcactgttagttcccttgatgctagttagcacttccatgtatctttgtttgtgttgccatgcaacattcaatctgttttttaggctttaaagttgaggtaacattataattattgcacgcacagtattatcttctggcatgttattttattcctttattcatttgtagaggaacataaaaatgtctatttctcttgcaggaagtacataacccagctagtgaccggataccttcccagtgtcatcttgcaaatatttttatacactgttcccccaaccatgatgtttttttctacattagaaggacccgtgtcccacagtgaaaggaagagaagtgcctgctgtaaagtattatacttcactatttggaatgtattctttgtgaatgtcctatcaggttctgcaattagccaagtgaatgcgttatcaagcccaaaggacattcctatggtgcttgctagagcggtacctgtacaggtgaattgcatgctcacttattttggctatcaggatgcagcaagtatttctgttacgcatatacaacttgttgatttgttaatagtgttgttcaattttactataattttttaatactgtttttatttgtctcaggctacattctttaccacctatgtactgacttctggttgggctagtttatcatcagaacttatgcaactctttggtctcacatggaactttataatgaagtatgttttgagaatgaaagaggatagctactttgtcccgtcatttccctatcatactgaagtgccaaaagttctgttgtttggactactgggattcacatgctctgtattagcacctctcatcttgccctttttactggtgtacttttttcttggttatgttgtgtaccgcaaccaggtgagaaactagagattaaattttgattccaaatcaataaattatctgtgattatgaattttgttgaaccttagttatagtgaagatgaccagactaactaattatgggaagttggtatgagtgcttatgcatttgtactttttaggtgaaaatgcaactgatgcattttacatatacatgcttctaattttgtgtaaattgttgtttcctggttcatgaatgtaaattctcagagtgcaaagttttgtgaaagattggtctgttgtgcttcttttccccgttcctgcaatctttttttgacgtaaccgttcctacaatctaatgggttaactttttttcatttgcagttcctcaatgtttattgcacgaaatacgacacaggtggtctgtattggccgattgctcactatacaacaatcttctctattgtgctcacccagatcatctgtcttggtgtctttgggcttaaagaatccccagtagctgcaggcttcactgtacctctcatcatcctcactcttttattcaaccagtattgcagcaatcgtcttcggccattattcaagactctccctgcacaggttagtatgaattcacctttatatattcttggagggatttacgctaaacttcttgccagtttacatttatgtgctctctactgagagtacatatcttgcacttctcttctgcaaatgccaaaaagtcctatgtcgaagcattatccctggctacctgaaatgaaatctcttacattagttctctctttctattacataggatttaattgacatggacagggaggacgagcaatcgggaagaatggatgacattcaccaccgtcttcattctgcttactgccagtttgctgacactgacgacatacctctgaaaggagttcacgttgacagagatgcagatgcaagcggaagttccggtgaatctagctgcaaagaagacaccaaccaacccacaaccagtgacatttctcaccctacactggaaggactccctgtaaaccggctacggcatgcagtgaggtcgctcagttccatcatcaggttacagaagagaggcctgtcaccacagcccgctggaccctccgccgatgtaaatccgcaaactgcataagttttgcagataggacatacatacagtgaccaaagaagcatacaaatgaatatacaaaaaaaaaaggcatagagatgcatataaaagaaaagaagcatagaaatgaaagagagcgccatctgtcctagttgctagggtaaaattttgtttgttttaagttttaactagtgcctgagcaacttgtgtcagatccttttggccatacaaaagttctgattcttcaattgattggtgatacttttggtcatatactactactgtcttccacaacctggtgatgcagttatctggtttcttttaaaatttattaaaccagtttcttgcgcttctgtttgctggggggcatatgatgtttcagagttcagacatacggggaagctttgaatacggtgtaaaccaactggaaaaaaggcacagaaattttcacatggttttgagtactcctgaaatccatttataacggaatagaatggagcatacaattcacagggactaatcacgcaagtggttaaacgaacaaaagatttttccattaattgaaacccgatactactacacaagcacaaatcgcagacgacgacgacggcgagcggatgtttattcggtggcggcgaaagtcacatgatggcgcagaggctggacgacggggcctcgccggcggcgtcggtggcggcggcggcggccttgtcggcgacgcccggccaggcgcggcaggcgcagtgctggccgtcggcgatctggctgtgcacggacgccacgtggcggccgcacccggcccacgtggacttgccgcacgtcccgcacttcacctggtagcacatgctcgctcgctcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcag

SEQ ID NO: 31211 - DNA, 163 bp, Oryza sativa
atcgacatgctggtataatgaatgccatgacaactcctgttccaggattgccaccggttcaccaccgatggtgcatgaggcacttcagtgctaatttccacaaggccggtgcggacaagcaccagacaaaagagctcctaaggatatgtcagattgacgagaa

SEQ ID NO: 31212 - DNA, 463 bp, Oryza sativa
ctatcgtcgaacactgggggggcatgagcactgactgggaacggttgaagtacctgcattagcaattgtaaatcaattagttaatataatgtcaaatacacgctaccgatacttatgcacaagtgaatcaatgccgattcataccctccccgcctcgatcgcagccccgcgatgacgggccgtcgtagtacgcctccaaggctgggtaagtcggcggttgtctctcctcggccatcctacatgaaaaagtaataaattcaccgttagttaccaatgtgacatatattaacagaaaatgatgcgagaacatgagtacgaaaacaaaatatttacctccctagcacttatattttttttggacttcttatttttggacgcttaagacacttagttttcttgtgaccctcctagtgacacaacgagcatctattttgcaccggcgcagcatcaagttgaacgcatg

SEQ ID NO: 31213 - DNA, 1452 bp, Oryza sativa
tctgcttaatggcttccagcaaagtgggcaaacggacatacgcttcactccattcaccgtaaatgagcttcatagcctcctctcgtgccctccaaaccttgccatacttcaccctatactggaaaacttcaaatatatacaaagctaacgcagaagcagagagtgtaggttgtagttttatggcattgcataacctatttgctatgaactttgatgtcagctgccggtggctccctgaaccttcggcagtagcacaactatgttctttacctacccgtgatatcctccacgtgccactagacctcttagttgcatggaccttccatttgcaccgtgggttttcacatttaacagtgtacctcttatttgcggcagaattgacaacacggtatggacgatggtgcacgatggcgtactcctgaagccatagcttcaatgcgaccatggatgggaactctaaaccctttctgagaccatccacttggaatggttctggcaactgatctcggttgatgccgccatctagtagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtccacatcatctctattgacttctactgagacagaatcgtgaccaccactcaattcgacatcaaagtaatcatctggattcacatattggcctgctacttctgtcgggtattcagggttgactccgtacgacgaccaatgaacactcaccgacaaatgttcacttagatcaagcccctcttgtactaactcccttttcatctccctcgctgcatccacatcatcactaccgcaatgtctctttgatggtcctgcctcccataaatcatttccaagcaaaggtctcttcttctctccttccccctccaagtcttcccgtaccaactcagtcttacttgtaccccctccacgacgagaataatatgtcacaaaattcttctcaacgtaatgataagaaggagatttgtttagatccaaattttttacggtacgaactaactttgatgcaaacacctctagagatctaaactgagactcttttaccaaatcaaagtaaacttcccattccaactgactatcacatttaatatatacttatgcccttgaccaacattggatctccaataaaaacgaatctccacattatcttggtccatccaaagaattttttcactggtgaccttagttcatataagagtggggggggtagaaacaaacatgccgttcaatgacatatcctcaaactcaacatgtgcaccaacataaggttccaccactctaccaccgtagggctgcaggaa

SEQ ID NO: 31214 - DNA, 9120 bp, Oryza sativa
ttacggactgaagataaatacataagatgttgtatttaacatttgaactcttaaagttcgaacataatcatgtaagagaggctccatagctcaccatcttgatctctcttgcatatttccaattgtaaatgtctccaatgatgctgaaggaatccgtacatggagcatatcttgtccaaaataattcagtggaagaactccaagtacacaaaggaaagcggctaaggagaatatgcgtatgctattgaaaagaaaaacacataagcatatcttggatataaaaccaaaattgaagacttaagtaatatagtgagaatgcagtaggcaaatgaatacatataaagtaataactttatgtggcataccatgtgagaccccgatgaatgttggtatgcacattatcaactttggcataagattttttattatcattaacttttttgaagttatttgattcccatattattttgtgtttttttttacctatcctatttgacagaggaaatgactcatcataccagtcaacaattagagattaaaaaccactagtttaaataatcgtatttagcttgattttcattttcaaagcgccacggcgaaccttttaagtgaaagtataagttgattcctgatggtctaaactctcaaggcacacaaagaaacagcataaaaagaaacatctatataaacttcaaataagataaaaaatattaaagtggaacagagaatcaagtaattgtgtacatacctaaatacaagaatcctattgaagacaactgcatccaacccagcagtagctaagagttcatcctccgtgcatcgaagacttctcaaaatccagctagcggatggaacaaatctctccaaaataaaagcctccctgagcctactattctcctcagcaatccttcttccaaaatagaccttaacattttgcggttgcttcctcagaacggaatacagtgacaaaaaaagtatacagaggctaatgttgattccagctgaggtcaaaagagcgccgactttcatctctgtcttatgtcatctaaatgcaacaaacttcgtatctcctttaattctgcaggaaaagattggaagttcaggtttgacatacaagaaatcatgagaagagcatgcacgctaaaaaaacagcactgcaagccatcctttggatttcttcaaggttacaaaatgtatgatgcagaagcatatttgaggcagctaactaaagagtagcatgggctattttaaggagataaaaccctaataccttaataagacatggaatacacttaagcatgccatcaagagaaaaaacttcaaaaatcttggaacaggcatcacgcagggacagattttgatttgtaccagaacaataagccagactaaaatcaggacacccgtatactaatgtgaatagttcacaactcagacctggtccagactcaaataaaatacaaacaaatatatttcatatggttaaccgcttactctaccaggaaaaatgttctgtccttattcaaactggtttatctttgtccctaaaatggcagtataagaatgttaatgaagacggtgagtagaattttcatgcatggaagcagagcaaccacacctaaatgcagatcaagcgaattacgatattctgtcttctttagattagaataaaatatatccaggaatcaggagaagtgtgctgccaggttggttagggagaagaactttggtgtgaaattatgtttaaatgaggctcaatgtgatgaaatttgaattatgaactactgtctattcaataccaagttgttatctgattaatcattcataaacttttctatcaaggtaaagcaatgaagtagaacttgttcagttttttttcctggcagaaaaacagtggtatgaaggttctgaaaggctagtaagtgggtattcgtacgctacagatcacccactttctccttaataccattaacatggaagtccttcctttcatatccagctttttacaggtcagccacttcgtagcaattatacaagcctaaaagaccgcttatgaggcccaattagctactactccttgaatatgccctaattagcaattattggtaacaggttgggcaccctttccttgtatacagccttgtagaccttcctttagaaaaccaaatggacccactaaaaattgaaatgagggcctggaagcaaattagttcaagtagccctgcaggctgatctcctatgtctcagattgttgcattaatattgacgagctatgaaattcattgtcctttcgtttctattgtccttttttttccttccattattttaaagataacgcggaactcacctcacctttcaaatacaccaagtagatctaaaagaagctattgagccaaggcaaggaggatttgttctcagtatacagccagagcaaatgtaagtggctaataaacaaagcactcagatacgatttgcaaagaaagatggctggaaaggcatgagaaagtacaaaatggaatatctgacagatctcatgggaggcatgaagaatcttaaagagagagaaaagaattttgtcagtatggtacaaagacaagaactaatctcgattccactacccacaaaggacgttttacactttggaaggccggtaaccgtttcagaattcatattattctctcagcatcaaaaggctgcttttgtcctcctctttttaactaaagataaagaacaatccatcaactgtcagagtttaataataagccttctagttcactcaaagtaaaggcaacaatatcctgcaggcatttcatttatccgctgtcttaaacgctaggattagagcagccaatcttaagaactcatacatcccccaaatgcatcggaaattcaaaaactaaacacggttgtcgcaatctcccaccggcccctggtgaatctactgggcaatacaacaacactacgccgtcagattccagatagatgaacacaaagccgcctcctactcacaaaagagacagaaaacttgcccgtcgcgacgcgcgccgaaaaaatcccaccaatgccccccggccgcgcctcctcaaaacccctgcaccacttacaaacaccgaaaaaatagattcagatcacacgcgcacgcacacaaaaggagactagaacaaatccgcgaggcgatcggagggcaaaaaccacctccacttcgccagtcgaccaccgccgccgccgacgcgcgatcgggattcgccgggggggatcggagagatttcgagaaagcaatgtgtggtgggagatttgcgatttggtggggggtttgggttggaagtttcgatcacaaggaagaagaagaggaagaagaaggaaggcagagagacgaaaagggaaagcgacgagaagagtgggagaggagagggagagtagcagtgggagctagaggagttgtcaaatttgtcaaaagaaaaatattcccaaaaataaataattcgaagtgggaggaggccggtggggtgggcccactgcggattggggtgggtgccacgtggcggaacagcagtggtcgagttgagtcggggacccaccggatgcaggggcatatcctcgtgccacgctgtatgtgcgggagttaatttgacaagatttagtagttactccatcatcatggtccttgttaaaactccatcatcatctttgctttgctcctttgctcaactaggaaacggtgaatatccaaaaagtttatttacatatacacagcatattagcatgtacaaactcaaatatatggtactggtattcagtagggagggaataaatgttcttgtggaaattatatcatgccacattagtaggtggtgtttgaatctcctgaacataaataataatatgtgattaattgttttaattattacaaacctgaaaaatggattaatctgatattttagaacaactttcatataaaaagttttcgcacgaaacgcatcgtttagcagtttgaaaagcgtgccactttaattcaaaatttaatacactcttttaagtggattcgaacgcagccatagtttaggtgactctaaggaggtgaaaaatattgatagaacaagaaaaaattacatgatcacaatggagaatcactcactcggattaggtgtttggctaaaaacattagctctagatcctaatgagaggacttgaagataatattacccctttatgtactaagaagtcctgagattaatatagatatcttctaggttaatgtaatactaatatttaggctacaattagcagctgagaattgagagaagatttctctcgttcttcacgtgcacgcttcccaaactactaagcgctatatttttttgcaaaaattctatagaaatgttattttaaaaattatattaatcaatttttcaaatttaaatagttaatgctcagagcctcatcgattcccctaataagcctaggccaaagccaaaatttgacttttcaaaattaagttgatttaaaaatatttttaacgtatctttttcacccttggcttttaagtcgctaaaaacatgtatataaaagttttatttataaattaaatttttgttccctaataagtgttttggctatggtaaccgatgagggcctcaattaatcatgcgttaatggatcaccttgttttatgtattttctcaatcttctcttttcctcttctctcaaatgcggccttagtatacttacaaatgtgtgcaaatattccaatacaattactacacatgtcccatattaagtttatttttggtcctcatcatttttcttaaaataagtattttaataatcgttgcatcggagtttgtgaaagtagaaaataattacattgggagtagattgtaacatcctcaaattttaaactaaaatttgactgcatcatgctggctttcgattaaattagtgtgttttaaaaatctatttgattcttaattggttcaagtattacttccttggaaccctattaatttaccctaattatttcctttattccaaaccctagtgaatttgagcaaattctctcaaatttcaaactatagattatttccttagtttatcttaatattaatgaggatttgctatacttcaaaccctagtgaaacccttccaaattcatagaacaaattcaatcctttctaggaaaatattcaaaattcttgaatttcactgttcattgccttcaagatgttcagcagaatgcctagcccaactaactcagcccaatccctatccaatcttgcacaaagtctagaattgatcctaggggaccacaccccactcaaaaccgtggctttctttacttcttcctccccttcacacgcgccgctcggacatccgacttagccgcgcgccgtgccgccgcgcgtcggtctcgggatcgatcgcgcgtgcccgatcgccttggcgcgccgctagccgttcgacgccctcagaccatcgccgccgcaccaatcacggcgacaacaaaaccgggatgacaaccgccacaaggaatcgccgctcgacgtcgtgcgctcccgtccaagccgctgccgagtgcgatttcgcttctacccagagtgaatcgcgccaattcttgccgcacggttggatgaaagttagacggtggtttcccctctcccaattcaaaccattaacccccaagccggccgttttaaccctcgccgccgccgcgcgtcgcgcccggattggcgccaacacatcgccagccatttctacacacggtcaagccgatccttcgctggtaagtattcaaacatggcctcccgccactcaaattgatcttggccaccctctcacagcctctgccgccccaaccatatccaaagatcgagctcatccatggcgatgatggtgcccgagctcatccgctcctcctagccctataaataggaccccaatcccttccttgtccatcatcgatcatcaacaaccatagccccacaaccccgaagctctgcttcgccaacccattccatcaaccaccatcgcccgtcggtcgaacaccttgtgcgcgatcgactccacacccctccatccatcttccaccctaaataatccttagaacaccttatatcaaccatgttctagcataatagaccctaaccgaagccctgcgtcgagttttacctcgccgcaccaagccgagcaccgccgccccgcgctgctctgttcttcaccgctgagaagtttttccggccgcaatccttcgtttcaaccgatctcggtgagttcttccattttaaccatctacatactccctagattccattttagcaatcactttgcactatcatgtcgccctctgggttgccgacgtgagcacggccgccgcctatggaggcgctcgtcggcaactaccctccgagccttgccaaaggttggcaagctgccgaaatccatctaggtacctcgtagatgctctaggagccctcccctagccatgtctaactcgtaccatcccaatcgccttcacggcctaaccgtgctgccgccgccctagccgctaggccatccacatatcaaattaacccctccgtcgtcactcgccatcgccggagaaccctagctccctcccctcctcagccgcaaccactttccctctccatcgccacagcaatcgccaaccctagcatcgccggcccgatttggggatcggctggaggtagaagaagagaagagaaagagagactgacaggtggggcccgcacacagtaccatttcacatttatttgattttcaaactttagaagcccatatcttttaaaatataaacccaatttcagtgaaacttggaccaatattcttctaaaatcattctctatattttgagcccctttttgctatttttgcattttatttcattttctccatttttcttatttttttggattttatttgaatcccttttgaatttgaattttatatgtctaaccctaggtcttgaagattcttctgacacactagataatatcaatcaatctcaggacatcgagcaaggcaagttaccatataccttttgatcatttaaacctatattttacaaattagttatttataacctcctattcaatattctattttctatgcataaatcaattatagaaacccagataatttagtattgcttactttgcttacaatttggttaaaataccttatacttagattgggacagtacgtaagatttggatgatttccgggtggctagtactgtctcgatcgatataagttttaccaggtacttatgtcgaacaaacgagtacgaccacagtttctaaaatggggacagacttagttattatgttaattagcaatatggcacctctgtatagtggttcttatttttaagttaagtcctcgtgcaggaggcaactatagccgcgaagggcaactttaaccattaccatgtacaggtaaatgatttgtgatactcgagtataaactatatggtatatttctaaaccctgatcgagatgacgtggtgtcatacgatcagttcccccttaaatacctcgggaacgccagaactcatcttgctgctgttaacaatacgttcagagcatatgaggatataagttcatggaacaggtgccataattgttaatgacttaatactgggccatgactaaagccgatgattatcaacaagtcgtggactgcgggtaaagcgtacatctactgcagtagaatatctttgaaactattcgaatagccgtactcatggagttgagtactgggattcatatggtaccctggttagaaatctaaagtctatatgttttataaattcttgctataactcttccagattatttattactgctttttgcgaagaaccctactctatgctaatgcataacatatttccatgataacttgcttagtattatgaatactcatccttgctcttataacccctttttcagatctgggtcaagaggagcacccttatgactattactatgatgaccccgattacttagagaatccataaaggttatacctccctagtcagaatgtatagaaacttccgctgtgtattaattattaattaattagttaggtgagtacctattattgtaaaacccttagtattgtaaaactttaacgtatgcaatgaagaaccagttatattgtatgtatcaatatttactgatccaaggattgatacattatcttagtcgggtctaagttgttagttccgggctccgacatagataaagtgagtaatagtaacattgagattggataaagtagaggtattctagtcttctggtatttgtattggtatgtgtgcgatggatgaaaataaacttattttgagacagaggcgatacttgtgaaaaataagtgtggtaagctagttagctgctcccttcatcccaaaatataagtatttttagctatgaatctgaataactgttgttacattttaggatggaggtagtagtcaaggaatggccttgcatttatacctgagcacaaaaggtctgacgtatacatggagttgatatatggtttgtaataggcaaattggacgcctcattgaagagaatggtgcgttggaccatagaacaacgtatggggcggatccagcgttatatgagtggtttcagctgacaccagtaacatttgccgtaacccatgtaccccttttattctaacattgctgatcaatcagccatgtgttttaacaccaaccatcagctaaaatcagcgtttgcttttgcttagcccgtcaactttcttgctcagcccgtggcgaacgtggcatcggcagtttatcccttcccctaaccatggcaaattcactaattcctccatctaatttccgtagcaattttgttcttgtctacctgttttttgtttttttagataatgttcttgtctacctgttaaggtcacccaattaatttcatgagaaacacctagatgtcttcgcggatttaaaaaaaaataatagtgagagctgaataaactacatcagtataaatcgaacctacagtccccacatcttttgaatctatggaaaaaaaattagtgagagcttagggggtctccactgtcccaggggtggtagtgggg

SEQ ID NO: 31215 - DNA, 3800 bp, Oryza sativa
ccccccccccccggcccccattgtgaatccgctccgggtcttctggctagctagcttcacaaggtggtgggctagacgaactgggttcgaagcctcaccccttctaactatttgatattatgtcctttcctaatatttatgttttttttcacccaattaatttccttaatctctcatgatcacttaagtttagggcttttgaaatctagaggttttcactttgcatggctggtcttctttggttatgaaacggttggtcactggcgtcacatatttataacatagggggctttgtttgttccacgatgatatttactcatgctgatcttactctagtgttttgcaatttaattttaacaattagacaattaggataaatatatatgatcaaacgatcctgaaaagagaattgttagaaaattacctacatgtgcattaaactctagcgcctacggatattgtgcacgtacgtggatttttatttcccacgggatttcagtgagatcgggatatatcgttggttttcgtctctttgagtgtgtatgtcacggatgtattattcgtgggtgtgggagtgtggtgttatgtgaatagtgatgcatgtccatttacagtataataaacaaaattaatacatattattaatctgctagaaactatgtacgttgtgaccatcaacccctgtcattatcgatctgcaacaaattgccagtacaattgacctatttcttgtgctatcattttcatatagctttcaagagaggaaaaatgaagacagtatacggttcaatgtcaaaatcgtggtagtttatgatgatctattttttcaatgcctccatcgcctctttctcgcgagcaattgtttaactaaccatttataaaaatacggcctagaaaaggttgaaaagtcagaatatgtctcctttcttgtcattcatataggtcattcctctgaaaatcatccacattttttccatggcatacttaattgtgcagagcactaacttaattgggcttaaaagcattgcgtatattctatttacgaaccttttgctacttgacatttataaatttataaatttatgcaccagatgtcaaaagcaatcttttaacaaaagctgcttccaatactatttcaaatcatattaaattgctagtcttctaaagaagtacataccagaacattgcaattcattaattatatctataacgtcggtggatacgtaattatttattccttctatataagttgaaattcattcagcctcatcttttcgcttatgcttatacttatcagctaaaatttaaattttcaaccttaaatttagagttgattttgatatttttcatcggagtttatttttcagcctttgcttttagatcgttaagaacacacatatataaaagttttattcacaaattatttttcatttgcaaatataccgtttcgcttattccactgataagcaaaacgatgagaaccaaaggcttataaagcagaacacacaaatatcaccactcactattaattacttctattattataaaacatattaaaacttttttaaacctaaggcggaactttgttccacttttatatttagaagaagagaattgacccagtttataaggaaaaccagaaccgaaaaccaacaactgcacggttaattacaggaaaaccggctgaaacccactgctacataactaacaatagcggcggagcccaatcgcaggacgtcgccgccaagctaaacacaaaagcaacacaattgctcccacatcgcagaagaggtgttatcattgccgagctagccgcctaagcgacccagcagcgccaacttcacaaccgaagcgacactgaagacgaaagtcgccaaagcgaaaagcggatctgacatccaacaatggacatcagccaagccaccgaggagccacttccttcacacggccaacaccagaactccatggaagagactgcaacatgtcatcgttcccaagcgtcgccgcacccccatcagcgagaagcttcgactcatcagcagaaacaaccgaagagcgtgtcgcccaccacaagaatgaagcggaccccaagaaggtgcagcctctccgaacacaaggtatgaaagattttgaaccgaaaaggaccatcaacagtcatcgatgcgttggaacttctccgaagcgacacccccaaggaggacacgacgcgtaacgccgccgccgcttgtccgtaaatcgtaacgaggttttcacctggagatttgtggggatatgaaagaacgccatgacaacgcctccaaggagggaaacgacgcccacgggcgctgtcgttgtcgaaccggccaaaagcacggcaaggctttcgttagcatcttcacatcacccacataagcaccctcacatcgatggccacagaatagtccataacgtctcacaagcagtcataccttgatcgtaaccaaaggcaaagatgggcccttggccaccctcatgccatccatccgccgcaaacttctatagcaagctagagcctccgccctcccccctagcattccccatgaccagaaaggggtccagccaaagaaggggggaaactgaaaggatggagaacactcggccgacaacgaggaagtcatcgtcgtggacgtcaagccccattcctgcttcacgccagcacaagccgtcatcccgccaactccacgtccgcacatcgccgcccatgagtcacgagacccaccacgggcagaagatgccccctgccgaacaggaggctggccaccagtgagccaccgccacgctcgccggagcccaccgagccgtgcaacgcccacacatagctgccccgccgaccggctgccatctggcatggaggcaacggatccggctgcagacggccagatccagccaggctcgggggcgacgaccagctagggcgcgccgccgcaacatccatcgtccaccatcaccaaagccgaagccgacaccgacgccggcgccgtgaccacggcgcgagcgagccgccgctgccgtcgcccgcccaccgtgacactgcccctgcctgccgccggtcttcgcgctgccccggcgccgacctctcccccgccgccagccgccacctcttccccgtcgcctgccatctcccttccccgcctccttgggtgtcgccgtcgtcctgggagggggacggactgtcacaccatgaagttcttttcccaagcctaaattgaatttataaatcacctcgagaaaataccggtgaaaaagcaagagagaaaccctaaaggaatcaatgcaaataataatcggaattggcatgtggaatttttcttgagttctatatgtcgaaatatgctaacaagatttttagtggaattttcagagctctagaaataattttaaccaattaaaaatgagctcaagcattatttaatccttggaaattcttttcctttttttctttttccttttcctccctttttcccaaatgggctgtcggcccatttcctccccctcccgcgcccttgctgggccagccgaaggccacggcccaaccgctcgcccgagccccccctctctctccctcaggcgctgacaggtagggcccacctgtcagtcctttccccaacctccagccggtggccccgggccggcaaccgccgccgcgcgcacgccgcctgcacccgccttccccgcaccacgtcggccacgcccgcgcgtgcgtccgcccctcccgcacccctcaaccccctctcccgctcgcccgcgctcccgaggtggccgggattcgattttcgaatccc

SEQ ID NO: 31216 - DNA, 4512 bp, Oryza sativa
cgctcccgcaccgtgcacccacccgccgccgcaccgcgccgccgccgccgttgggttcgcgcggccgaggtccacctcgtccacccctcctccatcgaggttcgccgccggagccccatccccgtcgtgcgccggtatgagacgccatggccaccgccttcggccggcgttcccgccctctatggtctctctctctccctctctaatcttccccatttcgttccttaggtcgtctcggaccccgtccgctgcttgtcgacctccctccatcgttcctcgtcgccggtcgccatcgtctccctccacgccggtcggaccccttcggtgaggacgcccctccttccccttccttcttcctcctctcttttccttggtagcgccgccgcttagccgtcgtcgcgccgtcgccgtttgccgaatcgtcgccgccgtccgccggtcaccaccggtgccgcgccgccgccgcgccatggtcccgggtcggcttgagccgaccgcgcgcgctggccgcgagctccccgccgccgtccgatctacccgagggtagatcggggccgtcggtccggctgcccgcgtggctgccacgtggccgctgcgtgtgcgccgcgtcggcgccatgtgtgcaccacatggtgcgccgctcctccccggtccgtagacccggtccaccatggaccaccctccctgagtcactgccatgcggggcccgcatgtcggcgccgccctctctctccccgggattttaattattgcgcaataaatcaattaagtatttttctgtttatagtaaaaacacagtgaatcttctaaaattcatatctaattcatccgtgctccgtttaagcccattcaagactcagtaaatcaaaagaaatgcatagaatctattaaaaatggttttgtcctctgtttcagtagtcttatagcctgtttgtattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatgccctaccgttttcctttaaatactgcatcattttataatgtcactatgggatgtttacctactgttacagccatactatttttgtaccatgctcctttgttagcttggggatataacatgactagatattggactagggattgcttagtcatgcttggttcaactagcacacagtgggggaaatacattaatgcatagatatcagattctagtaatgatattggttaatgccattgctccggtgttggttaattaaaatatattaaatggtgggctgtgagtgcatggttttgctagtcgcacccatggcaattaaggaccggttcgcgggaaaccctggaagaattcctcgtacttaccacaagccagcgtgggcaacggctgggcttgtagtgtagcttttctctagccgacgctcccaggcaagggtgggcgtgatggagcggggcgggccctgcgacggcctctgtagcttctggattcacctaggcacgagaggggactgcccgttgcccgctggggacggggggtgaaacctgaggtgtggtgtgcttggctagagggggttatgcgaagggtcctgttacggcctcttttcggtatgtcgtggtggcatgtcggcgcacagaagcgtgtcttggggctgtgtcttgtgggtacagttgtacacctctgatcagagtaaaactattcgaatagccgtgcccgcggttatgggcggtcgaccagattcaccgtgattagtctcaccctagtttagtctgatggaactgattagttcaggtggatggttgggcctgttgcaacgtggtgtagcgttggacaatggatggttaatattgattaattattacagccgttttactgcttttaactactgtttataaatgctcgctttatacaaatgaaccgctctagccatacgttgattaaaccctgcatcataccccctattccggtatgacttgctgagtacagtggatagtactcagtcttgctttattttccccaaaaccccagagtttgagtatgcgtcagatggtggtttttccgaggagtaggcttcgtccgtgccgtcgaggatgcctgtggagtggtgttcccgctgcaatccaagtcaacgcttaactccagttatcttttatttttccgctgcatttatgtaagacttttataaagtttgtaagacgtggatatgtatgtcaactttgttgtttgtgtaccccggccggtcctggacggaggtttaaatgcacattctgcttggaattctattcgagaatttctgggcgtgacacggaccgccggatgtagcgaggggcgccaaatctagcgccgtcaccgccgcccccgcacccaaccacctccacgcccatccgttccacacctagctgcctccatgcccccaacccgacgccgacgccgatgccgtcacaccgtcgtcacccccatctggtcggggtcgtaggcaccgacccgcgacctcgagggagatggaaggccctgttgccgccttcctctcagccgcgtggtttccggcggtctgcgcgggcggcggcgaggcggaggagggaggaaggcggtggtggtcaccacctgtgtcaccgctgcccttagagcgaaacgggggccttctcagaagtcagaacgatgcagttcctcgctttaacatcttaaaactaatacaagtattacacgccatctataatttattatattcttgtgctcaacaggcaagcacaaaattaccatcctcatccatcatttctatagtactgcatcatccaatctatgctttctttataatttgagcttaacatgaaagcatgtcaaaatcctcattctcacaccattttgcaggtatttcggcatgtatccatagattattcctataatattacatgtatttattaatacatctcacaacaaaagcacaggacatcaaccaataatataacagagtcatcatgttttgaggcaagtggataacgactgtatttaaacatttactttataatttcacactttccacctctaaccaaaaaaataaaagaattaaggcctaccatactttcggcctaatagtcatccagctcatcaccctaatagcctataatgtgaacttcaccgataatctaccttctagcaagtatagcactatagcttctcgtataattgaaagctctcttgaaaaaaattaactttttatctagattctcaaaagctttagctataattcagaaaataaccctagaagctaaaatcagcttttttttattataaattacaccctctacttcatatctatttaaatttatagtgctagaatataccataattctagaagtaaattcctacccgttcctcttaatccaaagctcgctagtacaagctagcaatcatcttatctatttaaatttatagtgctaaaatatatcataattgtagaagtaaattcctacccgtttctcataattcaaagctgccctagcacagtctagcaatcaccctccatcagtgaacagtccaagtgaccaaccctaccatgcagtggggctgtgggaagtgggaacccgtgaggtatgaaaatgggaaaaccagcagcctgctagtagcatcagctagcatcagatgctgatgctagacacggtggatcgatccagcacagatccgcgaaaagatgagatgccattctccccgattcacgcacacgcgcctcccatgcaagcgacgcgccgcacaccttgggcggtggagccggtccatggaccaaaccacgtacacgtccgtgtgccgaatcgcttatatacaaagctgccgagaattgagcctcaaatcagcgtttgccgctggcgtggcccttgccggggcgtgacacgtcgtccggcccttctccggagctgaatttggaggctgcgcgttgcttgcttcctccgtcgttggatgcccatcgtgcgtccatgcctgcctgacgctgatcattttgcaaaaaagcccttaaactaattgataatttggttttagatctctggtatacagtttctacgttctacgttattacgtataggacctctaaaaaagaaatattctaatcaaagaagcaaaaaacagaaaataggactgcgctcgaaaacatagaaactaagggggttttctgcaacaacttgcatccctatcccggtccctcaccccacgaaaccctagccgccgccgttccgtcacctctctcttctcgctcgctctccctagaccacaccgccgcatccgcctccgcctccgaccactcttcttgcacccagccaaatcgccgcacctcccccttgccaccgcgaggccagttccggcggagggtagaccgtgctcgccggattcgggtagccacgacctccttgccggcggatccggtcacccggaggcaagggcagggctagcacat

SEQ ID NO: 31217 - DNA, 2053 bp, Oryza sativa
gcgacggttctctctgtctggttgcacgctactctgagtattccaacaccgtgctagatttggcgagatgagtaatacggtgctgcacggaagcttgaagccgctccgaccggcggcgacggcatcaagcaagagtagcattgtatgcggccaaaaaaggtcgtctccatgtgcctctccactgccaaagccatacaggattcatgtgtatctgagtcccttgctgtcgttgccgccgttatgaagtcgttctcatatgtgacggtgaccagtgggcagcggcacagacaatgtttcagatggctgcctgcttgcctcttaccaccactcctttccttttttgtcatgctttctctttctccctttgtatgtgtgttgcagccttgcaggttctcactatcatgtatttctgaatttgtgcaggttcttagcaaataactcagatttccttgagcatatcatttcaggataaaaagcataaaggttggctttctgttttgtttcaacctctgttactgatgtactgcattctttagatttggtctttgtgaatctttagttaccgagattcatacgtttgtttgcttcattcttttaggtggtcgaccatctatagttgctttgcctctcacacgagccacgaatgaagctccacagcttagcgcaattgtataccagtagatgatgctggttttgtttgccatcagtcatcttgattaccttggtgcacatgatatcatctgtttatttgaaagaaaactaaatttcgattcggtgactactttacagatgaacactcgacatgaatgtgtttacgcacaaaaagtatttggcaatgcgccaatgtgttttcctgcagtttagattggctaacagtagatactgctggttttgtttgccattagacctcttgattaccttggtgcacacagatataatctgtttagatataatctgtttatttaaaaggaaactgaatcttgatttggtggttagtgaacagttgaacactcaacatgaatgtttatgcataaaaagtattatgtcctttgtagattcttatggttagccagaggctataattagaagacgatgtctttgggaaggtaggtagggctgttcagccccaaacaattgttgatcagctatactgatccctttttcatgttgcaaaaccttttatcctatgccttcttttgctcaattggcctaacaaccaagggataaatagaaattgccacaggatcttcttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgcagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcagataaataactggcaagatattggaatgcctaagaatggtacaaaactaagagcaagaactttcggtgccaatacaacactgccagcctttggtcatgaaaacattagagaatcaacttagacatcaccatgtacgttgttattagtaccatcaacatcctaattaactcatcttaattagctggcactacaatactatatttttctgagatatgttatctctgttctacagaatttaattattgttgtatagtgactgctttcatttgttgcagatcttacaggtgggcttaaagtatataataaacaaagtggaacaagtcatgaatgtcatgcctaattgttgttgttttaaccaggcaacaaactcaggaaatcgagatgcacacttcaaatgatctggtagaaatccccaccttaaatcctttatactctacaaaccacaactatctttaatcatt

SEQ ID NO: 31218 - DNA, 19616 bp, Oryza sativa
tacacatgtatgttgattgcagtgctaggagtgcagtaaatttttttacatgggtgtattttttgcaatgatggatgttaataattgagggatatgatgagttagatgatataaacaaggcacaatgaatgaattgaggccatcctgatgttgggttgcacatgtattatattttattggatttctccttttatgcactatgtacaatagttggtcagagaggaaaggctagagctagaagactttttcactttctttttttccctctaaatatgggctgttagacagagttttactaactgatagcaataacaacactcctctgaaaataagagagatgtgttcctctgtttgctagatgctactggccagcctaatggtaattgattaattccatgcagcaccatatttatcttgtatgtgacagtttataatatactgcattgcatttgtccacagtttgatcatgcagagttataaaaaaggtggcgtggtggtcttgcataggtgggtttcaaagtttctatatcagtttttcattgatgtggttcaagtgttaaatttccttgggttttctgctcagaattgtagattttctttactgaaaactgcaagcgacaagttctgttccattggtcaatataatctttttggtgatattctgcaagatgtttagtcaaatccatgactattatatccagactagaaccaaatttataccacaaaatatagtatttattgctgaggtcgtaaggtttatttgtaataaaatgtgttcttttttattttatgtatgtatgactacctgcctttgtttaatttatttctcgcatgcttgttttctatacatatctaactttcatgtaacctctgtttttttacctgtcttgttgccggcagcgcggcaacggcgcgcgccacccctagtaatctacacacgtgctcccgtccccgatttccttgtgaaaaaaatatttggcacaagctagtagcattggctaaaggccatgcgagcaatcaagcgggtagatccgtaccggacctggccgtctactcttatactatctccgtcttaaaataaaataaataaaataagtatagccatgctatccgtatttaacatttaaccgtttgtcttatttaaaaactttatgaaaaatttaaaaaatcagtcacacgtaaaatattattcctgttttatcatcaaataacaataaaaatagtaatcataaaagaatatcaaataaaataatagttaaatgttgaatatatacaatgtaaaattactcttattttagaacggagggagtaccaattattaaaaatagaggagtaatttatttgtgagagggggatgcacgccgagaaaaaaaatggagtgcataaaaaaggttgacgctatgattgattgtttgatttgatctagtagatgacaatacgtgggaaaatgaactaagcaagaaaaccatagttatattattaacggtttaaaagctaatgttaaaataaaccagataaaaaaatctttgtattatctgcattcctactatatttcgaaacacatgaaagttttaaaactattgttttattagtacatataaaaaattcaagacatgggaagagaaaagcatgaggtatattcttatgcttattttcaatggttttaaatagccggctaagacatttagcggttgatgatattctcaaacaactatagcaacaactacagtgggctaaaaagaatcatagcggataaattatatatgagagaaaatagctaaaaccattctcaaatagttgtagtcggagatttaaaaccatgtttattttcctccaaaattgctctagaattattaattccatataaaattttaagagaatggatatgaaattatcattcgtttcaaagggcttcgtacaattatattctataggatcaacatcctaaaacacgggaaagcatgtggtgaaaacttggaaactaccgttggattgaaaaatagacgtccgagattcatccacgtcatcacgagtaaaagttttactcacggatgatgacgtggacaaatttcggacgtctattattcgattcaacggtagtttctaagtgtccaccacatatgtagtttttaccatatattttcataaaaaagcccttacatatttttttaaatgagattctaaacgagaagaggctagatataagatgactcgcactcctttttaaatagctttaaaaaaatagccaaagggacaagaagttgcatgaggagccattgatgagatttgcgagacaaatgagcagtagggtcccgaagttggcgtccatagtccatatagaccggtcccacggaagacaccggcacatgccgacagcccacggttgcacaagcaaagcaggtgcttccagcaatttcaacccccgaaaccccgggataatcgcaaacccaacccaactcaacctccacagccactgcagcgtgggccctacacacccagtggaatcaccacttggcccacatgtcagagccaccacccatcatcacccatggcaatggccacccgtcgcctcgcctccgcgcccacgcatcgcctcgtctctctctcttctcgattccacttctacttctcttctcttccaaaatctcgcctcgcccagctcgctcgggcagcgcacaccacgcggcgtccctcccgctccccctcgccgctaaatagcgcgggagccgcgggctccggcgagcgcgagaggagagaggaggaggcggcggaggaggaggaggcggtggtgcgtcgcgagcgcggaagggaaggggagtagtagggggggagtggcgtcggcgtcggcggcggatggcggtggagtaccactgctgcggggcggccttcttcgagcacgtggtgatcatcgtggtgctggtgctcttcgcggggctcatgtcggggctcaccctggggctcatgtccctcagcctcgtcgacctcgaggtcctcgccaagtccggcaccgaccaggaccgcaagcacgcaggtgcgcgccctgccattcccctgtgcccgccccgcccgacagccgcctgggtgtattccgacgggcggcggcgttcgttggtgtgcgtgtcgtgcctgattagatgggtttctggtaggatttggctgcaacttttccgggcttggcatttcgtcgaacatcccgcgggcgtcggtcggaccgatgaatcgatgcatgaacgttgttttgtgatgaatttggcgaatagagcggttgttgggagggtgattggaacgtatgggtcgtataattttttttttgggcgatcaattcatgcaatctacacgcggccttcccgttgtgcctacttttggttgtgcctacttttggttgatcaatccatgcgattttagaggcggcccaacaaatttttgtgtactttttgttgcgaaggtttggcttgatcacctgggaagtggtcgtattactgctgttttaggggatagcgacatgctctgcactttcttatttcggaaagtaagacctagtggcatagaaaaagtaaattaaaaacaccctgtaaaatctaaagtaaaccctggtactcatctaatttttgttttcttttgttgctatgttaggcgatccattcttgagctatttatttggctgaatgaaatgcatatgcttcatcttttttttttaaatatgtaaaatggcatgcgtcaaatgcaaatcttctcatatttttgtgaaactgctcatcttaacttttctcttttctttccagctaagatattgcctgttgtgaaaaaccagcaccttctgctatgtactcttctgatctgcaatgctgcagccatggaggtatttggctttatttcaagctatttgtagaccggttagagctttaaggttctccagatgaatgaacatgtgatggcatgcttctgtatgttgctaggctctgcccatattccttgatagcttggtgactgcttggggtgcgattttgatctcagtgacattgatcctgctgttcggtgaggtgaattatatatactttactatgatgttcagctacaagcctatatttttgcaccccatgctaatattatgttctggtataaacagatattaccacaatccatctgttcacgctatgggctggctattggtgcctcagttgctccattagtccgtgtgctcgtttgggtttgcttccctgttgcatatccgataagcaaggtaattatactcgcagactctgcaatatcattacatcagtatactcgaatgcacatgtattaaatatattttactttcttttttagcattagtatcctcgaatgcacatgtattgaacatttttttacttttctttttcagctgctggaccatctgcttggtaaaggtcatacagctcttttccgtagagctgaactaaaaacactcgtgaccctgcatggaaatgaggtaaacagaaatattgtgtcttaaagaagaaattagattattgctattatcctatgtatgtgagactacacaaaattgtagatcatagacagctccactttttaagaatttcgggtgttaaattgttaatacctctgtatatcatccgatctacgtatgaattaccacagtcagggttctgattcgttgggttgtgtgatgtgcaaaagcttaggtttggagattctatgtgctattttgaagtaatttattatcaatatcacttccaaggaaataacaaaagaaatacaaaacataaaaaggaaagggagagtgaacttagtggaatctgatgcattccttcctcaccctaagtggattttgactcagagggcataggcatgctggaatattactgataaacatgctttgctttttttccccctaacctttcatgctttatacgaaggatatggttttacttcataggttgtgattaaatactcatgtctgcaaccccggttagaatatagatcttagatgtcctaatggagcaggtcatttggttggtattctgcttacaggccgtccacagtccacacttgaaactggacaggcttagagagctagttggtcttacctgtaccaatcattgacttagtcatgtaaaaaatgaattcatgtttattgatcttcctattagtttttgcatgagtgttgaggttacggaaatctgttttataactgttttacttcaatttcaacaggctggtaaaggtggggagttaacccacgatgaaactactataatagctggagctcttgagcttactgaaaagaaagctaaagatgctatgacacccctatgtcaaacatttgctattgatataaatgcaaagcttgacaggtattggttgcgttacaattacacatgatttaattggccctaccatattcttttctcaactgcataatcctgtcattcatgttctcgtgcagggatctaatgcaaaaagtccttgacaaaggtcatagcagggtgccggtttattatgagaagaagacaaacattattggattgatattggtaatgctatcttccttttcaaaacaatcatacgattcttgtaaattgtatcttgtgttttgtctggatgaaactttttttttagttttctcatatttggcatctacctgttaatgccttgtagcattagattgagcagaacttgattaacaaatttggcaaagaacccaaaatcactaattaccatccagatatgatttatgtgcttcttatttaatttaatacatcaaaccgtatggtttgtcaaactctggatcgagtataaccattgaagtgccaccagttggagtagattctttttagttgtagttttattatgaactggcatgcaacattttctcagcacaacgataattcttttattatgaactagcacgcaacattttctcagcagaatgataattctatagtgtacttagctgtgtaaatgagcataaattgtgaaggaaggaggcattcaaattagcatgttataagttgcagctggtaaatgtgcatttaaattttaaaacaggcaggacagtcaacaccctgcatctgtgccatcttcaaacaaaatgcatagcggtaatgtgtcttgtatgacagatctgtatgttttgagagcatccatgcattagataatgttgtgatgtggatcagtggatctgcgctcttcaacaaaaatggatagcattatgtgtcttgtatgaccgatctgtatgctttgaaagcatccatggttaatgttatggtgtggatcactggatcttgatttgagctgctagtacatttacattaggtttgcaatttatttatctggcaacttcagatatgtaattgtgttgtactcacctaaaattagcaattttcaggtgaagaatttattatccatcaaccctgatgatgaaattcctataaagagcgtaactatccgcaaaattcctcggtacggtattaaactgtaaattgttcttttatccaacagtgcaacatcttaatggtgaaattgttcaatacaactgaatattcctctcactatgaaattaatgcctgctaaccactggtttactgcaaacacaaagcaacagctgatataattaggtcatctgcaaatgcttaacttatccgtagttttgttgtaatttgtagtagaaatgaattctggcatctacaaaagggaactaatttatattgcaaaatggagaagttaacagatatggtgtataatagaaatccaggagatagttctgttttcttcctatcatattgcaggcttgatcgtggtagaatatggcaacagtatctctaataatagtagcaagttactaaatgacagtgttagtagctaatttctagatttacctgaagtgcctgtttaccttaatgaaatgcttgaaatggaataattgaacttgaacgtatggtagtttaagattcagcatttcagctaacgcaaccttcatcttgttgaatgtcagtgtttcagaagacatgcccctctatgacatcctaaatgaatttcagaagggccacagtcacatggcagtagtcataagacaaaccaatgcaaattatgcagctgaacctcctgccaacgacggtggaactcttggtgagctccaaggcaattttctttctcagtagcttgcatgtggcatatatataacagccttttatcttaccattttctccttgttttctttctttctttccatgtggaacaaagaggttgcgatctcaattgatgataagcatggtgagaaggttgtgaagaatcttcctccactaagaagatggaagagctgccccaactctcagaattctaatagagggaacaggaatagaaaatggtccaaagatcaatcagatgttcttcaaatacatgaagagccattgccgacactgaatgaagatgaagaagctgtcggtatcataactatggaggatgtcatagaagagctgctccaggttagtagtttgcaaatattctctttttattagaggtttgtagaactgtccgtttgttcaactctatttgtttatttaacacatgctcagtggcgattcaacacagtaagatgcggatgatcagccaatcatatactactcataaagtagttactttcatgtttatatgtccaaccattgaaccatgagatgtgctgaacttcaatgccctacataactgctctaaaattaagagtagttacaatgacattgtgcaatattatatcattaattcatatttttcatgatggcacaggaggagatatacgatgagacagacgtacatgttgaagaacaatgacacatgccgcagtcacttcccattttgaaccagaaaatcggtgccatacctttcttttggctgaggggaagtgccgggtgcaaatatgtgtttatattagtacgtaatactgtacttcagcgtagatagaaacgggggttgaattggttcatttgaacagctggtacgaatagtagtgcagtagtagagagggacaaagggttgtgtgattttgcttggtcctgggacagtaggattgcgtagttatgaaactgtactggttatcccgggattttgacgcggtaatagtgccgctctgagtcaatggtgctccttcggaaggcttcgctttcttgtgatgttggcctcactcgaagcgtctgcacagtaacaataaaaagcatgacagccttatatatttctcgaaatctgggaaaaatctcactcatatgatgggaacgagcgtcttcaatgagtgagccacatgcgagaaatcgctcccgagtcccggctccatgagcactactcgtccggtcagaacaacatcaaatcgcttatatacaaacctgccgagatttgcggctcctggagatttttgagctggcgtggctacctgcgcgagccgacgcgtcatcggcgctgggtctggtgggatagatttgcggctcctggagatttttgagctggcgtggctacctgcgcgagccgacgcctcatcggcgctgggtctggtgggatttaataccctttgttttcctctgaaaaggaggaagaatgccgtgataatagcgcgtagccggcaggagatacaaatccagaagagcattcttcgtcatccttcatcctggttgttgtctgccattgttgtggtctaagcgtatgatcaaatcattctaaatagctatcttgttttaaatcaagatgtgatatgtcattctaaatacttctatccattcacaagagtaatacctatttcatattttagttttttaaaacaagttgtttttatttgtagtctttttacaccaagattcaaatgaagaggtaaattaaatgtttgatcaaaacccaaggagctataataactctcattggttacttgcgtgtatgcactcttggatcagagtaatatgcaaaatatgcaaaatgagttaatttatttttatcttaatggtaaaagtaatatgtgtaacttttatggaatgaggaagtagttttcttgttttaaattaagacgtgatttgtaattcgcagtcattttacctaccatctctaataattggctccagtttctaattcgagttttcggcatggaactgtgaggcactagaggttttcatacaaatgatcaactatgatactcagtgtcaactcaaaatacgacgatcaaaattaagtgaacggaggcgggagtatctatcaagctaaccagtcgagatagagctgccgcaaaagcattaactccgaaattcgctggaccaatgtagtcccaacaattaaacaaaccgtggtccaattcgcattcgctggatcatatgtactccaaacaataaaccaatatggtccattcctgttggtcaggagggagcaatggcgcacgcggacttcccgttcccgtatcagaattttaatcgcgtcgtgctacctacggccgtgtgtggaacggcgccggcaaaaaaaaatttgtaccactacagttcatccagattttttgtcctcgtctacacgtacgtatctcctcgggatcctatacgtagtagtagtagcagcagtaaaaaattaaaggatttgattactgtcctataacatcaggatttttttgctctgttcccagaataacgtagagagcgtatatccgtgcgagtgaggatctatttgtctcttgtttgttactactactccctctgtcccttaatataagggattttgatttttatacttgtactgtttgaccatttgtcttatttaaaaaaatttagaattattatttattttatttatgacttactttattatctaaagtattttaagcacaatttttcgttttttatatttacacaatttttttaataagacgagtggtcataatgtgcaagtaaaatatcaaaatctcttatattaagtgacggagggagtactactcatgatgatcgaccgcacaacgcatgagacgatcgatcgcttgtgcgatttgtagcgcgcgcgtagccgcgtatacgtacctcgtgcggccaatctacggtctacaggatcgaattgagcgctcctatatatactggcaaattagctatagctctgagggccgagcaggacgcacaagaagtcagtaacttggcattcattgtcccacatggttttatagagttgaagttagccatttaggagtagtttttttttcatctagtctgttttttaaacattaatttttatccgttaataatatcaattaaaatttttatccatcaatatttttagttgttttatttgttttttcacggtttatcggttctgtgtgcggcagatgtcgaaacatgcttgcttttcgtgttgtccatgcggtaatattatgtactcctacatactagtagggatgaaaacggagcggataaggatggatagtgctcataccatatttgtttttatatttttttaccggatacgaaaacgaatactgaaaatcgaataggaataagaatcgaatatgatcggacacgaatatggaaatattttttctcggaacacgaaaaccaactcaacttctaatagaaataaatatcaacatatataattagctcattttatacaaaatgaagtataatttataaatatttttaaaatttaagtaatattaatagtattgactagtgttaagagataaactactattaaaatctataaaggtatattgaaggttatagagttagaaagaaatgggggtatgtctcgtggcttctgtggatatccgaatagcactgttcaccgaatatccgaattattatctatatccgacggaaaccccgataccatacccgggagaaaatatccgtattcgtatccgtatccgaactatccgagaaatttccgatccgaaaggtatccgtatccgtttttgtccggagcggatggaaactatccgctctgttttcatccctactacatagagctagagaatacaaagatataaacaacttacatttgagatacaaatgaaggaatgtagggcaatcctccatcaacaaaacaagtatactgataaaggtccattttactcccgtgaagtcttgaactattttattggagcaattaacaccttgaacaattgaaaacaattcattttactgtttgtcggagaaatagaaaccaaggtcccaatcgccagctactcgggtcgtatttgccactgctccctaacacgacctcccatgacctgtgcttggggaaaattcgccaccaggtgtagccctccatgggctatgcttgaggcacatttgtcgcctttccccaagcgcagccccatgtggactgtgctcagggcgcatccgcctctaggcccgacacctcgtgggttgtgctcgaggcacatccgcccctaggcccgggccctgggctgtgctcggggcacatctgtccccaggtgtagctccccgtgggttgtgctcaaggcaggtccgcccatgagtgcggctcccagtgggctgtgctcggggcacatccgtccccaagctttgccccccatgggctatgcttagggacatcttccacctttccctatgtgctcgaggtagatgcaatgcattgactcaatcaagtctcatattcaatgcgaggtgacatacaccaaccctaggacaccacggtacggctccacctagccttcgaggctggtgcgctgacccaacaaccaccaaggtatccacatcacctaccctaagccacgcgtcgaaggaaggagtaagaccagtcccaacccaagacactagatatggtttctataaaccttcacatcatcaagaaactactctttcaatgcaaacaccaatgttccatacttaaatttaatgctacttatctcacatgatgtcttggatgttgtgtagaaccatgtctcatgcaagacctggttttcttctctttcctcatttaatcacttgccacatcatcttacatcctagatgacagcttatttatgctatggacaccgtcctagtcattgggttgggactggcctaatggggtggagagaagccgctctatgccccaccaacatgactgaaatgcaagtttagggccaatagtgcccggcccccaactatcatgtgacaaggccaagcataccaccacttgtgggttgggtcccacttgtgcacacatgtatgggcactgtggtatccccatgacatataaaaagatgaccaataccactgagaaagggggaatgttcaattgggttagacttagttcaactcaagctgcaacttagagagcaagagctcatcccctagcagacacaaataaccctcaagaaattctctgtaaacatcatcatcatcatcatctagctaagaacacagaagtagtgtgttacacttccgatcatcccaaacctgtctaaaccattgtttttttagcccttgatgatccatgagatgccaatcacctcgtttccacacacccgctccctggccgaatcccaaaagagtgccacttctccatgctagaggagtttgagctccgacaccactcattagcatttcttttctttgtttctcctcatacgagtcgtattttgaactaaaatttttagagccatagatgacacaattatcaaagttgcaaaatattttcaaaaatttcattactattttaaacctcaatatttaactagttttagtgtttcctacctatttaaaagtagataaaaaaatctttaaaatattatgggtaagttataatgcatctatcaattcaaccaaaatttagcgtaaaatatgacatatagagagaaacaataaacatgcatatcattaggaggaaggtgaaccattttcaatgtttcgggatgtagaacgagtcaaaaaaatgtttagggtgttaactgctatagcgaaattgtttgagagagtaaattagatttttcttgcaatatactccctaaggtagtacttaaaatacctgtcaataaataacatatttacaataactgatgtttgtccaaaaagtgcactattgatcgatttcctctcatatgtatttattatctgccagtaccctatggagttatagtacagccgtacaggtatcattcccatcattttaaaataattacgagggagaattttggttattagtttacttccatatcatcattgactcgatgatcctactggtacaaagtcaaaatatgtttaggactgctggcgccaggcggttctacattaatactgcttcagataaaaaaatatcgttcaaatttaatcctcaaatacaacgacttctctacatctatattttcttatcttagctgatcataattacctcttgttaaatccctcttctgactttctcatttttcattttaatcatcatatttatagaaggtatcattcgagaccaagacaagaagcaccatatcttctaaaattaaacctcatcaattaatatgttgtattacgtgcaactgcatgcatgtgaggcatgctacgatatcatttactttggcataaataaatgaacagatatgtaacgataccatttgcttatagatgaataaacaatagatatcgataattaagatgataatcatttcggaaagacctaaaaagttttacgaaatgatcagattggaatagaactagtttaatttcatattacttcttaatcataaaaaggaaattctaaaagtacttttatatttgggacagatgaagtgagctcaagtacacgtgtggcatcatttatacccgcatagcacaaaatcctcggcgaaccccatgctaaggaacaggcttacaggccaacgtgacatgcatttacactcggtaatagtatgccattcggacatatagtaagtagtaggtcatatcggccacgcttggcatgccacttacggccccgcatttaccttttggcagcccggtaccagtagtccagtagaccagtacacataagatggcaatggaccttggaccgtcgaccatacatcgtattttgaggttttagataataataataatagattaaacctttcaataagcaataagtaatgtctttcttttaagaaaggaaatacagtaatcttttctgaggagccattttagttcgttatcagatagtgtgaacgatcctgaaaaatccatccaaggagatgagatggaaaacataaaaggtctttcagggatgaagggagtgaaattccaatttttcaattgctgacacttgtctcatgtacttaacgctatttttcctccaaagtagcatgcaccttaattaggtctcgttaatggcaccacgacaatcctatcttcctagttggtacccactaaaaagcatttactcctatacaataagatatgcaagaagccatatcatcaacaattttaagccatcagatcatattaatataaaaataacaaccgttagattaagaagctacttattcatccaattcaatcgattatttattagttatccattcacctctttttgcttcatctcatagttatacatagcactgatacatattttgtgcataacaccatgttttccgaatacaatcaaattattgtttaatatgtgattattgtttaatatgtgtattgtgttttattatgcatgataagatagcatacgattattagatattattacccgaatccatttttagataaaacttgagtgaagtagagagatgcaaactgtctaaatacaacaatacccatattgccatgaaaatcatattcatatattataacaatacataatgacacttggaaaaacaaagcatgaattgcattgtgataacataagacatatataaatctacattatcatatattttctatatacatagagttgcatctaaccatttaaaagtatgattttgtttgacgataaaactacaaaaccggtgaaaaatacgcggccaactagtaccaatgaggatcatcaccacctctcaccagtggcatagctaattgtgatctagagcaatgataatccttctatatgtaataagtcaaaacaaaagatgatccatataaaatgtttataatattaggaagtacatctacaatagttctaaactcgaccgaattcttgggcgttctatgggactatacagcgccactagctagcttcatcattggacctccctatgctcctcgccccattacatttcgtgtttattttgtttttttaactccgatgggaaatccatgtgttctcaagctgattaattacctcctcacaacaatttcttttttttcctacaatatcatttctgccttagcctcattgcttttgctagtcagcacctacaactttgattattgttatcttatataaaacctcgcaaactcgtatctcaaaactttaagcagtgtttggttcgaggacaagacataatagattgaagccatttttgtttttaagggataaaatggaatggtccatttttttaaggatgggtgggtatgacctgtatgttaatgagagtgaggcggtgagatggattggtccgtcaaattttattttaggattaacctgtgctgagtcttgagggaatattctctctagtcatcgtctcgtttctaccaaactcaaccaaacaactttaagaatataacagcccctttacatcattcatcttgaacaaaacagtcaaacagtaaggaggtagacgatctctcactcatatgtcagcttagaaaatgaaccagaagtctttggacacaaggcttgcacgaatgactgatggttaattattactactccctccgtttcacaatgtaaatcattctagcatttcccacgttcatattgatgttaatgaatttagacatatatatctatctagattcattaacatctatatgaatatgaaaaatgttagaatgacttacattgtgaaacggaggaagtatatgactttgaggctgcagccagctgtgctgaataaggtacggtctaacgcccataaattgtactccctccatttctttttttttaacgttggttaatttaaaattgaacaaacaaacgtcaaatatttggagaagaaggtaatatatattcatgagaaatttcactaaccatgcgtatatcgacacaaatcatgaaaaccgaaaaatatggcctaagcgtccacctcctgcgtgggtaattgctatcggtaaatgcggtgatcaggctgagctcttttgttgaagttcccaactcacttatctcattttttatatatttttaaactactaaacggtaagtttttttaaataaataaatatatatatatatatataagaaaattgctttaagaaatcatattaatctatttaaaaaaactatgcgctaattagtcgttccgttttgattgcgagagtaattaattcccaataccaagtaaagaacacagcctgagaggtacttcctctgtagaaaaaaaacaaatttagcatggatgtgatatatcctactccctccgttacataatactcataagatattttgagttcggtctgtcaagattaattgtactaggatatgtcacatcaaccaaaaaccctttattatgggacggagggagttgttcaataaatctcgacataggctcctaggatatatcacatctatgcatgtctaggtttttttttttttgggggacagggggagtgctgtttactgccaaagagccaatgagcggaaggctcttttgtacgcatgatgggttgccaacccgcaacagacacaatcgcaatgacacagtcgcgattggaacttggttgtggagtactagtacgtacaacgctgtacacacatgtggtggcacgtacgccgcgtacgtacccctgcgccattttaccagtaccaccaccatgcatatactcctctctactcgcacatgaatcatcaaatcacattgatggcccctatatatggccctgtctgtacaacaacatatatactgttctagtacctaggagtagtatctagcgtagtactccactacgtaaatatatatacgcatgtacggttgcacatgcacgcatacgtacacggtacacggagaccaatgggaaaggagccatgtcgagcgtgtatattagctgctgcagtagtgtacatgtccggggcctgccggacatgccggggcatgcaggagctagctacggatggctagcgcgtaatctcccagacatatgccgtgcgacgccactacatgcacgagacgacgagaacgatagagagagcgtctcgctcccccatcaaatctctcatgtcccgcgacgcggcacacacgggccagagacgtcgtcgtacggggcccgtctcagtaaaagcacgtacgccgatgctacgctacggtgtggatcccccccccccccaaaccggttcaccgccccgccccccacgtagcaaagcatatcgcgtcgcgcgcgcgggaggggatgagatcaaagggtcgcgaaaatttgatgccaaaatatgccctgtctaccgaattgttgatattttgaatagtagtttggctattgtttagtttgctaacaaaatatgtcaataagatacgtaagttgctaaaacatttggcactactaaaatttgcttatcttttagcattgtcaatattctggtatggcaataaaccaaataagcttatcgtttttgtaaagtaggattgtttatagttctacttatatatactccaccgattttgaaataagtttattttcactcatcttatacatagcattaaaaagctaaaaagactaattaaatacccacatttaattaaatctaaatgcaattatttcctagctactttattaatttccaatgccatctactttcatagactttaacacaataatttctagaaaatggacttattttttagataaataggagagacggaaattaaacttattctgagacgatacagtatgaatttgattttctttctgtagcatcatattgatctcattactaaacagttaaatggattatacggaacgattcctctaaacagagtattaaaaagaattccatgcgcgcgtgggcggaaaaaaacattcggcgtacggcagctttgccgctttcgcttgatgctttccctggattaactctgctgctgacctgctgtaggagtatgcgtgagtcgactgagagagagagagttaaatgcacgggtggattatgtatgggcccggtcggtcgtccggtgggggcaaacgccacggatagagctcactgttgacggggcccggttgagtatatgacatgggactgttcgtgatgctttaattatacagtaacttgggagaaattcatggcaagcgtagaacacgtatatatacagtgttgtagcgttgaaaaaaaacgtactgaccgtgcgaacaaaattatgaggagagggccagctgttcaacaatcacctgatatatatagttttttcgattaagatgtatatttttttctcgattaagaaggtttttcaaaccactaaataacgtgttttgtatgatttttttatgtgaagttattttaaaatattgaataaatctatttttaagtttaaaataattaaataattaaacgctaatgattttctcgttttgcatgcgcacttaatcttcattttaaactcagttttgaacaggcctagtcatatatttttgatgttttcgatagataagatcacttcaagaatcatacaaggatattagcctcaatctctcatatctatcaatagcgaataatgtgcctcgttggtgtcggtgaggcctactagccgtcgcctccctccctcactcctcctactcagccgtccttattttattagctcttcttgttcaaatctgactagattcttcgcgttgcatctctatcaatgtctccgttgcaccgaacaacaacacccatcatcctaaccaccaccaacgctatcccgtattcatcctctcttgtcctgcggccgagaggcaccactgctacctcatcaccctgtcacaactaccacctaccattgggctttcacctccgatcctacggcatccctatgaagcctccacctctacccgacactcctccgcttctcgccccaaccgcgataattaacctaatccatgcggatttggccagtaacacggcaccgtcgatataggtgatacttttattattaaattttctgctgacagttttcctccatcccatttacctactggaggttaaagacgattctctgattgtcaaattattagcatccacaggctaggagtggagaaatattagtcacctgattggtagctaaaatggaacgaaatgggtggacattcgcatcacttcaagtgatgcgaggaattgaaagtatgagattcaccacaatggccaatttctttcttcttcaaataattttcaaaggagatgtgaaggttctaatcgtattggaagaaggcctcatgcaagatgtaaaaacacaagagaaaatgaatgctgagccattgtagcaggctgaaatttttacattttggtcctttttgaaaacttattttgcaaatagacccctgaaaaaacttaaaccggaaatggtcctttttggg

SEQ ID NO: 31219 - DNA, 431 bp, Oryza sativa
cacactggcgtcgtgcccgtgccaccgtggcagtagggctgtcatggaggtgctgactaggccgaagggggcgccagccagagtggcgccgccactcataccacgacgccagcatggctggcgcgcccctcctctgcgggccccaccaactttctcccccctcaaaattttcgcttctgcctccgggcaacggctggcgcccccctcctccccccatcgaagcccttctgcctccgggcctcggctggcgccgccctcatggaccacggcgccagggtagctggcgccgccctccccccagcccgaaacccttctgcctcgcggcactggctggcgccgccctccccaaccgcggcgccagggtggttggcgccgccctctgcctctctgcaaattgaagatccatattgcacaaatatgccaattcacag

SEQ ID NO: 31220 - DNA, 9848 bp, Oryza sativa
ccatcaaccttcatcggcctcttagaatcatcaaatttgattttgcctccttcgatagccgcttgtatctgctgcctgaagaccttgcaatcattggtagtatgagacccagaattgtgccacttgcaataccttttcttgcccaattcctcaaccgatggaattgtgtgaccggcaagaagttgaatctgcttctctcgtaagaataaatcaaaaatcttgtcagccttggtaatgtcaaatatcatccttctcctcttttccagaattcttcacccattggcatggtacaacctttttgctccttacccattcggctacagctatttcagaatcatcatcctcatcatccgatccacacaaataaggacagacatgattaaccttcctagaattcctcctagcttcagcaaaccactgctcgtgcaaagttaccttctgtgtaagatgcgacaagctttcaaagtcttcagatgagaatttctccatgattggagcaatcataccctacaaagccaaatcagctaactgagcatcagtcaaacttaaactgtagcacatattcctcatctctctgaacctctgaataatactcatgcacgggctcatcatgtctttgcttgattgctgtcaaatcggacaacttcatcttatgtaccccactatagaaatagctgtgaaactgcttctccagatcgccccaactgttaatcgatccatacggtaaagaagaaaaccaagtaaaagccgatccagacaaagacaatcggaacaacctaaccctcaaggcatccacagccgatgcttcaccgcactgagctaaaaattggctaatatgctcataagttgatgtactatcttgccctgagaacttcgaaaaatctgggactttaaaccggttagggagaggaactctctcaaaccattcaggatatggctgtcggtataaatttccagcatctttcggcctaagcccaaattgctccttcatgacgtccgcaatcaaatcagcccatggtcattgctgaggtgttcccttaggctgctatgacatgggctcaaactgattgtattgaggaacgaactggggttgagccgatcctgcctgccggtattgaacttgcggtgatggcggctgatactgataattcaaattgcccccctggtaattttgaaaatccggctgaatattgcgcaccaaatgctcaggaataactgaggagtcagtgtgccatctggtcgtaccgtgatgaatgaagtgctccgggacaacttgatttgcggtatgctgcacaggctgcacaggcaaacccagccgatgcattcactgagccttgctgctgaatcggctgaacaacttgttgccttaatggcgtctgttcaatcggctgctgtagacccccgattttgaaaatcggaaatcttctgtgtttatccgtaccaatccctggatcagtagttagtacacacatacatagttggatcacaacatatcacgaatgaattcaggctaaaagagttaaatacttacattagggccggtaggccaacaactatcagagaacaacagcggaagacaaaataatataagggcccggttaacatgccacaggcagtcgactagggaacgagacctagaacaagaccgcactccgatcatcttgttggatacgcaagtgtaccgacaagggcttctcttcaacactctcctaaaagatatataaatagcaagggtgagtaccaaccgtactcagcaagccaccacagcaacgatgcatatgatagagggtatttcaaggaatggcttcaggttcttttgcataaagctagttttgcaattcttttcacaagcctaagacctaacatagactgatcaagttttaataccagtgttcacattaaacaacgacggttctgtccaccatccattgtaatcccaaggatagcttcccgccattgagtcgtcatggttttctgaggacgtccaccttcccgcctctcaggaagtggctccaacagcataaaatcatcatgcaatatcccatcccacacaagttaagaattttgagtctagccaagtgtaatacgtgtcccagtgctcaataaccgcgagctctgctattcgaatagattcggtttactcacactgcagtggatgtacactttacccgcactccgcgactgcccaacacatgagcctcatcccaacacatgagacgcgtcacggcaaagcttttcgataacctcgcattggcagtacccgctccatgaactttagccctcatgcactctaggcgtcatatgtttctagcagtgagaggagttctggcgctctcgagaagggaaaaacacacacactcctacgttgcttcttgtcgttgaacccagtccatcatgattgttctcttatgggtatccttatgtagtattgccaagccaacctctgaccatccggaacgggcatccgccatccacctggccatccgaaccgggcatccgccagcagactgcttgccgcatcacacacctaaaagaaaaccactatgcagggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctccaaccgcccagtcgaaaacagttgtttaactttattttcctttcacaaatcatgtcatcaatatcatggcaatgtggcgctcatgtctccacatgccgcatctcaattaccttcccaaaggtaattgcccaagcatatagcatttgataaatatgagtatgcatgattctagaatagcattcctaagcaattgtcataattgactagggactcatacgtaatcatggttacaaggattttaagggtaaacaataatcaaggcatggcataatcacaagtaggatgtttatcattgcatgcaattttatttgtaaacaaaacaatttcgcaattgggatcaacatgttcaaggaatagtgatgacttgcctacttaggatagtccttattctcgatataatcttgatcaaccttcacctcctggaagttgcagacgttgcctcacgactaaccgatacaccaggtctataatacgcgagaaaaaccaatattcaaacaacaagcaaatatgcacaagcaaaagataattgttggggttgatcctagggttgctcatactattcgtgtttgctaatggatttcaatcatgctagggctaaggcttcttaatctttctattgtcatcgtggtctatttaggagttaaccaacatagcatttatgggatacatatatatttggctaatcggtggtttagtctatcaaatggctatggaaggattatggctatgtatgcatctatctaaataggacggttatatactagaggttctgttgttagatggatttaggatcggtcaaataattattgtgaatcatttgtattattattttattgatggaggctttattttaattatgtacatattttacttgtcaaaataaattataaaaggttaacaattacccatgctttgtatgttagaatagtttaggttaatcatattatggttacggattatctcatcacataattttacaataaataatactgatttacagttgaactataattatatgagatcaagatttataactagtatttatctaatatacatgtttatcatatattccctttaatttaatacatgcaacaagcaaattgatactataccatatagctataatgtgatgtacagtatatgtgtatgcacaatatctatcttaatattgaatcatttatttgaatagttgctatttactacaagctactcagtacatgtgattttaagtggctttatgagtgggttaccgtctatacaacttaagggtcaatttccaacctaaacatatactactgtataggaaatgccgttaactaacttcgtgcgggtgattttagtcacactagctctgttattatctctcataaacatgttattatccctcataaacaagttgaagactcatctacgtgtgttcaaatttagtcacaaagtatgaggctaaacattatttatacaatttgaacgtcatgagtatagttatatattcacatatattaataaatggcactagtatttcctatgctttaattaatttgaaacaatgctcctaattagtttacataggttttatagtgagaaagcgtgttaaagacaattatttgacatctactctattgtacaatatcaatcctatttatgagcacatttttaagttaactattatacatcatcttggtattaactatttcataatttaaatatattttcgtaaatagtgaattatataccattggaaatcttatgaatttagatgaatttaggttcaagtttcactcgaatcggagctaaaacaaataagttacgctagtttaaagattcaaatttgaattaattctaataattgcgaaatggtactgttcctaattcatttatttttaatacaatattatccacaagctatagtgactgacaggtggggtgttcctattttcttttcttttattttatttttctttctgaaggaatccatatgggcaaatgacaggtagtcccgactcctttgactagggtcaaaccggccattaaacccggtagggcccgcatgtcatagactcgagaccataaaacttctataattagatttttaaccacccggacccacatataatagacacaactaataaagattaagaaggggattactattcaccaattacgtggggcccactctaatctctcctatcctttctctttttctctctctccccgctacctctctgcttcctctctctctcacggctcggctggaaccggcgggcggcgcgacgcgacgacaagcggtggggaagggggaggctcaccggaccggcggcggggtcgatggcagagcacggcgcggcgacgaggcgcagcgcggcgacggggcgaggcgcgtctgctcggcggcttccgaagtggtggcaacgccagggacgggaaagagaggggaaagggaggggaggtggtgagggtggtgtgggaagcaatggacggccggggagggtttatataggcggaggggaagggtgggcggtgcttaatgacgacggcgacgcggcgcggcggcgtggggcacgatggcgacgggacgggcgacagtgacgcgcgcggcgcggcaggggcgcgaggcggcgcggcacggggcgcgacgcgggagtgacggcgacagcgcgcgccgaggggaggggctcgagacgagcggtgacgcaacaacgatgcgcggcgacgcgatgcaacggcgacaagacgcgacgcgcggggctcggagcggcgacacgacgggagggatggcgactggcgagcggcgcgcggcggcagcgacgggcgcgcggcggctcggggcgcgaggctgacagcaacggctcacggcgcacggcgatggcgacgcgacggcggtgtgacaggcgcgcggtggggcaggggcacagggccgacgggtcaggtgcgcggcaggcagcggcgcgatgatgatgacgacgtgacggcgacgacgacatgacgcgcggaggggtggggctcgaggcgatggcgggacgcgcggcttggcagcgggatggcgacggcgatggcgcggcagcggcggtgcgcggctcggagcgacgacgggacgcgtcggcgacggcgcgcagtggcacggggcgcgagacgggacgcgtcggcgacggcgacagcgacggcgacggcgcgtggagacgcgtgacaggcggcagcggcgacgcaatggcgggcggcgcggcgacatgacggcgacggtggcgcggcagcggcgacgggatagcgttggcgccagtgcgggcagggctcgaagccggctagggtggtgcagcagtggaggggcagggctatggaaccacatcgagcacctaggccataatgaacagtgactttttcctatttatccaattttagggcatatttcctattaaaacttgtcccataaaattctagatttcacacaattgatgtttacccaatagatgtgttaatttagatgaaagtttactcaatttttaatattacccatattttatgtttatatatatttttctattgcattatttaaatgaggtctaattataaaattaacctagataattttggaggcttcgagggttctaaaattaattaaaatatcctaatgtggccattattattgcaatagcacattgaatgaacttatttgtataacaatgcattttacgtgggtctattcattctataaatataaattgagactcagtacaacattaacctaattgtttaattaaacactcacatattcttaatttatttatatgaccattattttatatgagtgattttcatgtcatgagggactcggtaaaatgttctaagtatcaatctatatattctggtgaattacttatttataagcgcgatcattatagtggtgatcatcatttcatgtgttcttatatttcatgtgagattggattcaaatgaattagatttgattttactatctcttttagctaatcatggcatcaagccatcagcatggttcaaatatttaatatttgatctgtgatttatagtagaaattaatatttgacttatacttgatttggcttgctttcttgtgcataattatttgtaggattaaatatatctattgcctaaatgtagttcttttctttactttctttgtgatcatttacggtttggcaagcaatagcaatcataacaaccagcatgatgcaaaagttttaaaaagttcaaaattttagtgatttttattattgggaatttccaggatgttacggctgcaaaacctgccgtctctgtggcgtctgctgaattggttgcacaacctgttggactgggggtgtttgttgaatcggctgcacaacctgctgccttggcggtgtttgctgaatcggctgttgctgggttggatcaatggcatgttgaggaggtaagaacatagatgcaacctggtcttgggttagccgattcacattctgtccactgtgttgtggttgttctctcaccaacaatcggggattaaccaattggcctggggccgaaggtggtacagcgggtgcaggagctggtaatggtgccgtcggctgaaccgatggtggattaatggccggctggacaactggttgattatcgatgattaatggccgataattcgggaacacccgtcctggtaagtagactagtcctgtagcttgatactcggccattgaaccatcaaccattgactttaccatgttcgctaaagttgttgaactgcaactgtgttgcatcgccgtcttgattagggccgtcaccttgaactccctgggcaccatcaccttgaactccttgagctccctgagagtggtcaccttgatttccttgagaatcatctgcagcacctttgttgcttggttgagccgagccatctggagcttgtttcactccccatccttggaagaaccggtcccggggacatcagccactactctcacctgatacttttgcaccactgtccccttgcgggtctgcataaatgagttcaaaaactggttccgtgcttgctgcatcattgcttcaaactccttcttctgattaggtgtcaatttgtctggagtaatggtcatgacgttgccctcattaacgtcagattggtctaattgctggaccttccatttaacagaacccggactagctgaggatggtgatgttggcggtttgccgtccatgagaggacttctgacttctaatcggtcccaccaggcgtgccaaaagcgtgttgatgaaaaacacgaggcctaggagatctgtttaactccagtgcaggtccaaaacttgcctttggatatgctagcgtgccagttgatttgatcctgaaatcaacaagaaatacagacaaagaaatcgtagttaaatccataaatcatagccgatcggctagatgccgatgtcgtatcatttatctttgagccgatgtcatgcttaaatcgatcggcggttgtcaaaagataataaagaactaaatctactcaatcggttgtagatattaacaatatataatcctggtgtcgatatatacttgaatcaagtgattgggatagatcggtcgctatgccgagacagtataaatcacttagatcgaaatatatattaacaacaagactatatatgttcatagcgtagccgatctgatagatctagcatgtatcggctaatactccgatacaactctatgttaagatattaaaacaagcagaatataccaaacagaagcttaatatactaagatgcaataagatcttgacataaagggcagatttaacgtgtcaataacacacataaagcaaatgtagttaaatcagataagatcggctgaaacctcgatgctaccctaatcggcaaccataaggcgggctagagattgatgttctaagcagacttaatagatcaaactcaactgatgcaacattaagtatgaaaagaagaacaatatctagacaatcaagccgctggaagattcatagagtggtagatatcctatataatctaagtcaacattgatatctaacctaatcggctgccctctaccgacagatgttagccgattgtaggttagatggcgatattgctagagattatgtaagatatatgataacttgacgaattacataaacaacattagagtatcataaagatggaagcactaatcccgagaacgcaagccgtcataacaagttttacctcttgttgaagatcgaaaccgatgcagctcaacccgaaagcaagaacttgttgaaataaaacaaaagcaaaaagggtggcgatgcgccgagattgtattgaacgtgtgtgtttttttaaattacatggggttcggggtctatttatacccgagaattaccaactatgtccatatcgaacacgacttttatctctaacataccctaagataccataagtctttacggcagacttttgcccaaacatatctctaaggaaattatataaaatatcctaattaatagatacaattgccttctcaggactctatccatgcgtggcaatcatcttgaagcatatcaactcaacccgatgttgtacaccaagtcgtcttgtcggaatcggctgttcaccaaatcaagtccgactcgaatttagccgatccaatcgtagctgatctagactccagccgattcttactctgttcccgaatcgggcttcgcctttgactccgcttcgatctaatcctcttttccgatggtgatattaccaaatttggttgttaacaccttcctacttgggtgagagcttgttgcgccctgcttggttttgaacccgtcggaggacgtaatcaccgatcgaaagtgtgtgtgctctgatgcgcttctcgtggtatcggcgaagggcctgctggtagctggctgctttgacggcaactctttctcgatgttccacaagtaggtgcacatcgtcgcttcgctgctcctcctggtcctcatcggagtatttctgtactcgtgtgccctgatgtcgcaacttcgtggggagcatagcttctgagccatacacgaggaataagggtgtctccttgttggacgttgtcggtgtggtacgtatggcccaaaggacagaggggagttcttcgacccatttcttgtcgtgtgacatgagtctgtc

SEQ ID NO: 31221 - DNA, 6558 bp, Oryza sativa
  unsure (1)..(6558): unsure at all n locations
gtctggagcgcttgcactggtagccttgtgtgtttgctgtggaattgacaggcttcacaccgctgaaccatgtcacaagcgactttgagcgcggttggctagaaaaacccttgtcggaaagcttttccgaccaatgtccgaccggtggtgtgtgacccgcaaatcctttcgcgtatgtccaggaggagatgtctgccgtcatcgaacgagatgcatatgagaagtaccccgtttggcacctttttgtatagatcgttgccgatcatacagtagatcttggcttgtcaggttattttctcggcttctgtgtcatcctcgggcaactcgtcgctactcaggaacttgatgagtggggtccgccaatcgtctgtggtctcgatgtcggcgacgacgtgttctgacactgtagcccccgagccgatgtcggggacgactgtgctatcttcgtcgtttgcctcttttaccgatggctttgtcaggacgtccaggaaggtgccaggttcgagtggctctcgtctggacgcacgccgtgctaggtcgtctggtttgatgttgtccttgcgatatacatgtcgggcctcgatcccatcaaaccttttctccagcttcctgacatctgcgaggtacttggataactcagggctagagcacttgtagtctttgtgcacctggttcacgactagttcggaattccctttcacgattagtcgcttgactcctactgcggctgctgctcttatcccagcgagtagtcttcggactcggctgtgtgttggtcaccataaagtgaggtgaaatgcgtgcttgactgatctccgaatgtaatgtcagatgaaccctgctcctgctctttggctattgagtgcactgtcaaaagccattgtccatgtctcgttatcgggctaactgtccgacctggtgtcaggcatagcccagtcagctacgaaatcggcgaggacctgggacttgatggttatcgtggcacaaagtgaacatcaaactagcttagctcgactacccatttcgcaatgtggccaacaacatctttgtttctcaccacttctccgagggggaaggaggaaacaactgtgactctgtaggcttggaagaagtggcgtagctttcttgatgtcataattactgcatagaggagcttttggatctgtgggtatcttgtctttgcctcgtggagagcttcgctgacgtagtaaactggtcgttgcaccttctctctctcaacaacaatgacgatactcacagaatatggcgtggcggcaatatagaggaataattcttcattaggttggggggcaacaagtatagggggatttgacaggtagcgtttgagtgtgatgaacacatcgtcggcttcctgtgtccacacaaatttgtcttgttttttcagcagagcgaagagggttgtcatcgttcttctatcctagcgacaaatctgcccaataccgccatgcatccggttagcttctggacttccttgagtcttgtgggcgacttcatgttctcgattgccttgatcttctcgggatttgcttcgatccccctgccggagacgaggaatccgaggagcttgcccgacggtactccaaacgtgcacttctctggattgagcatgagacgatatcgtcggagattgtcgaacgtttctcggaggtcatcgatcaatgagtcgcttgtcttggtcttggcaacaatgttgtcgacgtaggcctcgacattgttcccaaactggtcattaagtgccccttggaccatgcgctggaaggtgtttccggcggttatcagtccaaatggcatcttaacgtaacagaatacaccgaatggcatgatgaatgctgtcttctcctcatcctctttcgccatgctgatctggtggtagccggagtaagcatcgagaaagcttaacaactcacaaccagctgttgagtccaccaattggtctattcgaggaagggggaagtgatctttgggacacgtcttgttgagatcggtgaaatcgacacacattctctacttcccgttggccttgcgtaccatgactggattggctagccactctagatggagaacttctcggatgaaactagctttgagaagcttgtcgagctcttctcatatggcttgtttcctatctggtgcgaatctctgtagtttttgctttactggcttggcatcgggtcgcaccatgatttgtgctcaatcacctccctggggacccccggcatgttggacggctgccaagcgaacacgtctgcattgtcgtggaggaaggtaatgagtgcgagttcctatttctcatccagtgacgccccgatcttgacagttttgtcggggttggcactggagagcggaacgatcttgattgcgcggtctggcttcggcgtcttgttggttttgctcactttcttgggcggctcagctgtggcgggcgggttgggagtatgctcgacaatgtcgaggctccgcttgtcgcactgcaccgctagcttcgcgtttccctgaatagtgattgttcccttcggcccaggcatcttgagcacttgatacgcatagtgagatgcagccatgaacttcgcgagtgcaattctcccgatgatggcattatatgctgtgtcaaactcagcgacatcaaaggtgatctactctgttcgaaagttgtttgcttggccgaaagtcacaggtagcgtaatcttgcccaatggcttggacgatggatgaggagtaattccatggaaaggttgatcagtaggtgtcaactcgcttcgtgggatccccatcgcgtccaaggtgctggcgaagagtaggttaatggagctaccgccatcgatgaggacccgtgcgaccttgatgttccgaatagtgggttctaccacgattgggtatcgccctggagtgacagcagcctgnnntngtctgcctctgagaattcgatcttctgctcagaccacttcatcttgggcgcagccccctgccatgtcgaacaagcttcacactccactttcttgtattctcgtttcgaggagtacgctgtggaacctccaaatatgtgtgaaacatagaggtcagagtctggatatgctgagtctgagtcntgagtagccgttctgcggccttctcgactacacgtactcgcttgcccttttccaatgccaattgcttcgcgagtgccattttcaagacgaaacaagtctccaaagagtgcttgtccgacttgtgtatagggcaccatattttctccgtatcgtcgccttgtgggtctgggtgcttgggcgggtccgcatactctgctgcgaggacttctgtttgagctttccttttcccactcctgcgactcttcttcttgattgactcagttgcatccttggctggtttcttctctccccctatcttcggcctgtcgttcttgtgtcttagggtgtcgtatgcgtcagcgcatcgatcgacaatttcgaatagcttacgagcagttgtgatccgtctcgtcaccagctcttgggtggtgtagcgatctcggacaccggatttgaaagcacgaattacggaagcatcagtgatctcggggatcatatttctgccctcattaaagcgccgaatatagtccctcaatgatttgccggattctgtgtcaacgcatgtaggtcgtcctcgatcgcgtggcacttgtatgttccttagaagctggcgacgaactgctgccacaaatctgcccatgaagaaatcaagtagggcgggaggtgaacaaaccacgaacgggcagatcccttcaacgccgctggcaaataattttgccaatgcgttgtcgtctgctccggcagcgtagagtactatggaatctctcaggccatcggacatctcgtagagcacgactgaaagccctacacccgccgctgggggcagtgggttgtcggcgatcatacatccttcgtggatgtctgtccgatgacgaagatgatgaggatgatgaggatgatgatgatgatgacgacgagtcactcggttccggtgtgcgattacaaggatcatgttcgggttctcgagaaccttgtcgtcgcccaccgttgttgtcccggcactgatctccgccgtcgtcatcattacgatggcgtcctcgaccagtatcgcccgacatccgttgctcacgattagcgtgttcacggtggttgtggcgatcatcacggtctcggctctcgctcggatgtcctccttggtcttcgttctcgcgatgtcgcgaagagacgcgatgtcaggaacaattgttgttgtcttgcgtgcgccgcacttatcggcgaccttttagatggtcgtggagatcactggtgccacgaggcggaggggtggcttgacgaggcggcattcgctgttcaggctattccccgttaggctgccagtcggcggttgttctggtggtgccctggcagcggcctcttcgaatgtgttactgaagttggccactgattcccgtagtcgttctgtccactgatcgagatcagcgttcaggacgggatcataaggggtttccctcagtattgcgttgatggttctgatatgttgggccggcgtagccaattgatcctccgcttctgtgttgccacctgcaacgtgctagtcccaccgatggcgtatacatcgcgtggtgtacttgttgatgatgaggcctgatcttcgaccagatgtaagacagatggctcgtggggatcaatattgattaccctgaccaatcgatctgagacagcagccggtccttgttccttggccggctttctaagaaaaaattttgatggtggaccttaagagggactcttcattgccttgaaaaagaacttaccacttgaaaaggcgtgaagtccttggctggtgattggaacattgaccatcacgagtgggagaagcacgtcgaattccacgctccctgcaggcacggattcagcttgtacgtcgagaaaaaccgagcaagcctgcaagtgtgccctttggtcttgtgaatagaacaccagattcttgttgcctcggaagttgtcctcgtcggctcgtgattcttgttggaaagataagaactggccgcgttagaatccttcttaggtgcagacgttgtcgatgttccgttctccgctcctgtgggaggatccttcgacatggagtcgaccggggtcgtaaccacatcgttcttgatcctggtgatttctgggccagtcgagatcggcatcgtggtgtagaccgggaagacgatttcgccgacttgagtgcacaccagcatcgttgaggttgaagctccctggttgatatcggggttgacgctgtcgtcgaggaggtttgaagtcgtagtagtagaaccttgagcgccaagtccccctacctggcgcgccactgttgacgggggatacccatagaccggatatagagggtattggggtacgttggaacgaggatctacgtaatacaacatcaagcaaacaaaagacaaggattatactggttcaggccccttggtaggtaatagccctaatctagttggtatggggttatatgatggaaaccacatattacaaaggaaatatcggaactcgatgataccgatgagaccgtagtcgagttggttcgactagatcacccggcgacttggttcctgtagggccccggcttcgtaggctatggtggttgtgttgccggtgagattcgatgccttaggtcctgcccaggggttccttttatactgcgggttagttgatctctccaagtaggacttggaaatatcagattccctcacgtaatggtaaagacccagtcttgtccgagtagactccctccatttgttgatcctgtttctattacgcgatagatttccttaacgtacatagaaattatccggatacgcgcgggtataccgtatcagtatacaacgtatgtccaaggatagagggtataccttatccgtaaccctaacagtttacattgcagtatgtggcacattttaattctaagcaactaagatcgtgatattatgaatctaacaaatctgaaatcacctcatttggagttggaaccattttcctgtgaatttttgaagttctcatattaattatgacgattatttacatatatattacctaaatgtggatgtattatatgtaccagttactccaggtcttagtccagatcatttttttattctaaataattttagttcaactcatttgaagttaaaatgaattttctacaaattttataagttggagcatattttatattaactatttcatacatgaaattttaggaatattcttgtactgtaagcgtacctttttaatttacaaaattaaggtgaacaattttgtgaatccactggaattggttcaactaaaatcgttcaaccaatattggtttgggtattttctttacattttcagaatgttaaatataagggttccactatcagtgtctggccaatatgcaaaaaggaaccacccaaatcaatccatgtcacccagtcgaaaatcaattttgttcattccctttggtttttcgcaaacgtttcacacgtttatc

SEQ ID NO: 31222 - DNA, 19685 bp, Oryza sativa
  unsure (1)..(19685): unsure at all n locations
gttcgatgactatgctcatcaaactcttcaagccaaccatctctttggtaacctggtgaaccacattagtggctacatccaggggtcgaacgacttggattattctgagcacttcacacttcagaaagtcatataataatatgtggtggagaatgcgttaacgcgcaacggctttcgtgctagttgctcaaagaatcatataaaaatttataaagagtgaattccactttaggctaggtttagttacctatgttgcacattagaccaggcattaccgtattagtaagcctcttcacctagaactaggtattgttaccaattttgcaccttgtaccggtggcccacatgtcattggatcttccttctccttcttcctcaaaactccctgagcccaactctctatccacactggtgagctgagcttgtctcttcagccagtaccagcatatagcggccggccagctatcccctgagacctgctccaactcctattacacggccagctacagccttgcacaagtgctagcgagcacacaagatgaagaacaatgagattgaataattgaatcaatgcatgcacagggcagcctgagaatgggtgattgtacgaacggtgctggagcagagccactgcattgtcagctctcctctatttgcctaggacttaataatttcctccaaatcacaaatcgatcgagatcgtcgcgaccctcggcgaaggtcgagcgtggctgcagcgctaacaaagtttgagcgcgcttagtcttctcatccagcctcccctctctcacggtctcacctgaagtttgtctagagcatcaagaataaatggagatgaagcaagataacagaacaggagcatcggagcatcgcacaaggtgcgcgtcggcaagattcacttgagaacagcgccagtggaagaactggcccaaagtgaaacattaatgtaaacttttctgctccaaagtaaaaactgagttctatccctagtccaagttgtaacttaagtaaaatatagtggtccaatatgaaatttactctatagaaatcaagcaattaaaaggttatggaagtgcattggccatgggactgtaaatcctctttccttcactgggcctgggccctttgggactgttaaatcctctttccaaacggagtgtgtggtttgattccactttataacgatagcgagactgaacgaaagaaaagtgaaacgagacgagaagcaaagattcttcagtgcacgtgccccgctagcttgctcagctatgaaaacttcatcctcatggtcaaaaaggttcttcctcacaaacgtaatatagatggcgaatgactaactcaaaatattccactactaactaacaaggaataaataccaattaaaatgcgaaaaatacaaaatcattgccaataaatagatcttgattttagatgaatttagctgtaagtttcactagatttggacttaggatgagtgagttatgggtgtttaaagattcaaatttaatttaattcaaacaattgtgaaaacctactgtttgcatagttttcttttagtgtccgaattggttttataaaacaaaagaactctagtcactgataggtggttccaaagtatttccaattaatttgctaaatattttcccaaggggtataaaattttctaataatttgtaaatatttttccaaggggtttaaaagtctttatcattgacaagtggagcagggatcaaagtcgactgggtcaaattgactagtcaatagtctaatacccacatgtaagtgacacaaaacataaaaatatctatctatctataatcttctataataatatactaaacagtccattaacctcccaaaaccgctctcaaaatgccacgtggttccctcaaaacactctcgagttgtcacatggcgctcaaataaattattagagaaattcttaaaaattataaaaaacagaaaatctacccttaatttcagttaaatcggtgggtctactattataaaccattagattaatctatccaagaaaactaataccctaattccgcccacacatactttcgcggcgccgttgcccgtctcctctgcctcacccgcgtgcgtgtgtaatcctccctcctattttttctctatagtaattaagatttgcagcattattctgttaacatgagtaatttaaaatagtatattagatacttcatatctctcaagacgcctcacggggccaagggcatagacttccatcgttatatatagcccaatctgccagctgcaagaagtgtcttcatgcaagcatatatgcatgcgtggacatgcactacgtacaaataatttttaactttatgttgagtcgatttatttttagtttattttttaatatcctgacatttcaatcaattatttaaggtgtgtatggactatgattattgtcaaatggaaaaaaagtgcgagccatgtatcttcacgctttacattttactaattagttcctccggtttttcatagattgacgctattacttttttagatataaatttgatcatttattttattcaaatattttttttaaagtataaaaaatgtaggttatgtgaaaagttccattaacgataaaccaacttacaacaaaataaataaatgatagtcacgtaacttattaaatgaggtgaatggttaaatatattagtaaaagttaacaacggcatctattaaaaactagaaagaatataattcttaaaaaaaaataatatgcaattaggtgaaaagcccataacacaactgtcaggttacaaataaggtataccctctacccctggatatacgctatacatcgatatggtatatctgcgcgtataccgacgttctctgtatacgctaaggaaattcatcacggagtccacagatggaaagattcctatccggataggactgggtcgtcactgtatcgtataggtccgatggtccgatgtctctgggtcctactttgaaaccacctgacctgcggtataaaagggacccccgggaggacctaaggcatcgaatctcaccgccgagacaaccaccatagcctacgaagccggagcctacaggagccaagtcgccgggtgatctagtcgaaccaactcgactacggtctcgtcggtatcatcgagttccactgttccctttgtaatctgtgatttccatcatataatcccatatcaactggattagggctattacctaccaaggggcctgaactagtataatccctgttttctatttgcttgatgtcatattacgtagatcctcgtaccagcgtaccccaataccctctatatctggtctacgggtatcccccgtcgacaatggtgcaccaggtagggggacttggtgctcaaggttctactactatgtcgtcaagtctcgtcaacaacagcgtcgaccccagcgtcaacctaggagttccgactacaacaatgctggtgtggactcaagtcggtgaaatcgtcttcccggtttacaccacggtgccggtctcgactggtccatcaatgaccggaagcgagaatgtcgtggccataaccccggacgaccccatgtcgaaggatcctcccgcagtagcggagaacggaacgtcgacgacatccaagcccgaggaagatcctagtgtggccaaatcttgtccttccgacaagaatcacgagctgacaaggacaacttctgaggcgacaaggtcctggtgtcctattcacaaaactaggaaacacaccttgcaagcttgctgggtttttctcaacgcacaagctgacatccgtgcctgcaaagagagtggaatttagcgtacttctccaactcatgatgtctattgtctatccacaagacaaagaatcacgacctctcaagctgcaagattcttctcaaagccatgaagacgtagcctcctaaggtccagcactcacaaatctctcctagagatgtgaacaaggaacgaggagcgacggtcatctcagaccgattcgttggggtgatcgacattgatccccacgagccatcagtcctacactcgctcgacgaccagggttcatcgtcgacaagcacaccacgcgatgtgtttgctatcggcgggaccagcgcgtctgcgcgcgccgatgcggaagcagagaatcaagtggttacaccggctcagcacatcgggggcatcaacgcaatactgagggaaaccccttatgatcctgttctaaatgatgatctcgcacggtggacagaacggctacgggaatcagtgaccaacctcagcaacgcgttcgaggaggccgctgccacagcacacccaaaatagccgccagctggcggtgccaatggcgaaccacctgagtagcgggcctcacctcaacaagccacccctccaccccgcggcaccagcgatctccgtgaccatttaaatggctgtcgagaagcatgacgcgcgcaagacaacgaaaaccgttccagacatcgtctctcttcacgacgtcgagagaacgaagagcgaggaggacacccgagcgagatccgagaccgtgataaccgccacaaccgccacgaacgcgatgatcgcgaacagcggatgccgggtgatattggtcgaggacgccgccataacgatgacgatgacggagattgacgccgggacaacaacggtggacgacgacaggattcccgagaacccagacgtcatcctcggaatcgcacgccagagccgagtgactcatcgtcgtcgtcatcatcctcttcatcctcatcatcagatagacatccgcgaaggacagacgatcgccgacaacccaccgcccccagcgccgggtatagagctttcaaccgttcgctacgagatgtccgatggcctgagagattctaaccaggagcaacagagaagtacgatgggagtactgacccagaagaattccttcaagtctactccacggtactctacgctgccggagcagacgacaacgtgttggcaaattatttaccgacggcattgaagggttctgcgcgttcatggctgatgcacctcccgccctactgttcacgaaaaaaatcgaacacaccggcctgggagatctgcttagctcctatgcaggtccaaatcttgatgagatgcgggcgtgccagtcagtttgatcctgcaactgacaagatatgcaaatagtagatcaaaacagccaatcggctaacaagccgatggagtagttccagccgatagccgacaatagcccatgccgataccagccgatagtgatagggtttaagcaatcggctatatatccaatgtagataatgataaaaaggcagtcggctgatgatgatgtaatgaaataacaatataatccagtataaaccaatcggcaaataatgatatgataaataagcatccatccgaaggttaaagcacacatcggctggaagtccaatgtcatgaaatccacaagattagattaaacagtgaaacctttattgtcatgggctaaatccaacttatatgtatatgcaatccttatgagccgatgcaacatacagataactcaccggctgaaaccccgatgaaacccttattggcaatcaagaagcaggctagagattatggttctaagtatgacttagtagatcaaacttaactgatgcagcactaagtatgaaaagaatcataatatccagacaatcaagccgttgactgattttcagggtggtagatgtctaaactaatctaatatagcaacgcgatttagccgataccggcagaaaccctaaaacgagaagcagccgatagagctaaattgatatgctaagactagattaacaaagacatatgataaatggttaggcaaatatatcatccaaaccagagcaatccaagaggtcgaatgtattgatgcagccttgaacgacgccgacgtagacgatataattgcctgggccgacggaacattggacttatccttgcgccgttgatcgaagacaatgcagcaccgcgtcgggtgccaagttccgcctgaacgtaaaaacaaaagtagaagtaaaaagggtggcgatgcgccgaattgtattgatcgtagcgatgattacatagaccccgggtgtacatatttatacccatgggttgatacaagtccttgtcggccaagaaagaaacgttcctaaagataaaaggaaaagataaagtccttatagcacactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactaacggcttgacaactctcatcggctaatctcaagacttcgaagccgatgctgactctaagccgatgttgttcctccgttaaattctccactgtgaccatgatcttggcattgacttcttcttcagacatgtggatataaaactcgtgtcccactgggcgtgccaatttgtgttgacgaaaaaaatcgaacacaccggcctgcttagctcctgtgcaggtccaaatcttaatgagatgcgggcgtgcgagtcagtttgatcctgcaactgacaagatatgcaaatagtagatcaaaacagccgatcggctgacaagccgatggagtagttctagccgatagccgataatagccgttgccgataccagccgatagcgatagggtttaagcaatcggctatatatccaatgtagataatgatatagaggcaatcggttgatgatgatgtaatgaaataacaatataatccagtataaaccaatcggctttaatgagtgcagaaatacaaaccccgaaatccccgatgcctctgtgattcgtgctttcaaaaccggtgtcagaaatcgctatactacccaggagttggcaacaagacggatcacaactactcgaagatttttcgagatcgtcgatcgatgcgctcatgcggatgacgcactttgacgcaagaacgacaagccgaagttggggggagagaagaaaccagccaaggacgcacttgaaccaagcaagaagaaaagtagcaaaagtgggaaaaggaaagctcaagcggaagtcctcgcgtcagaatacaagcgccctcccaagcacccagacccacaaggcagcgacacgaagagaatatggtgccctatacacaagtcggacaaacattctctagatgattgcctcgtcttcaaaaagtcgctggaaaagcaactggcattggagaagggcaagcgagtacgagtagtcgagaaggccactgaggcaaccactcaggacttggactcggcatacctagattccgatctccatgtctcgcacatcttcggaggttccacggcgtactactcaaagcgagaatacaagaaaatggagcgtgaagtttgttcgacatggcagggggccgcacccaagatgaagtggtccgaacagaagatcgagttctcagatgaggaccatcccaaggctgctatcatcccaggacgatatccgatcgtggtcgagcccactattcggaacatcaaagtcgcgcgagttctcatagatggtggcagctccatcaacctcttcttcgcctgcaccttggatgtgatgggaatcccacgaagcgagttgactcccaccaatcaacccttccatgggattactcctcagtcgtcgtccaagccattgggcaaaattacgttgcctgtgactttcggccaagcaaataacttctaaacggagcatatcacctttgatgtcgctgaatttgatacagcatacaacgccatcatcgggagaaatgcactcgcgaagttcatggccgcatctcactacgcgtatcaagtgctcaagatgcccgggccgaaaggaacaatcactattcaagggaatgcaaagctggcggtgcaatgcgacaagcggagcctcgacatggtcgagcacactgccagcccacccgccacagctgagccacccaagaaagtgagcaaagcaagcaagacgccgaaaccagacggtgcaatcaagatcgttccgctctccagcgccaacgccgacaagaccgtcaagatcggggcatcactgggcgagaaataggaactcacgctcatcaccttcctccgcgacaatgcagacgtgttcgcttggcagccgtccgacatgccgggggtacctagggaggtgattgagtacaaactcatggtgcgacccaatgccaagccagtaaaacaaaaattgtgaagatttgcaccagatcgaaaacaggccatatgagaagagctcgacaagcttctcaaagctggtttcatcagagaggtactccacccagagtggctagccaacccagtcatggtgcggaaggccaacgggaagtggaggatgtgcgtcgacttcaccgacctcaacaaagcgtgcccccaaggatcacttccctcttcctcgaatagaccaactggtggacttaacagttggttgtgagttgttaagcttccttgacgcttactccggctaccaccaaatcagcatggcaaaagaggacgaggagaagacagcattcatcacgccgttcagtgtattctgctatgttaagatgccgtttggactgataaccgcaggaaacactttgcaacgcacggtccaaggggcacttaacgatcagcttgggaataatgtcgaggcctacatcgatgacattgttgtcaagaccaagacaggcgactcattgattaacgatctacgggaaacatacaacctctgacgatatcgcctcatactcaatcttgagaagtgcacgttcggagtaccatcgggcaagctgctcgggttcctcgtctctggcagaggaatagaagcaaatcccgagaagatcaaggcaatcgagaacatgaagtcgcccacaaggctcaaggaagtacagaagctaaccggatgcatggcggcactaagcaggttcgtcactaggatgggagaacgaggacaaaccttcttcgctctgctgaaaaaacaagacaaatttgtatggacacagtaagccaaagaggcgttcatcgcactcaagcgctacctgtcaaacccccctgtacttgttgctccccaacctaatgaagaattattcctctatattgccgccacgccatattctatgagtactgtcatcgttgtcgagagagaaaaggtgcaaagaccagtctactacgtcagcaaagctctccatgacgcgaagacaagatacccacagattcaaaaactgctctatgcagtaattatgacgtcaaaaaagctacgccactacctccaagcccacagggtcacagttgtttcctccttccctcttggtgaagtcgtgagaaacaaagatgttgccggccgcattgcgaaatgggtagtcaagctaagccagtttgatgtccattttgtgccacgaacagccatcaagtcccaggttctcgccgatttcgtagccgattggactatgccttaaaacaggttagacagtcaaaccgacaacgaaatgtggacaatggcgtttgacggcgcactcaatagccaaggagcaggggcagggttcatcttgacatcaccttcgggagatcagttcaagcatgcaattcacctcaacttcagggcgaccaataacacagccgagtacgaaggactactcgctgggataagagctgcagctgcacttggagtcaagcgactgatcatgaaaggggattccgaactagtcgcaaaccaggtgcacaaagactacaagtactctagccccgagttatccaagtacctcgctgaagtcaggaagctggaaaaaagatttgatggaatcgaggtctgacacgtataccgcaaggacaacatcgaaccagacaatctggcacggcgtgcgtctagacgggagccactcgaacccgacaccttcctggacgtcctgacaaaaccatcgatgaaagaagcaaacgacgaaaatagcacagtcgcacccgacatcagctcgagggcaacagaggcagaatgcaccgttgctgacatcgagaccacagacgactggcggatcccactaattaaattcataagtagcgacgcgctgcctgaggacaatgcagaagccaagaaaataacccgtcaagccaaaatctattgtatgatcagcaatgatctatacaagaaggcgccaaacagggtacttctcaaatgcgtctcgtccgacgacggcaaacacctcctcctcgacatacacgaagggatctgtggatcacttgccaccggtcgtacattggtcggaaaagcctttcgacaaggatttttctggccaactgccctcaaagaagcttgcgacatggtacaacggtgtgaagcttgtcaattttatagcaaacacacaaagctaccagcacaagcactgcaaaccatccccctcacttggccgttctcgtgctgggggctcgacatactcggaacattcccacgaggacaaggcagctacaagttcctgttcgtggcgatcgacaagttcaccaaatggatcgaagcaacacccatgggggaaattaaggccgacaacaccatcaaattcattaaagggatattttgcagatatggattgcctcaccgcatcataactaacaacggctcccagttcatcagtgccaacttccaggattactacattggactgggagtcaagatctgcttcgctttggtctctcaccctcaaagcaatggacaagtcgagagggcaaacagcatagtactacaaggaatcaagacccgtgtctacgacaggctcatgtcacatgacaagaagtgggtcgaagaactcccctcggtactttgggccgtgcgcaccacaccgacaacgtccaacaaggagacacctttcttcctcgtgtacggctcagaagccatgcttcccactgaactgcaacatcagagtacacaagtacagaagtactccgccaggatcaggaggagtagcgaggcgacgatgtgaaccttctcgaggaacatcgagaatgagttgccgtcagagtaactagctaccaacaggcccttcgacgataccacgagaagcgcatccgagcatgcacgctttcgatcggcgactacacaaaggcacaaaggcagttggaaccgacaaaagttttacaaaccatgattaattaaggagtacaggcgaaccgaagtcctactcttcaaaaagtgggagaacagactctcccagattaccgacttcttccatcacatccttacgcgcgtcgttagccgccccctgatccaagatcctctagagatcgagttcagggtgcgccaaccttacgcacgcgaggatgtgacacgtcccggtgtagatcccgtttgacgtctcctccccgatcctggccgcatgcttggaggggatcgcctccatcatcatcgctagtttcgcgagcgaagtcatcagcgagaactcatcgggattcaccgggatggtggtcgtgacactgcactccccggtgagctggtgcaggccggtgtaggtaacccgcagcgagccacggatgtccgacaggttgttctcgagcttcgacatgcggtgctcgagcccctgccattgccgctcgttgccggccaccagctccctcatcttctggaggtcctcgcgaacctccgccaggtaacgcgccaacttgtcggcgcgttcgttcgccgacgaagccgccgccgccctcgccgccgcaatctcgcgacctatgccacgagcgccagcctggaggatgcgccccatctcgatttggagctcctcccaggtgaggacgtcagcgggtgggcctcgagcaggcacaaggtcgccggcagggccgctgggcgtcgcctcacggctcctgggcacgaccacgacatctgtcaaggccactgcaggagacgcactagagttccctccagacccgtcttgtgccgccttcgcccacaccgccctatgaaaaattcccgtaatggccatcaagacgagccgcctgaattcgatgaatcaaacgacctcaaactcgtcaacttacttctcgccaagtgtcaccagcctctgccgtcgcggaggtgggggagacgcatccgaggcctaagtaaaccgagtacggtgtgaggacaacatcttccaactacgcaatcaataaccaaagacggcttaccgatggagtgggtgctttccgacggttaccgagcacggaggaaaacttcctccccttcttcggaacggtgccgccactggtcgtggcagcaacgggggcaacatcggacgcttccttggcgacgtcctccttcagcgatgccgccgcctggtggtccacgagcggcccgatgacgtcagttagagggagagcctgcactacatgaagtcacgatgcgatcctggaagaaaaagagaaagggtcatcgagtacactcacgttgattgcagcttcgccctcagctgcccctttctcgcaaagaggggcagggacgttgctcgccatcgtggggccgctcatcatcacctggccaacacggcgctccacggtttcgctgttcaaacctatagatcaagaaccagattttgataagtcaggaggaatgtatgcataaggaagggaacccagaatgcaagaaaaataccccgaggagaaacccgggtcgcgtcctccgacccagagtagtcagaggctgggtgggctcgagcctggagcggctggatccgcctaccaatgaagtcggcagcgacttcataccccgacaacccacgtactcggaggtcattgatgatatcgatgaatgactgaagtgtaacaccctgaaaattcgaccaataaaaacaaaactctaaaaatgcggaccttcgaaaactttttaaattaactacatcatgccgattctattcgcctattttatttggatttgatttcgaaattcattagtcgtgagtaaagaatagttaattacgaataaaccctaaaaataaattggcaaaataaatataatttaaaataaagattaggtgaggatagaaataaataaaatattatcgcgaccataatggtaataattaaatttaagtgcgatggagcaagaattaaccctaattaaaaattcaaataaattatataaaaataaaatatgggtaatattaatttagggtgaatttttagttagaataacacaaatattgagtaaacttcatttatgcaaaaattagaatttatagggctatatttaaatagaaaataggataaaatcgggataaataggaaaagtcactattcattgcccgctaggtgcacgagtgcgtcccctagccttccccctcctctgccacaccgctcctagccgtccttgtgccccgcgccgccgtgggccgtcaccgtcgccatcgccttgctccgccgctgccgccgcgcgccgtcgcgtcatctcgtgccccgagccgccgcgcgccgtcgccatcgccgccttgagcccgtgtcgccgcccgtcgcgtcgccgcccatcgcatcccgccccgagccacgtgccaccgctgtcgccatcgccgtcgatgtcccgtcgccgcgcgcgttccatcgccgcctcgcgccccgcgccgccgctgccgcgccgtcgctgtcgccgttccgtcgccgcgcgcgcgtcccatcgccgcctcgcgccccgcgccgccgcgccaccgtcgcgtcacccccttcacttccctctccccccttatcccctctctcccctatataagcccaccattctcccctctccaaactccattccctcctcctctcctctacccactacaccgtgtcgccgttgtgccaccacgccaccgccttcgcgccgccgcatttgagccgccacgccgccgacctcggtgacgccgcaccgcaccgagtgccgcgccacgtcctgcgccgccgtcaccgtcgtcgccgccaccaccgccgccggtgagctgtctcctccccccctcgcgcacaccgccgttgccgcccgggtgagcaagagccgagagagagagaggtagaaagaagccgggagggaggagagaaaaagaaaagaaaggaaagggagaaaaagaaaagaaagaaggagagaaaaagaaaagaaaggaaagaggagaaaaagaaaagaaagaaaagaggagagaaaaagaaaaggaaaaataaatagaaattagtgggagattaaggaagtttagaaaatttaaaataattagaatttaattatagattaattatagtcgtagaattgcaaaatttaatataattatagattatttttgggtaatctctataagtaatcgattcacggtagaaattcggatttaattactaggaattttagccgtgtattatatttaatcatttagtcatagactaaattaaatcgtgcaatattataagataattttaggattttgtccgatatttagctcgcgatagaaatttctaacctattatatggatgtaatacccgggcggattaaattaaaaacttgtgctaataaaatatttatgccacaaaatagtttggggatggatagagttaaatagacggagtagctctatttcacgaacgaaaatagataatgtatgaaaccgacttccgcgctcgatatcttcttggatttacttggatctttatttgaattctaaccgaattcaaattgtttcttcgcatgtaattttagagcccgagggagttgcggatccgagcgaggaccaagacccgcaaagcttcgagcaaggcaagtcatcactattctttgaacatgttgatcccaattgtgaaattattttgtttacaaataaattgcatgcaatgatgaacatcctacttgtgattatgccatgccttggttcttgtttaccccttatgcctttgtaaccatttacgtatgagtccctactcagttatgacaattgcttagaaatgctattctagaatcatgcatactcatatttatcaaatgctatatgcttgggcaattacctttgggaaggtaattgagatgcagcatgtggggacatgagcgccacattgccatgatgttgatgacatgatttgtgaaaggagaaatgaaattaaacaactattttcgactggggcggacggaggatttgggtggtatccggaaaaggctagtgccatccccggtcaattaaggaccgagccatgaagttaagcatgaaacgacccccgtacaaccgcacttctcgtatgggtatagacctagcggagtagatagctgagcggaggcagtatccatgcatagtggtttcttgttatgtgaggcaggggctctatggtggggcagccattggtaggaccgcgaggcgggtgtctacagtggtgtcgctgtcggtaggactgcaatgtgagaatctaaacgtaattataacttaatgcatgtgtgagtcttcccttcccgggtgcaccagaactcctctcactgctagaaaccgtgtacgcctagagtgcatgaggatgtaaagttcatggagcgggtactgccaatgcgaggttatcgaaaagctttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcactgggacatgtattacacttggctagactctaaattcttaacttgtgtgggatgggatattgcatgatgatttctatgctgatggagccacttcctgaggggcgggaatgtggacgtcctcagaaaaccatgacgactcaatagcgggaagctatccttgggatcacaatggatggtggacagaaccgtcattgtttaatatgaacactggtactaaaatttgatcagtctgtgctaggtctcaggtttgtgaaaagaattacaaaacttgctttgcgcaaaagaaccatagccatcctttgaatacccctgtcatgtgcattgttgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactccgctgccttacctacttctgtttttggaatgtattctagaccgctcggtccgatgatttgagactatgcctgcgggcttatgatgtaataattcgcactagactctcgtgtatgtgcatttggtatttcagctatgaactcgtgtataccagactacttgatccagggaaatggtactgattacacgatagattcctgttataaaaacaggggtccacagagttggtatcagagccatacgactgtaggaaaagaccaaaaggcgccccaccccttttctaagattggccaagggagaaattcccatttagtaatactttcaaaaataaaaactctatgtttacaaaactctgtacgattttcatcttactcttaactactttcttcacaaaacaagttttactctcagctgactttgggtttttcttaaaattagatggcagatcaagattcacccaccacctgggagatgggcgtaccccgctcagagggatacgtcatagagctacatcgggtgatgaggcgccttcggtaccccagatttccgatctaccgagtgagacaatgtggacccttttgggagggccggattgaggttcatccgcgagtcccttcagagtcagactacagcttctcgacacgccaccgtcgtgacttaccggagaccgcgatgcaggacgcagcccgggaggccttcctctgacttagttctattcactgggcagagttagcgagtaccgagtttgctcaccatccgtttcgggaggagagcaactctgtctgcacagttcaggacataccttgctgctataacccgatggtgactcgactgtcccgatgggctgaggctgtggacgacttctacgaggaggccctgttggagatcgacgaccagcagaggcgtatgggagagttggagaccaaggtaactgacctcacagcacaacagcttcagctagaggaggagcatcaggcttggggcagcgagatagactcgctgaaggcacagctccaggtccacagcgaccagttccagcagctatctgatcagtacaatgatcgccgcgggatgatggatacactcgaggagcagctgagagagagtcaggagcacgtcagccagcttgaggagcagcttcgagcagctacagtcagcaccacaggagcttctacttccacaacagtagggcgtgaccgctacttcttccttactccgccgtacccaccagcgttccacgctcttttgggagaggttaatatggtagccaccgagtcagcaccttacctggtggaccagacagtgacacagccacctgctccagagattaggaacaccccactgatctccacttcttcaccgcagccagggtccagtttagagactccgattcaggtcgactccgagacagaggggaccgacaccgagccagagatagagccggacatcactgatccttcagaggacgcgactcctgtcccccgcattaccttcatcggaggccctcgtaccctcagcaatgcccgcaagagcacacgacctccgggcaagaagcccaagccagatttagaggccactacttccgagccgtggggactcaagtttgcacgagccagcgaccaccctcttcctgccncaggatcctgcggatggttggatgactagactggaggacttttgcagcttcgatctcgcttcagatggtttttgggtagcatgcgagacacacacacccccttacctagattgacgagtagcttgatgattagtcgatgtatcttttggatgaactttatttggactgcgtatatgtgcggtcgattgcatcatgatttatgtactatctgtggaatctgcgatgttctttatgatgttgttactgttgtgttatgaatgagtttattccaccatgcttgcaaaacaaacttcacatcaaaacaactcccttaatgggataaaaccataagagctagttagaaaattaggatacttacttaatcggcctacacagatggcaagccgacgtcgggcgtcaatcagcaatgaagaaactcatacacctgacctaaccaccctggccggagttatggccatcaaacccaacttctgcaagccattgcaaacaaccaaggcaaccgcggacgatcaagctttggagagtttatgaggaccaagccacccacgttcactacggcagacgagcccatggaggcagaagattggctacgcatcatagagaagaaactgactcttgtccgggtacgcgaagccgacaaagtgatcttcgcagtaaaccaactggagggacccgttggtgataggtgggatacttacaaggaagctcgggaaaaggatgctggagaacccacttgggaagagttcactgcagcatttcaagagaacttcgtgcctgctgcggtaatgcgtatgaagaagaacgagtttagaaggatgcgacaagggaacacaacggtgcaggaatatctgaaccggttcactcagttggcccgctatgcaattggagacctcgcagatgaagaggaaaagatcgacaagttcatagaagggctgaatgatgaattgcgcggacctatgattgggcaagaccatgagagcttccagagcctgatcaacaaagtcgttaggctggagaacgatcaaaggactgtagagcacaaccacaagaggaggcttgctatgaatcgcccacctcagggagtgcctcagcgactcaagggagccacttcgtctgggtggaagccccctattgtggcacccaaccgtcccgccgcgcctagtaatttcaacaggccggttgtgattcagaaccgcacccctacaccaactctggctgcccctggagccaagaagaatgtggactgcttcaactgcggggagtatgggcactacgccaacaactgccctcatccacgcaaaactcctgtccgtactggcgctaatgcaatgactgttcgtggaactactacccctgctgccggacgaggtctattcaagactccgcaaactaacaggaccgctaccggatttggacgcggacaagtgaaccatgttcgagctgaagaggcccaggaagaccagggcgtactaatgggtatgttctctatcaattccaccccggttaaagttctcttcgattctggtgcatcgcattcattcatatctcggaaggctagtcaaaagcacaacttaaccctagtgggacttgaaagcctatgatagtacactcacctgggggcgagataactgtgagtcatgcttgcatagacgtacctattcgtcttagggatgtggtgtttccctccaaccttttggttttgatacctcagaccctggatgtcatattgggtatggattggttgacgaagaacagaggagtaatcgactgtagacgtagaaaagttaccctgaccacaccctggagatcggatatgagagcaaccatggatca

SEQ ID NO: 31223 - DNA, 9611 bp, Oryza sativa
ggtttgtgaaaagaattacaaaacttgctttgcgcaaaagaaccatagccatcctttgaatacccctgtcatgtgcattggtgctgtggtggcttgctgagtacggttggtactcacccttgtaatatacaaacttaatcagaggtcggagatgaagcttcggaggatccctacgcttactaccaggagggtgatggagacgatggcgctcagtaggtcttagttacggtcgttgcctgtggcaatggcgtgccgctgccttgactctgctgccttacctacttctgtttttggaatgtattccggaccgctcggtccgatgatttgagactatgcctgcgggcttatgatgtaataattcgcactagactctcgtgtatgtgcatttggtatttcagctatgaactcgtgtgtactagactacttgatccagggaaatggtactgtttacacgatagattcctgttataaaaacgggggtccacatgaagggatggggtcaaggcaggcttggcggtccaaaacggaatcttgtctagttgttcctcagggacaacaaagattggatccaaattttctatctgaagatagaaccacctcgcccgccatttgctacgagaagaggggcacttgaaggggatgtatcgcgacttcaggccatcccgaagtcggaaactaacacacccggacacatttttacgttccatccagcgcagctcgtagtagaaacgaaagagatcaagaaacagctctaccccaatgtagacctcacaaagatgggaaaagatgctgaggaaggccatggagttggggttcagatggagcagagaaagaccgtagaaattcaagacgagaaggaaaaactcagaaggcggcgggagaaaaccgcagagaatgtagtcctcaaccgcaaccatgcggcccaggacaggttcaggttcaatacctcctggttccctctccatggtcccgcgaccggggagagcgccttcctcctgcaacttcttcagggacgcgctggtggaagtggacttgtcgaggtccattgccgccggagatcaccggaggagggaccaagatgagcaagctagggtttgtgcgggagcggagaagacgaagagcgcttggaggctaggaagtttttgcaacaggcgggctccaaaatggatccccaaaactcccttaaatagacgcactaccgacgatgcgaattccaaggaaaggagagagatggccgccggaaatttctgggtccgttacacgcggcagtttttggacttcaatttaaattcactcacgaccgttgaacttcgcatggcgtcgtcgattactccttgtctctacggtcctcacgccgagatcgaccagtcgagaacgacaacaaacccgacatcagaagtcgcgatcggttacatgagttcatttaagcagaagtcaggggctactttcagggttacgaataaggtataccctctacccttggatatacgctatacatcgatatggtatatctgcgcgtatacggatgttctttgtatacgctaagaaaattcatcatggagtccacagatggaaaggttcctactcggatcggactgggtcgtcactgtatcgtgtagggtccgatgtctccgagtcctacttggaaaccaccttacctgcggtataaaagggacccaccggaaggacctaaggcatcgaatctcacagccgagacaaccaccatagcctacgaagccggagcctacaggagccaagtcgccgggtgatctagtcgaaccaacttgactacggtctcgtcggtatcatcgagttccattgttccctttgtaatctgtgattccatcatataatcccatatcaactggatttagggttattacctaccaaggggcctaccaaggggcctgaaccaatataatccatgttttctattagcttgatgtcatattacgtagatcctcgtaccagcgtaccccaataccctctatatccggtctacgggtgtcccccatcgacaacaacataataatcaccgggtcttaattgctagcgaggcttctttgtaaatactaaattaacttattgaaccacatgataaaacccactcttgataattagctgtcagttgtaaaaagtaaacaaaaatcgaagatactaattaaatttgaattcttactgtagtatttgaaattaaatacattgcaaaagaaacaaacaaatatacgcaaaggaaataaattagttccaaccaattacttggatgatttgttggcttatataccaaaattcctaggttgagatcataaactattcggtaaattggtcagattcaataaacttcaaacattttaggacaaaatttgacttctatagagtataagtctatctttaattagatgacgtagtcatattagcaatatgtttaataaacaaatatcttcaactaatttatcctaaaatcgaaaaacatctacagtataaaaaacatcatacaaaccaattccatggttgtgattgcgacaccatattttctcataaataaattcaagacttcacgatttcacatgattttagtttacaatttatatgatgcaagggtaattagaaaaaaaaatcatttccaacgtaatcccaaataaattagaatagagtaaaaaagatatttcaataaaaatatcactcacgcatatatatttgttataaaattttgagtggtgatccgatgctctctactgatactattatatcaccagtagaaatgatctgatccattcgttatttactaatacattgattaaggctaaccttttcatttatatatttttttcgggctagattgatcaatctgtggttatttattgtgctggcatcgctcatattccatcgaaataagccaaacaagaataaaactaggtttagtgactactaaatgataattataccccttacgcactttttttatagtaatgtctctccatgtttgaactactgctatttagggtggtagtataaatagatctaaatcattcgatcaaataagatcaacggattagattactttctactatcaatagagagaatcgtagtgggtctcaaattttaaacgtgttaaacaagatgcccgcgcatgtgcacgggctaccttgttataattagattttctaaataactagtacccacgtatcaacctacagattttctatcgtatcgccataacagtgcacacgtgtacaaataaaaaacgaaatcaaactaccatatctaactgtaggccattcggccattgacaacaattttctatttccacgctgaacacgagccacagttgacagttgaatcgctgagcctcactctatttaaacccgtcactcgtacccatgctaatacaacaaacataccacagtcgcgagaagttaatcgcgatcgagatagctagctagatttcaatttttaatggcaggtcagcctcccaacatgttggcaccaccgaccgacgacgagctgctgcacgcgcaggccgacatgttgcgccacagcctctacttcgtcacgtccatggcgtttcagtgcgccgtcaagctcggcatccccaccgccatccaccgcgccggcggcaccgcctcgctgcccgaccttgtcgccgccctctccctcccgcccgccaagctcccgttcctccgccgcctcatgcggctgctggtcaactcgggcgtcttcgccgctgccgacgacaccgccaccgggtgggccgggatgtaccgcctcaccccgctgtcgtggctcctggtggaaggcgaaggcgcagcgcccgtcgtcgacggccacccgagccaggtgcttgtggtgctcgccgcgacgtccaggcacttcgtggaggcggcgatggggctcgcggactggttcgggaaggacctgccgccgtcgtcctcggcgccgccgtcgccgttcgaggaggtgcacggcgccgcgctgttcgacgagagcatggcgaaccttgacccggagtctgactcgatgttcaacgaagctctagcggcgcacgaccactcagacttccccacggttctccgggagtgccgtgaggtgttccagggggtggagtcgctcaccgattgccgcggtggtgacggcagggcggcgaaggccatcgtcgaggccttcccacacatcaagttcaccgtgctggactttccccgggtgattggcgagacacgaactggtgtggtgaactacgtagcgggcgacatgttccgtgagatcccacctgctcaagctgtgatgctccaggtagtattaactgaaataaattaaaattaaaagtgattttcagcgcacgtatatataccagtgagagtttgatttattattttttataacttgtgatgattgaatttgaatttggatgtttttaaagtcatatatcatatatcgatatatcttgttattttttttataatattaggataacatgcaaatacggaagacatcgtcttgagtcttgagtaattaattagaatccatttcctatatagaagaacagttaacgactagtgcgccacgaagtgtgtaattcaaattgcgcatttgttaacttttctatgacttttttgtgcatggtagcttgtgcttcaccactggaatgacgaggattgtgtgaagatcctagctaattgcaagaaagctattccaacccgagaagatggagggaaggtgatcatcatagatatagttattggtgctccttcaggactgctgctagaagcccagctcctcatggatgtggctatgatggtggtgaccaaaggccgacagcgagacgagaatgattggcgtgatctcttcagcaaagcaggcttcagtgactacaatattgtgaagaaactgggagctcgaggcgtctttgaggtctacccatagcagtggttccaacactaattgtgtgggtcccctctgtggaggatgtgatctaagtgaataaaggaaggaagggcatattttctgaaacaaattgttatatatgtgatctatgtcaagcttggttttgtgaattaatacgtgtaaaacttctgttgaatgtttcatgtgagttaatgtgtccggcttgcttatgtaaaatttcaatatgtaaaatcacttaggccatgttcaatgcgtagccccaggtcgtccccctagcaccctccgtccgaagccgttagccgtttcgcccgaggcgatggaacgcgcgcctctgctgggggacacgtccctcgctcgcttttggcaggggcatgcagcggaacgacgcgttgtgtgccggtgagaggagagggagacgagcggcggatccggctgccgttacgccagatccggttgccggcatgccagatccatgcgctgctcaccgttgaccaccgcgctcataagtcgtcggccaccagcaacggcgttgctccagcggcggcggcggccctcctcatcgcccttccagccgccggctacgggttagagaaagaggcgagcggaggcggagggagagagatggagagggagtaaggcggcggtgtctagacgaggagggaggcgacggcggtgtctgtggcggtgcggcgcgagactcccgggaggacggcgacgggcgaaggaagtgagacgaggcgaagaaaagaagaagaggaggggcgacgaagaagaagcaggagcaaagaaaaaagagaagagagagaggggggagaagagaggggtagtataggaaaacacccaccctgggttttttggttgggacacccattgtggggttgagtacctttattcggttgcttcagattttgaagagaccacttagatgtaacctccattgagagatgagtgcccctgggcactctaggtgtggctttgattgtagatgctgatggagggaatactttaaacatgcaagtcatcctagatgaataacaattcaacatcacccacaaccaacttggtctccccagccttaagtatactggacacatgtttgatttcttttgcatggacgaataagtccatgtaacctcacaattctatttagagggtcatgtccctacactaataatacccgaaatttttgcttggacaaataagtccatgtaaccttgcaactctaccttaatctactggacatgatttgcttaatggggtaggtttgtaacattctagttaagaaaaagcattaaggtttcaaagtttttaaaacttttgcatcatgtcgtgatcattgcttgagttgtatggaaatttattttaaaacaaacctacgaataactaaattccaaagcatacgaagaaaacatgataaaatatttcacgaatcacatgtaaagcaaagacaagaaatcaaatagattaaataccaatttaaattataatctaattatacaacaaacatttgaccaaatatatatattagtaataaaaagaaacatttgaccaaattgtgcatttgttaattttttttggtgactgttttgtgcatggtagcttctgcttcaccactggaatgttgaggattacgtgaagatcctagcccaatgcaacaaaactattccaaacggagaatatagatggaaggtgattatcactgacatagtgaatggggctccttcagggccacttctagaagcccaactcctcatcaatgtggttatgatggtcgtaaccaaaggtcgacagcgagatgaaaatgagtggcgtgatctattcaagacagcaggcacagcaggcttcagtgactataagattgtgaagaactgggagctcgagctatatttgaggtctatcgatcccaagcagtgctcccaaatactattattgagtgggtttcctctatcactactaggaaaatgtttcgcatacgaggtccttttcactaagcatgcatgcacgatttttgctcccaaacgtccaaggcggaggcttaactacgaaaatgtatcattccaggcagagatttaagacgtccgacatgaaagatagtatattatcctagacggacatctttagagctttgtctgcgaagatatttcttcgtgggaggaaccttaagtcgtccgtctgggataatttttttatgaaaatagatgcacaacggagacacgaattttacgtggaaaaacccttgcgggaaaaaaccacgggcaccgaccgacaatgatcaatattgagaagttggatacaaacgcagggggatgcattgggttgtcacacactcctcataagggttacaagagaaatataggagtcttaataggcgaagacacaaagtccaagtaggaaactaatcttataatatagagtcctattagaaaactaatctaaatatactgtagtcctaatatttggatcacatgtttaacaatcttcaccttgagaccaattttcttgtagcataaaaattgtcaatatccaaagaatctcacatagataaaatcattgtgcgccaaacaatctctatgactataatgtaacaccctcgattcagaagaagtagaccatactctcaccattgggaataaatcctgaatctgctagtataaacctgtgtgaactaagcagcgacgcgaaacatgatgcccaaacttcaaactcgccatggaaataaaatcttgagtctactagcatgaatttatgtaatcctagcagaatcatgaacttttgtatacaaaacgaagtacttagatctcatgataaccagtttcgaccatcaatattatccaatatatgaagactagctatgcttgcaatgcataattcctaaataaaataattacttccactatatgctatgctactaacatgtatgcaggagaagcactcataaatgaagagaaggaggaggaaatatatcgatcaattagtcgaaagtctgccggtgatgtgcaattgcatgagaaggcctaaatgtccaatttaacaatcacaaatgggcctagaatgtatgtcactgatttaggggccaacatgggagtctactggagaaagctggggccagaagagccagcaaggggtcggccgacccaccactgagcccaatcagcccccatcttacacaggctactcactacctaaggtcgttatgaccggttcccgcgctattaccgacttcaggaggacagatggcatgaggagaaggaagatgttcgttggatgctatggaggatctccaccctcccaagtcatctccacctataaataccccttcacttccttcattccaagcacacacctcaagaagaagatcaagagctctctcaagtattgtttagtagttctagtgctagtggagtaggaaatagaatagtcttcatagtcctcaagtcttcaggagatttctagtatggctttaatagctttactttcttattttgtaagacttattgaattaatagaatattcttctttatacaagttcggtattttattccattcatattacttgagtgccgactttactttatacttgaatcaatatagtcgtgtaactagctttccagataggtgtattggtgtgggtttaatgtccgattattcggttgctctatgtcggttcaaggatgtagagtagtatttagtaatgtaagcgcggtgcttagattattagataccattaattggggtaatatacagtggttcagatgctggccgctgatggtgacagcttagtacgggtgtcctctgcatgtgtatattgtcctaagttaatttcctggggagggtactcctccgtatttagccccggttgtatggtcatgacgggctgtcgtaaggaactcggcagtcaggggtggcttctcgaaacaccaggaggacactgggtatgaggtattggttgcatgactgtatactagcaagtatagactaaagatgtatgtatactagaagtacaggaatgatatttttcttattctttctccacttagcttaaactatattttagtgagagtagttcttagttctttcttctgtgtgtcaccctaccctttgaactgaattaacccctgcatagactttgatgtatataagtaatatatgaattgttagcatagttctctcttatcatatcttctcttgcgataccttggaatactcccgggtgaaatgctacaatgatatatccatgcgcttgcggatcatatctgtaaccataatataccaggattatttctagtgctactgctgggaattagtcgctaagaaataccaacaatatcatgttagcaaaattcaccgaaaaatttgatcaccttgtgatctagataggagcaaggctctctcttgacaacttggatgtgcttcttgttttctgcatgcttctcctcttagatagatgtgccaacttgcatcttcacttgccataatgagaatattgcatctcaatctaggagtggtcgataatacttcaaactcgccttgtgaataaaatgcagaaacacaaaacacattcagagtgcaaaaactaagtatttggatcaccgtataaacctcttggtagacttgggttgttaatttagcaattgaacatgaatttggatttaccagaacagaatagaaatcgctgcaaattgaatttatttcctggtacgaaggatgtg

SEQ ID NO: 31224 - DNA, 7684 bp, Oryza sativa
tactgcctatagggggtccttggaggttaagcagccgatccatcatcagagttgatgagatttctcctcggcactgaatcttgtcggcaaagaataagtcgattgggagttggccaaatccaagttgtctagccgagctcatcaggtggtaaaattcataagagacttggatgtttctgccctgatgaatgccaacaggaaggatgcatgggctgattgtagctgtaagaacttttcatgattgatgtcttcaaatctgaagtctgatgggagttcaagatctgctgagtcctcgtaaggaaaccaaacccgggcatctttctgaaagccttcataaaagctgcaaaactaatccttaagcagctcagccgacagctttgctctagcatcagttggcatagatgcatattctccatatgacatgcatctacgatgagtgcgttcttctccatcatcttccacaatcggctccaaccttggaaattcagcttctgtcacagatggccgattgacaactttcataactaccaggtttaaccaagtctgcagcaaccaccatggtccacctgccccaaccactgagccgacggctatcttggccgatgcattgttcaacatttggtatagatagcgggcggagatctaaccgggggtgaaatcgcctggggatcgccttgtgcatcggaggaatcgccggagagagagagggcaaagttaacttcggcggtgaaaacggaagaaaacggtgtgagtttctcgggtgcaacggttagtatttaaagcactggaataacggtcgggaaatggcaaaatgcgaaacttgctcggagtcgatacacggcaaatctgaaacattaccaaatattccggactaggggggcatgtgttaacaaccaaatttggtaatatcaccatcggaaaagaggattagattgaagcggagtcaaaggcgaagatcgattcgggaacagagtaaaaatcggctggagtccagatcggctacgattgggatcggctaagtcctagtcagactaggataaatgatacagccgattccgacaatacgacttgtgtacgacatcgggttgagttgatatgcttcaagatgattgccacgcatggatagagtcctgagaaggcaattgtatctattaattaggatattttatataatttccttagagatatgtttgggcaaaaatctgccgtaaagacttatgttatcttagagtttgttagagataagagtcgtgtccgatatggacatagtttgtaattctcgggtataaatagaccccgaaccccatgtaattacaaaaaacacacacgttcaatacaatctcggcgcatcgccaccctttttgtttttgttttatttcgacgagttcttgcttttgggttgagctgcatcggtttcgatcttcaacaagaggtaaaacttgttatgacggcttgcgttcttaggattagtgcttccatctttatgacactctaatcttgtttatgtaattcgttgagttatcatatatcttacataatctctggcattattgttatttaatctacaatcggctaacatatgtcggtagagagcagccgattaggttagatatcaatattgacctagattatataggatatccaccactatatgaaacttccagcggcttgattgtctagatattgttcttctttttatacttaatgctgcatcagttgagtttgatctactaagtcgtgtttagaatatcaatctctagcctgccctctggttgccgattagagtagcgtcggggtttcagccgatcttatctgatttaactacatttgctttatgtgtttcattgacatgttaaatctaccgtttatgtcaagatcttattgcatctaagtatattaagcttctgtttggtatattctgcttgttttaatatcttaacatagagttgtatcagagtattagccaatacatgctagatctatctgatcggctacgctatgaacatatgtagtcttgttgttaatatatatttcgatctaagtgatttatactgtctcggcatggcgaccgatctatcccaatcagttgattcaagtatatatcgacagcaggattatatattgttaatatgtacagccgatcgagtagatttagttctttattatctatttacaaccgccgatcgatttaaacatgacattggctcaaagataaatgatacgtcatcggcatctagccgatcggctatcatttatggatttaactacggtttctttgtctttatttcttgttgattgcatgaccaaatcaactggcatgctagcatacccaaaggcaagttttagacctgcactggagttaagcagatctcctaggcctcatgtttttcatcaacacgcttttggcacgcctggtgggaccgattagaagtcagaagtcctctcatggacggcaaaccgccagcatcatcgtcctcggctagtccgggttctgttaaagagaaggtccagcaattagaccaatctgacgttaatgagggcaacgtcatgaccattactctagacaaattgacacctgatcagaagaaggagtttgaagcaatgatgcagtaagcacggaaccagttcttgaactcctttatgcagacccgcaaggggacagtggtgcaaaagtatcaggtgacagtagtggctgatgtccccgggaccagttcttctaaggatgggggagtgaaacaagctccaaatggctcggctcaaccgagcaacaaaggtgctgcagatgattatcaaggaaatcaaggtgacaactctcagggagctcaaggagttcaaggtgatggtttccaaggagttcaaggtgacggccctaatcaagacagcgatgcaacacagtctagatcagggtgcgccaacctcacgcacgcgaggacgtggcacgccccgatgaagatcccgttggacgtctcctcgccgatcctggccgcgtgcttggaggggatcgcccccatcgctgtggccagctccgcgagcgaccacgtcagcgagaactcgtccgggttcgctgggatggttatcgtgacgccatactcctggcgagttggtgcagaccagtgtacgagacccacaacgaacctcggatctccgacatgttgttctcgagctccgacatccggtggtcgagcccctgcagctgtctctcattgccggccaccagctccctcatctggtttgctgacgcgtggcagctgctcggcgcgctggtttgctgatgccgccgccgccctggtctcctcaatctcatggcctacgccgtgagcaccatcctggaggatgcgctccagctccgcttggagctcccccgaggtgagggcatcggcaggcgggccccgagcaggcacaaggccgacggcggggctactcggcgtcacctcccggtccctagtagcgaccacgacgtctgtcgaggccgtcgcaggggacgcgctggtagttgcaccggtcccaccttgcgtcgccttcgcccgcgccgccctgcgaagagttttctctttctcataaagctaggtgatcaagaattcgtgaataaaaaaacttcaagaacgtctacttacttctcgccgattgtcacatgcctttgcctccgttgaggaggagttgacgcgtccgagggctaagtgagatacgacggtgtgaggtccagtcatttcgacaacgtgttaaaaaacaagagagacttaccgccgggcttggtgccttccgactggtcctgagtacggaggagaatttcctccccttcttcgaaacgtagtttccactcgtggtagcagcagcagcagcgtcggacgcctctttggtgacgccctccttcaacgacgtcgccgtctggtggtccacaagtggcccgatgacgtccgtcagagggagagcctgcataacatgaagtcacaatgcgatcttggggagaaagatgtaaaggagtcatcgagtacactcacgttgatcgcagcctcgcgttcagccggacccttctcccaaagggggacggggacgtcgctcgctgtcgctggggcgctgatcatcacctggccgacgcggcgtgccacggtgtcgctgtccaaacctgtagatcgagaacaggaactcgataagtcaggagaaacaggcattcccagaatgaaatctgaaatacaaggaaaaataccccgaggagagacccgagtcgtgtcctctggcccataatcgaaggccggatggatgcgggcttggagcggttggatccgcctacctacgaagtcggcagcgactttgtaccccgacaacccccgtattcggaggtcatcgatgatgtcgatgaaagactggagggagggagtcagggcgggtttggtggtccactctgggatcttgtctggttgttcttcagggacaacaaggacaagatctgagttctcttgtcagggttacggataaggtataccctatatccttggacatatgttgtatactgatacggtagacccgtgcatatatgaataatttctgtatacgttaaggaaatctatcacgtaatagaaacaggatccacaaatagagggagtcctactcggacaagactgggtctttaccatatcgtgaggggtccgatatctctgagtcctatttggagatcaactgacccgctgtcacgcccagaaattcacgaaccagaatttctaagctgaatgtgcattaatcccctgtccaggaccagccagggtacacaaacgacaattgttgatatacagatccacgtcttacaaaaatatattagattacaaatgtagcggaaaaggtaaaagcgcggcgactccactccacagccaatccttgacagcagcaacgaaaccaacctcaacgagacagctccaactaggaagatcttcagctctggtgtgggggaaaagagagcaagactgagtactacccactatactcagcaagtcataccggaagagaaggtatgatgcaagatataaccaaaggaggctagaggttcatttgcaataaagcaggcatttaaaagaagtagttgaaagctgtaaaaaagttgcagtaattaattaatattaacaaatcactactcaacgctacaccacgttgagacaggcccaaaccaccacttgaactaaccagttccattagctaactaggagtgagactaatcacggtgaatctgattgaccgcccataaccacgggcacggctattcaaatagttttactctgatcagaggtgtacgactctacccacaaaacatagccccatgacatgtttccgtgtgccaacatgccaccatgacatactggaaagaggccgtgacaggacccttcgcataaccccctctaaccgatcgcaccacacctcagggttcgcccccgtccccagcaggcaacgggcagcccgcctctcgtgccacagtgaatctggaagctgatcaaccgaacacccccgaccgacccaactccatcacgcccacccttggctaggtacgtcatctagaggaaagctacactacaagcccagccgttgcccacgctggcttgtggtaagtacgatgaattcttccagggtttcccgcaaaccggtccttaatcgccataggcacgactagcaaaaccatgcacccacagcccaccatgtagtgtattttaattaactaacaccattgcggtggcactaatccaaagctatgccaataatcaaagtctatgcattagtgtgattcccccattgtgtactagttgaactaagcacggctaagcattccctaaaccaacatctagtcattttaaaacccaagttatcaatggcgtaaggtaaacaacatatggctgagtaataggaaccatcccacatgatattgtaaaataatgcaacatttaatagaaatgcgggacatttgtaaattgggtacaatatgatcaattgtaatacatgacttgccttgctctcgcgctgatgagaccacaacaacgtcttcgagaaaccgcggatcgacaaaacgaccgaaatctatgcgacaaacaaagcacacaagcaaaacatgctataagtctactgaaacaggaaacaaatccatttttaatagactctttgcatttttatgaatttactaagacttgaatggacttaaacggagctcgaatgaattagttatgatttttagaagattctctgtgtttttactaataaagaaaaggccttaattgatttattgcgctataatgcccagggctgacgtcatccaagaggggggcggcaagcaggcttatagagcgccggttcaccgtggatcgggaccacgcgggtggtccaccgccagtccacgggaccaacggtccggatcggccgggagccgatcggacggcgcggcggcggccaggcacggctcgccctggcacaaagccgaccggccggccatggcaaggcagcagcggcgcgcggccaccggcggtgcgggagatggcggcgactggcgcgaggacgacggcgtgcacaggaggcggcgacacgcaccggtgaaggagaggaggagaggggggtttctcaccgaggttggccggcgcgagaggagacaacggcgaacgacgccggcaagcagtggacggcgagtcgagcgggtggacgacatccggagtgacctaggaaagcaaaaaaaaaaaggatttagagggagagaggtggttcgcggcaagtggcaacgccggccgaaggcggggaaaatggaggggctcaccggcggcgggggaagacgatttccggtgggatttcagcaacgggaggcggcggccgaggtagcttccgcggcggcgaagctatcagcggcggtggtgcggcgcggcgagggcgctagtggcgacgtcgtgcgaccggagatgggcggcggcggcagagctcagggagagcggcacggcggcggtagagagcacgggaggacgcggcgagagcggaaaaagagagagggggctcgggggaatttttataggcgaagcgggaggctgacgtgaccggggaggggcccaattcgccggcgacgtggggaggtggagagagagagagagttgggggatttcaaatcccccgccatttgcgggctagcgcgcttgcaggagtcgtggggaaggtgggcggcgacgtggagggtgtggagtggagtgcggaaggcggaggaggtgggcggcatcggcggttggggtaggcagcggcggttgccggccggctagaggaggaagaaggggccgacaggtgggccccacctatcggtgaccctgagaggagcggaaggcggcacggactgggccatggccacgggccggcctaagaaggagggggtccgcgcgcgggaggagagttgggccgacggcccaacaaaggaaaaaggaaaaaggaaaagaggaaaaaggaaaaagattttcctggatttaaatattgcacatgttcatttttaattgattaaaattatctccaaggctctgaaaattccactaaaaatcatgttagcatattttgacatgtagaacccaagaaaaattccacatgccatttctgattattatttgcatttattaattaaggaattagctctaggttaattcaacaatttcttcagaccatttatttaacaaattttaaagctagaaag

SEQ ID NO: 31225 - DNA, 6361 bp, Oryza sativa
ccaaggggtctgaaccagtataatccttgtcttttgtttgcgtgatgtcgtattacgtagatccttgttccaacgtaccccaataccctctatatctgatttacgggtatctcccgtcgacataaacacttaaaacattttgtataccaaataaataccacaacatgtcttataacttgtaaaagtcgaaataaattcatgctatctgatctaaaaattattgactaaacttttttgaattcaggataatgtactattttctgcagtaacccaaaatgttacagaacttaggcctaaattacataatgatacaacgaaaattccttaaccataaatcatgttaagtctgtacctatccactgtaaagaaatcattcattttagaccatgctgattttttttgcatatattggtgtttgtttgctatcagtgaggaaattgaagaattaaatttgaaaatatactattgatttgttttttctcaaaaatattcgggatgtaaaagttttgacagaaatataccgccggtctcgcgtaaccattgcgtgagaatgacgtgggcatgacaacgcacacggtttcgcgcgacaaaagcgtgagaccgcgcgtactaaagcacgagaccgaacggtctcgcggtaccagctagcgattctgaatggctggccagattcaaaatgtttaattaccctgactagtaatatgcccatactaaacgctacggggtaattctattggtctttaatatttttttaaaaaagattcaggttagcaaaaaatatatttatatgatctgtgcatttgaactttaatattttataaagaaatgggtggaagtacaaaatagtacacatccacgacatttgaagaaacattagttatatctctgaaggcaaagcgccctccattggaggaagtattttgatccatatgtaaatgacaaattataaccaaacgtgagttgaaaccaatttacaatgcgattttatatttcaaagttttaaaatatcatacatcaatttgatttctcagtagcagcatgaaagcataatacaactccactaatttataacctcgatacacgccaaacatgaccatttcaacaccatctttaagtgttgggattaattgcaaataagaaatacacaagttatatgggctccaaactgggtacatcccgtcaatcaattggtatgttatgtacaaccaaccgttcaaatcttgccaaactcttttgttgagcagaagtataacttctggcagagcaatgaagatactctaacgaatcaaaacgctctcgcatcacctgaaaaggatagtcaaaggaattctgctcaaggccaagaagatcatcaactaatactgaagcaattcttgtattgaagatcatcaactaatcttatgacattagttatcgcccatcaacaaaagaaataaacgccaagtacttaatggcagtacctatctcatgacatcaatatagcaaaacaaatttacagataaattcccagtgcgatttgatgtgtggcaataaaatataggccatgactcaggttactgacagatcaaaggcccctagcataattgaacatgatacacaatatacctgaaccatggaatctaatcacatatgcatgacactgttcactgacataccacctctcagctttcttacacgggccgtgatatataccgcttgatttatttttttcttctaaatacatttatatcatttcccttctacatacatgtgtcaaatgtataaaatcaaagatggttgtttcttgtgaggatgtatattgtacctgtttggaatcggcctatgacactcctaataatttgttcgtcaaagcagaagtataaatcttgctctgtagatcgctctatagttaaagaagaaaacagtgattttagactaccagtcgcttgtcaatctgctaaaatataataatgaattaacctataggttcaatcaaccctcgcattttggcagtctgaagcaatgggctaaaaagtaatatttataagcacacttcttatgtcactaacatataataatgaattaacctataggttcaatcaaccctcgcattttggtagtctgaagcaatgggctaaaaagtaatatttataaacacacttcttatgtctctgagacaaattaacatagataaagattcatatcacaaaccaagccatggttccaggcaagaacagggagagtaaaaaaaattatggatttttactgccgaccgagtgagaaggtacaggaaccccacctgagagaagaggtcggtgacggtgatgatggcagcagcggtgacaccattggtcagcacaagccgcctcggcactgaccctgaacccaccattcgctcgctctatgacgatggcgacgcttgcttgaacgacggttgtgtgtggcgaaggtactatacagtcttaaatgaagcttcatccatgccttgttactatctcgttatcagtttatcacctgctaactactccctcttgtaaaaaatatgtgttcaaaaaagatatatgcctagagcatcagatatacagtctacggatgcggagaagtgtggatgttggatttattagctcggttcataagacaacaaggaagaaaggattcactttatgtctggtgagtttgatttatctatttggtgatgacgtcagttatctggccatggattagatcaagtcaaatttaagacagaagatgaagttgaacatggtcttcgggagtctatgatgtgacagctaggaagaaatccaatttcgcttggcaagacgactgtggtgatatgagagaaggtggagcactgttgcaggtggagtcaagaggaagaacttgcagggatagcgggagtctcttgttacggtgagcctggtgaaggttcgtcggggcagctcggcgtgagcggcgaaaaaggatcaactcaagtcctggtacacgaaggttcgcgcatggaacaaatttaggttggcatggcatattcgccaaggtggagtttgttagagtttgtgtcgaatatgtgtacgtagtcggttacagtttaggacttgcagttgtaataggtattaggattagagtaagagtcgaactctatcctaggatctctcataaatagaggggcgtgcctgttgtaatcacatggcgacttagcatagcgagaggaagcggctgccggcggcgaccggccgtgagtcgttgtaactctgatacgctgtatatgctggatcggggaggagcgcccgtaatcagtgccccggagatgtaagcctcggctgaactccattatcaaatatcgtgcctcggtgtcgtcatcattttggatctcctatggcgttttcttccgtgtttagctaccgatgttgatttcggggctggttttataacatgcataatagagtgtaaagtacatattgtaacttagcatttgcataataggagtgtaaagtacatcagtacatatttacctaatagtatgatacattaccaatgtgcagttagtgccattaaacaaggcctttttttttttgctttttacattctagataaatagccgctaaacaattatgtaagaggtgtttagctgagatcaatggtgattattagctgcaagattaatcaaatcatcaaacttaggaaacatatatctgacagcaatttgaaactttccatgttcctagtcaatatataatgtatacacagagtcaagtgcaaaagatgagacttacaattaaggttcttgtattgatcagttgaaaactcaagattatacgtatcaataatcaaaagttggattgtactgcactgatatgaaaggttaagttgcatgagcataaggattaaaatattgcagatgcaaaagccatcaaattttagtgagcctgagtacacagtaatgattgttcattgtgagcatgacttcatcgtagcagattacttacagcttacctagaaaatgattagacaaatatagagagtggaatttgccacacatatacctctgatgaactcagcatagcagctctgagtcctttttgttcagattaaaggaaggaatccacaaagaagaactgcaatgtcaaacaacccgacggaacagatcccaaagtaagaatgcacgatttcttaataaaggaaatatctgatcaaagcccaaaacgtgactcatgttatatacactctgtcatcaatttaaataaaaaaaattatccttcgcattggtacaatggtacccctaggatgtgttaaaaaatttcacatgccaagattacgaaggtaacatcagaagtgaatcgtagaagggagaaacctgggcaattgcctccttgctgattgccgtggtcattagcattccataaattttcctaaaagatgcaaagggggataacatcagacaccgaaattaggtcatccgtatgaaattcacgagtccgacgcatcaaaaaaattaccaaatcgcaatcgtcagtcgcagatcgttccgcggtggccgtggataggagcgcgacctgcgggatccagcgcgagatgctccaaggcgaggaggcagggcatcgcggcatcgatctggcgagggcacagggtgaggcggcggcgacgaccggttgaggtagcgcggttagggttgaggggaccggggggatggatggcgatggggcggctgacgaaggggacaatggcgacgcggtggagagcgatgggcggcggacggcgttgttttcttcgagagggatgggatgttttttctgcgagagaggataggagcggggaggggaggggatgcgctgttttcggcgagagagggatgggagggagccgtcggatcttaagtcataagtaggatttggagcgttggatgtgtgatatgataaatgatgaatgagtaaagattaattaattactaattaatcacgaatcagataattaattattaattattattaattaattcctaattaagtaattagtccctaactgagcgccggcgctctcgctcattccttgtgcgagaccgtccgcttttgtcccatgataccgcgtagtctcgcaacgttattgtgcgagacccgtccacgtcgtcacgcccacgttattctcgcgcaacggttacgcgagaccgacggtatatttctgtcaaaacttttacatcccgaatatttttaagaaaaaaagcaaatcaacagtatatttttaaatttaattcggaaattgaatatattactgatccaagtaaggatcttaattaaggcatgtgcccctcttcctttgaacatattgaaacccatgtttttggaaacgtgttgttttatgaaacttgcacgtgtaattctaactatctattacttttaaattgggaaaatagtagctatatcctatttgctgcataaacaccctcaaatctttgataccctgctatttgtaatcataggaatattcagagcactttccttgtgctcaaatgagtatatttatgcttttataaatacctaatgcttacccagcttaaaataaacttaccatggttatggatcacttatatatgctatttgaaccattttaaacattatggacagaggtgattttcagtgtatttgtgagctaaaatgagagaaaatgtgaattttagagagagtgttagttacatatggtgctagtgacatatctatagagagagtgtttgcttgggtcaattaagaaccgaactctatgccattaactattgtttaccgtgcaaccacatgtgctagttatgagataaccttagctaactaagttattaattgttcattcgggaggccattgtggtagaggtagtggctacgagtatactgtgggatatcttgtcacgctcggaatttttatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaagatctaagcagcggaaaaaaataagataaacggcgcagacgactccactccgcaggcagcttgaccagggctacacctaatcctccacaccatcagcatcactgaagaactcttcctctgatgaatgattgcaaggtgagtatacgacatactcagcaagccacgcagcaaatatgcaagtgcacaaggataccaaagaatggcataatatatggctcatttgcaaaagcagcatttagcaaacatttgagaattataaaacagtagagtaattaatcatccattttaatcaactctaaacagcacccccatgctgctcaggcc

SEQ ID NO: 31226 - DNA, 2922 bp, Oryza sativa
taatgtttcacaaccgaaactcgtgaaccggtccttaattatcatgagcacgactctcaaaaccatgtgctcacaacccaccattatcaagttttagttggcaagtaattaattaaccaatcacgattgaccatcgtgaactatcattaagccaacattaaataatagtgagtcataagttatcccaatagtgtgctaatgtttctaagcatggctaagcaatcatatataatatctagatgaaccaatatatatagcccaactagtcaagttataataacccaatgtatcaaggaataaagtaatcaagaacaaaagggctataacaaacaataggttaattccatccaatgacattcgaaaataaatccaatagttgaatagaaacaatagctttaaacgggatcaacatgctcaaagggttgtttagaatctgtgtgacttgccttgctggccttggaactcttcaaattcttctcctgtaaaaacggactctccggaaacgtcggaatctaaacagaaaggagcaaaatcaccaaaacagcacataaacaagcatgaacaatacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaaggaaaagggaattattgcgtcagcggctagggttcgcggtgaaccgggtgcacggcggcggctcacgaaaacgaacggccgagatctttccatccaaaacgaacggccgagatcgaccggtccacggccggaccacgggagacgacgacgatgacgtcagcggtgacttaaaaacctttttcaatttaaattattcatgaaatgcaattccatttattaaaaatacttccttagctcaaataaatcccagaaaaatctagaaattatagaattaagcaaagtatttaatgaaattttatctggccccattttatattggaatttattatttaaaattagatcttcttttctagactttaaaataaattctattaattacaattaaacaacaatttatatatttaggatttttagggtgtgacaaacctaccccccttaaacagaatctcgtcctcgagattcggaagaactggcgaacagatgcggatgagctgacttcaattcatcttctcgttcccaagttgattcttcttccgagtgattactccattgaactttacaaaaacggataactcgatttctggttcttctctcatctatttccaagatacggattggtttctcaacataggtcagatcctcttggacttctatctgttcaagattagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaatttcctttggtgtgaaaacgatgaactcctcgaagaggcgtgacacgaaggtacacataatctccttcgtcaaaatttagatctctacgacgattgtcggcataactcttatgacgagactgggccatacgcaatctttcttgaatgattttcaccttttcttctgcttccctcaggatatccatcccgaaaacctgacgttctcccgtttgatcccacaaaagcggagtgtggcacttccgaccatacagtgcttcgtaaggagccatctgaagactagcttgataactgttgttggacgagaattcggcgtaaggcaaatttttatcccaacttccaccgaagtttaaagcacaagatttcaacatgttttccaaaatttggtttaccctttcaggttggccggtcgtttgcggaagattaacaggaattaaggttaggttaagacccatttttttctggaagttctttaaaactttgaagtaaactgactacctcgatcagacattattttcttagggacgccgtgcaaacacacaatccttgccatatacaattccgccaaccgacttccggaataggttgtctttactgggatgaaatgagccactttggtaagtctgtcgactatcacccaaatagagtcatggcctaatgacgttctaggtagaccagtgatgaaatccataccgatttcctcccacttccattcaggaatcttcaaaggctgcagcaaacctgcgggtttctgatgttctgccttgactcgctgacaaacatcacatactgctacgtattctgcgatttcacgcttcatacttgcccaccaaaatctttccttgagatcctggtacatcttggtactacccgggtgaatggagtataaagtatcatgagcttctttcagaattgcatcttttaaatctttgttgtcggggacgcagattctctcgcccaaccatacagttccttgctcatcttccaagaaaccgatagcttttcctcttctcatattcttcttgatttcttgaatatcaggatcattaatttgggcttctctaacttgatcaattagagtgggctttgcttctaaggctgcaacgaaacctctactgacaattcccaaatttaatctttcaaattccttacataactccaatggcaactgtcgtccttccgtagcattgcaatagcctttcctgctaagagcatctgctacaacattagcctttcccgggtgataatgaattcccatgtcataatccttaattaattccaaccatttccgttgtctcatgttcagatctggctgagtaaagatgtactttaaactcttgtgatcggtgtatacctctgtacgagta

SEQ ID NO: 31227 - DNA, 2827 bp, Oryza sativa
ggtgaaaggggtgacacgacgacggtgcggcggcgcgaggcgcgaggcggcgataggacgcgcgcgcggtgatggaacggcgacagtgacggcgcggcagtggcggcaaggggcgcgaggcggcgatggaacgcgcgcggcgacgggacatcgacggcgacggcgacaacggtggcgcgcggctcggggcgggacgcgacgtgcggcgacgcgacgggcggcgacacgagatcgaggcggcgacagcgacggtgcgacggcgacggcggcacggggctcgaggcggcgacggcgacggcgcgcggcgatggtgacggcgcgcggcgagcggcgatggtgacggcgcgcggcggctcgggtcgcgaggcgacgcgatggcgcgcggtggtagcggcggagcgaggcgacggcgacggtgacggccggcggcggcgcggggcgcaatgacggctaggcgcggtgtggcagaggagggggatggctaggggacgcactcgagcacctagcgtgcaatgaatagtgacttttcctatttatcccgattttagactattttctatttaaatatagccctataaattctaatttttgcataaatgaagtttactcaatatttgtgttattgtaactaaaaattcaccctaaattaatattacccatattttatttttatataatttatttgaatttttaattagggttaattcttgctccatcgcacttaaatttaattattaccattatggtcgcgataatattttatttatttctatcctcacctaatctttattttaaattatatttattttgccaatttatttttagggtttattcctaattaactattctttactcacaactaatgaatttcgaaatcaaatccaaataaaataggcgaatagaatcggcatgatgcaattaatttaaaaagtttttgaaggtccgcatttttagagttttgtttttattggtcgaattttcagggtgttacaaacctaccccccttaaataaatctcatcccgagatttcttatcggatttcgaatagatgcgggtattctgtctccaagaattcttcgctttcccaagtggcttcatcctcagtatgattactccattgtaccttgtacatacgccacactttggtcctagtcctcttttctgcttcatccaatatccggactgggtgttctggatacgtgagatcattgctaatatgaatttcttccaacggagcttgttcctccggcactcgtaagcacttctttaattgagacacatggaaaactgggtgcacatcagcgatattttctggtagctgtaactgatatgcaacttctcctcgtctagcgatgatttggaaaggtcccacatatcttggtgctagtttccctttaaccttaaacatttttgtacctctcatcggagaaaccttcagatatacataatccccttccttaaattctagatctcttctccgggtgtcagcgtaactcttttgtcgtgattgtgccacttttagacggtcacggattaggcgaaccttttcttcggcttcttggataatgtcaggtccaaataccgtccgttctccagtctcggaccacattagtggggtacgacatcgtcgaccaaataatgcctcatttggcgacatctttaggctcgcttggaaactgttgttgtaggagaattcggcgtagggcaaacatttctcccaatccttgctaaaatccaaagcacaagctctcaacatgtcctccaagacctggtttgttctctctgtctggccatctgtttgtgggtgataagctgtgctaaaagcaaggtaacttcctagggcttcatgtactttttcccagaaatgcgaggtaaactgtgtgcctcgatcggatataattctcttaggcacaccatgaagacatactatccttgtcatgtataactcagctagcttggctccgctataatttgtcttgacggggatgaaccttgcagtcttagtgagtcggtccacgattacccaaatggaatcgtaaccagttgcggtcttatgcaatccaacgataaagtccatacctatctcgtcccatttgcattctggaatcctaaggggttgcagcaaacctgccggtcgctggtgctcggccttcaccctctggcatacgtcgcagagtgctacgtattctgctacatcccttttcatgttgggccaccagtatccttccttcaggtcctggtacatcttcgtacttccggggtgtaatgaatatgctgattcgtgagcttcccttagaattaatcccctcagtccaccctgttcgggtacgtaaatcctcttcttataccatagtgtttccttctcatcaattgagaattctttcgcacaaccagcggctatgcgctccttcacctcttggatctctccgttgtccttctgggcttcctctatctgggtcctcaaaaggggctggatgtccaaggtgtttatttgaccataaggaactaaatgtaaattcagttgggctatttcctccttaagttcaggggttatcccttccatcctcagatgattgcaatggctctttcgacttaaagcgtcggccacaatgtttgctttgcctgggtgatagtgaacctctagatcataatccttgattagttccaaccatcgcctttgcctcaagttgagatctgactgggtgaaaatatacttcagactcttgtagtcagtgtagatatcgcaatggtttccaatcaaatagtgtctccaaatctttagctcatgaaccacgactgctagttctaggtcatgggtagggtaatt

SEQ ID NO: 31228 - DNA, 6545 bp, Oryza sativa
  unsure (1)..(6545): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaaccaacccacaggcataccgactaggggtagacccctatttagaatcatcctaaagaatcaacgaaacccacaatacttagctatctgcagcaaaatctaaacaacatataaataaagcaagagttagtacattaaacaaattaatgtactagcaagaccacaatcaattcttaatacattgaggctctaccatgatgccttcacaaacattttcaatgtatttaaagaaaacattttgcaatatgtatagcataaagaacatggcatggtgtcaacataaataaataagaatcatttcctactaccgaaccggtagcaagaacataataccatgtatatcattctcatcatcatttcaaaagattcgaattctaaaagcatttataaaacataaacctaaacccatgacaattcactatgccgctcatgatcaattgcacgactaatttattagttttagactctgcagaatttgtacagtttgacccacatgacataaatccctctagtttgtctgccacctgtcgataccaccacactctacacattgagtgtggtctagcgattatgattaagcctttacattatctattgtttattccttgcatgagcacaatggtggagaatccgcaccaagtctagagcttaagtgtcatcagaatggttagcctaccgattctgacgccgtggcgaagcaacccttcccacgaggcactcactgttgcattggatagcattggacatatttagacgctcattctatgatgtggaacagtacaatcgtcccctcacagaaaaacatacacattggaacagtgcactcaacgtatcataatcacaatcatgggtagtttctatagatatgtcacaccctaaaaatcctaaatatataaattgttgtttaattggaattattagaatttattttaaaagtctagaaaagaagatctaattttaaataataaattccaatataaaatggggccagataaaatttcattaaatactttgcttaattctataattcctagatttttctgggatttatttgagctaaggaagtatttttaataaatggaattgcatttcatgaattatttaaattgaaaaaggtttttaaaatcctcttttggctttgggccgaaagtcggcccaaaaccttctctctctctctccctcggcccagtcggcccagtcagcccgcagccgcccgcgcgagcgccctcggccgctgacaggtgggtcccacctgtcggactcgtcttcctcctcgcgccgtcgcccggccagaaccctagccgagccgcgccgccgtctccttccaaattcgctcgcgcctttccttctccggtgaaatcaattgaggggaaatgtttcccgagatctcctctaccttttctcttttggaatcgtcggctaaatcgtttggaaatccgtggattcgagttcgattcggatcgatctctctcctccgaaccctaaactttccttcgcgtcgccggtcgccgtgggccttcgctgccgcctccttgcccctataaaaggacccccaagcccgccgctaccgccgccaccctcgacttcgcctctcgccgcccgtagcgccctagccccgtgtagcctagcgccgccgtcgtcgccgttcgtccagccgtgcgccgccgccgatcctgtcgtcgtcgtcgctcgggaaagtcaccgtcgtggtcgccgtcgcgtcgccgtcctcgtccgcccctccatcgctgctgtagaccgccggagcaccgccgttgtcgtcaagccgaaggttgccgccgcttcttcctcatcgctgtcgccgtccgttgatcttccgccgccgctttggtcaccggtgagttcgccatgccgtccgctacccgtaggtgctctccgttcgcgctgtcgtgtcgtcgttcgccggcgagcatgcacgcccgagccgccgccggtggtgacgtcaccgctaacgtcatcgtcgtcgtctcccgtggtctggccgtggaccggtcgatctcggccgttcgttttggatggaaagatctcggctgttcgttttcgtgagccgccgccgtgcacccggttcaccgtgaacactagccgctgacgcaataattcccttttccttttcaaaaataattcattattgcgtcataattcaattaaaatctaaataaatgatttaatccgatttaatctttgaaaattcatcttagctcggatttagttggttcatgcttgtttatgtgctgttttggtgattttgctccgttctgtttagattccgacgtttccggagagtccgtttttacaggagaagaatttgaagagttccaaggccagcaaggcaagtcacacagatcccaaacaaccctttgagcatgttgatcccatttaaagctattgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgttggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactatcacagctcctttccgtggtaccgtggtggtattgaggcacatggtgacatgttgtggggctgtgtcttgtgggtacagtggtacacctctggctagagtaaaactattcgaatagctgtgcccgcggttatgggcgagtctaacaatgtctttcgtaattagtttcacacttctcatcataataaaagatgctataactggtaataatttgattagctcctggtttggaatggtatattcctggtttggagatagatctgtacagccgggtatggttgttcgagatggttgggcctgagcagaatgggtgtgctttttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcgtatactcaccttgcaatcattcatcagaggaagggttcttcagtgatgctgatggtgtggaggattaggtgtagccctggtcaagctgcctgtggagtggagtcgtctgcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagtgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcacttcataatctcttttagtggttctcattcaaaatttattccagtgttgttagtactgtacatctaatactgtactaatggctcatttaccagcaaatgttttacaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataagatttgggactgcccctttgtatgcctagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggattgccataggagagctccgcgatcgctacagtgattagttggccgacactgagtatcgctaccatcctcgccaaccccagggaagtgaccgtggcagctaccttgagactgaggggattgagaatgatgctaccacaaggcatttggttgagatgctgtgggctatggatgaaacccacgcagaggttgtgctagcagctcaagatcgtgaagaccggaatcgtggtaagatttgcaggctagatgacaaggtggatcgtttggagaaggaactagccgcgttgaagggagaagcaccaccgcagatggccaggattcgtcttaccgcaaggaagagagctctatttgttcctcgctaccaattggcgccaaaggtccgtgtggtggagaaagaagttaccccagccctagcggatcctccggtcgtcaatgtaagtgatgatgaaggagaagaatcgaagcgcacccattcaaaggttgagtggggtgctactcaagatgatggagacgagccgaacgagccttcaatcaacttcgatgcccggaagacctagagtgccttgttaagccgttgtcttagattgttgtgttagtttgttcgtttaaatttggttgtgtgtgtctcacatgtgatttacatcagtggtgggatgtaagtgcatgcgtttgtttacttttgagtgttaggaagttggtgagtttagtggtgtgagagtcttcagttttgtaataatgaaactcagttaagatcagtaaaagttaagttagtagaaaaattaattctctgtcctaagtagttttccccggtttctcttcttgtgatcctgcccatgccagatggtgctcactcgcagcaacgggaatggccccaacaacaacaataacaacaacaacaatagagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcccactttctctagcaccactaatcctgttgaagctggcgattggctgcatgccatagagaagaagttggatttgcttcagtgcactgattaggagaaggtctcatttgcatcacatcagctgcatggccctgcctctgagtggtgggatcacttccgccttaacagaactactgctgaacctatcacttggcttgaattcaccgctgctttccggaagacgcatataccatcgggagtggtgtctctcaagaagaaggaattcaggtcgctcacccagggatctcgcacggtcaccgagtatctgcacgagttcaaccgtctggctcgttatgctccggaagatgtgcgcactgatgaagagcgctaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttctttgtctgttgttcgtccgcagcgtcagtt

SEQ ID NO: 31229 - DNA, 3527 bp, Oryza sativa
catgaataatgtaaagcccgctgcgtctgaaaatccgctcggcttcatttttgtcttgagggagttcttgtttggtcaaaaattttacaagaggttctctccagtaggcttcaatcatgcttacgccttgagtatccatggcttcgactatctcttttctaggcacggtcggttcataaagatgttcgacgaacacatctgaaggagctgcttcccgttttgaaccaaaattggccagtctgtcggccgccttattgttatgttggaggacatgggtgagctcgagtccatcgaatttgttttccaacttgcgtacctcttgtcgataagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaaatgtatccacaatacgtagctcaatctttctccagtcggggaaatcaagacgaccccagctccagtgcctgtaagcctcttcgacccatcaaaatgcataatccaatattccatcttttcctctggcatgtcttcttggcactcggtccactcggcaaggaaatcagctaaagcttgtgacttgatcgaagttcgtggcttgaatgatatgtccaaagatatcaactctaaggcccacttcgcaatccgtccatttgcttcacgattgtgaagtatatctccgagtggaaacgatgtgactaccgtaaccaagtgactttgaaaatagtgagataatttcctaacggtaattaagacaccatataataacttttgaacctgaggatatcttgtcttggagtcggctaaaacctcgctgacaaaataaattggtcgttggactttttgaatatggcgctcaacaaccaggaccgtgctcacaacctgggaggtcgccgacacatataacagcagcggctcttgtggatgcggcgaggccaaaactggtggagtagtgagaagtctcttgaagtctttaaaggctttttgtgcttcgggtccccactgaaaattgtcagtcttcttcagcagcttgaagaagggcatcccccgctagctgagtcgtgagacgaaccggctgagtgccgccatgcaaccagtcagcttttggacgtctttttgggagcttggcggtttcatgttgaggatggcgttgactttctccgggttggcctgtatgcctctttgagataccataaatccgagcaacttccctgacggcactccgaagatgtacttttccgggtttagtttcatcttgaaagcacgaatgcttgtaaaagtttcttctaaatccgcgatcaggtcatccttctgcttggtcttgacgactacatcatcaacataagcttcaacattgcgaccgatctgagttgaaaaacatctttgaatcatgcgctgataggttgctcctgcattcttcaatccaaagggcatggtgatgtagcagtaggccccaaagggcgtaataaacgaggtcttcaagcagtcggattcttttagtcggatttgatgatatcccgagtaacagtccaagaagcagagtaactcgcagccggccgttgagtcaaccacctggtcaatgcgaggtaacccaaaagggtctttgggacaagatttgttgaggtcggtataatcgacacacatgcgccattgccccatctttttccgaaccaggactgggttagccagccagtcgggatgaaggacttccttaatgaagcctgctgctaacagcttggttaattcctccttgatcgcatccttcctgtcctatgcaaaacggcggagtcattgcttgatgggtttggcgtcttccttaacatgtaaagagtgctcaatcacctctctagggataccaggcatatcggatggtttccacgcaaaaatgtctttattattctgaagaaaggtgatgagcgcgctttcctatttacaatctaactcagcgcctattacagcagtcttatcaggatcgaagggatctaagggaatctttttggtcttggcatcactttcttcggtcttcgtcagcttggttgtaggcacttctccctcgcttgccgtggtcgcagccagtcggatctcttcgcgggcgagagtagtctcgtgggtttgggccatctcgcaactttctttgtcgcatgtgacggcctgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcgacttcgaaacaaacattttctgtgcgaaaattctcccgagtgccgaaggtaactggaagagtgatctggccgagtggtgtagctaacaatcctgggataaccccgtggaagggtgcattactcggctttaattccgtgcgaggaatctgcatatcgtccagggtcttagcgaaaaggatgttgagtgcgctgccactatcgatgagagtccgtcggagcttgacattgcgaaccactgggtctagtaccagggggtaccgccccgggtggaccactcggtcgggatgatccgagcggtcgaacttaattgctatttctgaccaccgaagatattggggcgtgttaggctgaaccgcattgatctcccgttctgttagcttctgttttctcttagactcatacgccaggggtccgtcgaagatgtgattaagttctttgcgatgatcttggaaaccagtcggggcatcgtcttcatcatctttcttctttgatgtgccttgatctccgtctgaaggtttacgtgcgttcttgacgtattgctccgcgaactgtttgtagatgaagcaatctttggccacgtggttggagtttggatgatgcggacattgggagttcattatcttgtcgaaggtgttgacgcgggaacgttgtcgggaagatggagaggtggtcgccacaagttcttcgggcttacgcttgcgatccttgtggttgttacttccactccctcctgcggtcgatgtatccttctttggcttccaagtggtgcccgactgtttggacgcggtaatagcatcttcggctttggcatactcgttggctttttcgaacatctgcttaaccatcctggggggtttacgtccgaacttgctgactaggtcctcgtggcgaatgcctttagtgaaggcggcaatgatgacgtcgtcggtgatgtcggagatcttgttgcgttgttcggagaagcgtcggatgtaatctcgaagggattctctagacttctgaacgacgttgtagagatcaaactgtgtgccggggcgttcaaaggtgctttataagttggcgatgaagtgatcacgaagttccgcccatgatccgatcgtgccacggggtagtccgtggagccaggatcgggcggagtccgct

SEQ ID NO: 31230 - DNA, 21323 bp, Oryza sativa
attgctgcaaccgcgttctgctggggggtgcgaaagaccactgttccatcgacgtcttgttgcccaatgagctctctcgctcggcgcctggattccaaggcgcgttgctgtcgatcttcacctcctttgcaatccgttcacgatcttgttgctcgcgctgtagtcattctcgctcctgtcgctgtcgctcttcctccagtcggcgatgttcggtttcttgtcgtatgcgctcttcctccgcttctcgggcttggcgctgctcctccgtttcgttgtcagccatgaatacgccgaagaagaggggcgtgtagttatcctcatagctgtcgtcgaagttgtcgaggtcaccgtggtcgtagtggtagccgaagtcgtcgtagtcgaggatctcggttggtcgagaattgacgccgggggagctaaggtaaccatccaactcttccgtcgagactgtcccaagaggttggagtataacgccaacctctctagatctagattggatcagggccaagccggagctcgcctagatcttcgagtaggagatgtctggcggtgaagacggcggccaagtcatcaggaagcttcatcaggattgagggatagaacccgtcgtcttgatctggtcgcggaagagtagattggatctcgtccgagtggtttgaagccgactcgggagagatgatcttggagtaggcctcggccgagttcggaataccgaatggcacggggacctggtctctccccgactggtttgaatccgagtcaaggagagagatcttgccgaagtcgttggtgatgaagttgaggctgccgaaccggaacgcctgcccgggagggaaggcgaagttgtcgatgccagaaacgaaacccatcgcacttagtcggcgagaacttgacgctacccctacctggcgcaccaactgtcgaaacaagatttcggcaataataaaagggggtggctatcaagctaggaaagtggatgggtttggagacaaggaattttatacaggttcaggccttcttatttaagaagtaataccctactcctgtccggggatgattccaccgagtgtgttattgattgtatgattgggagaaaaaagaatcgtcccgagaggaaccctgacccctccttatatagggaaagggatccgtattacaaagtacagtccatatcctaacggaatatgggattacagataaaatacaatcgtaaccgactaggatccctggtattttcttgacatacaagtttagaatctaacccgagtcctcataaaaatattctatctatatttggtactgtatatccgactaaagtataaatgaaagcaaattcttctgtagtcactaaaggctaaggcctgggggttgtttagttgctatcatgggttcctccacgactcaggcgagtgaaaaacgtcacctgactcaggtcgtcaggcgtgacggccctgttcgtttcttctgcaagcataaattttggatactcgtgacacgtttttcaaactgctaaacggtgcgtttcgtgcgaaaaatttatatatgaaagttgctttaaaatatcagattaatccattttttaagtttgtaataattaaaacttaattagtcacatattattaccaaccctattttcatcttcattttcaggagattccaacatcaagcatcgttagtttcactcagataaaaaatcactagaatgagcttcaagttgctcgcaaaaccctttcaattcgtcgccgacaggaaaacaaacaaaaattccttctatgtgtgcactgctccctatctcctaagcattttccccacattaattgtgggtttcagctaccgagcaccaccttcttcctctcaagtccggccaccgagcaccaattccttgcagccaaaacatccctaatcaaaacccacaatctaatttcatcaaaactttacacgtttattgctaccacaagacctgcggtgttcgatactacaagcatgcccatcatcggctgctccacgaagtgcaaacaaccaccattagagtcgaattgctctgtttattccattttgatggttgttggtacttctgaggccgaacttccctgccggcgagctcacttggtgcccctctctgttcttcgtataattcatataagatgggttaaggaaacgcaattctttattgagtattatatgctttctcgttcataaaccatattttttgacttatgaggctcaggcttccaaccaaacacataagcgtaagatggcctgatcaagaagaacccatgaattctcaggccaccttcaggcttcaatttttctcaggcatggggttcggcgtgtcaaccaaacatgccctaaatcaatgtatttaatttaaagcttaaaatttgtccggactagaaaaattttcaagtcgttttgatgaactgattacaataagtaaaattttgaaacaggaatagattagaggaaataaatgcaaaatcttgtatggtaaattcaacaaacagaaacctcagcttataattaggggcggagctagcgtatattagggggtgcctatgaactcggtcaagaaaagtttttagcatgtatatatgtaccccctcaatacaaacttaggcactcatatcagcttaaacttgatctaaaatagagtaaattaaacaagtggcaccacccttcatttcgctctagctccgcctctgcttataatattggaagtaggataattctggtcagccgtcaaccacggacataaggtaaaatgtcaccaaaaatgtactaattgaaactatatcggagctttgtttttttaccatttgaattacatcgtgttagtaagcaagcaagcaatgatatatgatatgttccaacatggtataattttattgaagacagtgttatcgaacaaatttgtgtcccaaatactgatggtcggtggacgaagttggttgaaggtgatgtcaaattgtcatgtttgcatgctgaaagtattccatccatccacagatatatgaacaaaagttttacacattaacgtaagcaactggacatattaactcacacgaaacaaagcaactggacataactgacatgaaacattcaacacagaatgctttacacatattaacaatccaagcttgacataggctcacgtatataaaactttatttcataaagtatgcactcccttcatttatttacttagatcacatcctccatggtatttaggagcaccctacggatagacctcaaagacagctcgagctctcaattttttcacaatcttatagttattgaagcctgctttcttgaagagatcacgccagtcattttcgtctcgctgtcggcctttggtcgccaccatcatacccacatccataaggagttgggcttccagtagtggtccagaaggagctccaatcactatgtcaatgatgatcaccttccctccatctttgcgggctggaatagctttcttacattgagttagtattttcacacaatcctcgtcactccagtggtgaagcacaagctaccatagatgaagccacaaaaaagttaaacaaacttataatttgcattacacagttcttttttttagttctagtcgttaaccgttcttctttatggtgaagtcgcaaacttttgttgacaacttctgcaggaactataaaattgaaatacatagcaacaaaagatgaaccttttatttttcaactattacttgtttacttctcaagtctatcgtgaatatactacctctgttattatatgtataacattgttgactttagaaaataatgtttgactgtttatctcattttaaaattgtatcatttataaattttcttgatttttctcattaaaggtactttataagcatgacttatattttatatttatactaaatttttaaataaaaaaagtggtcaaacatcatgctagaaatcagtatagtcatatatctatacttaaaaagagggaatcgtcctcccctccacttcctcataaaaacctcttccctcatgtaactgtgaaaaatcgtatttctataaaagaaccaaccatagtatataaaaaaaactcacccagtgcgaatcctatcactaaactaaatagaaaaaccgttataacgcatgggcctataattaatttgaaaattgaggaagtaataggtcatagtactcactccattccaaaatataaggcataaacacacttaacctaaacatcaagaaataatttattatcacatcctagtttattttaccctaataaatataatgcatgcacccaataaaattatagatcttgagggtggatgatttaaaaataataatttagtggatataagttattagttaattgtatggatgcatgtctaatattacaaaacatttttaaaaaatagttgtgcattatattatggaatggagggagcactagctggctcacaatatgtgcaagtttctttgtgggtgaaagataacggttgcattaattttacaaattaccttgagcatgacagcttgagcaggtgggatggcgcggaacatgtcacccgctacatagttcaccacaccatcaccgcgtttattgccaatcacccggggaaagtccagcacggtgcacttgatatgtgggaacgcctcgacgatggccttcgccgctgcgccatcgccgccgcggcagtcggtcagcgactgcaccccctggaacacctcggaacactccctcagaaccgtggcgaagcccgagtggtcgtacgccgcgagagcttggttgaagaccgtgtcgacctccgggtggaggctcgccatgctctcgtcgaacagcaccgcgccgtgcacctcctcgaacggcgacggcggcgcggccgccggcacgtccttcctgaaccactccgcgagccccatcgccgcctcgacgaagtgcctggacgtcccggcgagcaccacgggcacctggcacgggtggccgtcgacgacgggcgccccgccttcgccttccaccaggagccacgacagcggggtgaggcggtacgtcccggccgacccggtggtgtcgtcggcggcggcgaagacgcccgagtggaccagcagccgcatgaggcggcggaggaatgggagcttggcgggcgggagggacagggcggcgacaaggtcgggcagcgaggcggtgccaccagcgcggtggatggcggtggggatgccgagcttgacggcgcactggaacgccatggacgtgacgaagtagaggctgtggcgccacaggtcggcctgcgcgtgcagcagctcgtcgtcggtcggtggtgccaacatgttgggagcctgacctgccattgaaatgagatgtactagcctcactctggtctgtggtctgtttgttatattagcatgggtgtgagcatctggggtttaaatacagtgaagctgtgagcagtgactctaccgtggctcgtgttcagcgtggagatagaaaatatattgcttagagtaggtacaatagcaggctataagccagctacaaacatattttaaagagataaagaaagagagagataagcagcgggctacaaatctgtagccagctgcagcacggacttcaagacgtactgtgtgtatgacaggtaggatcagatattaatagtatagtaagcaactattgtatgaattgattataatattggctatagatgatttggagctagtagttggctgtactattaaacttgctcttataatggccgaattaatggcgtttatatagttagatttggtagttgattttaatttatttatttatttatttttacatgtgtgcaccgtcatggcgatacgccgatacgatagagcccaaaagaagccatctacgagtaaaagcagcgacagttctgcactcgacgtactgttccctgtgcttatctctatggtcctgtgatttctagggacggatcgagttctttctatttcagcagtcacttcacttcatcttgagtatcacacgaattcatatgaaactggcactagagaatcggagcatcagccatattgatcaattgaccccctccctaccagaccggatctataatttagaggcctcgctgctaaacctagctataaataaaactagataattccctatgtgttactgcggactgttataaagattgattgctttccccatgcgttgtaaaaaacttgtctttcctgcttgcgtcgctcccatcgcgggcgactgggcgggcggaaaaaaccctagccaccgccgctttccccctccatcctccacctcgcccccgccagagcaagcggggccgagccatggctcggcgagcaaggacggcggcggcggggtaggcagccgtgaagcgacgagtcctctcctgcgcaggggatgagggacgacgtcctagcggcagctgcggcgtcccggcggcgagctgctccagcgatagcagcggggtggaggcggtgagaagaggcagcggcgagttggaatcggcatgtggcggtgtgggtgtggccggatatggaggggcggtcaaccggtttcggatctggctgccttcaccttggatccagaaggggaaggccgacgggagtggagttggaggaggcgcagtggtggagttggctggctgttgggagaagctggtagccggcaggtggaggaggcggtcaatccggcctatgccgaatctggtcgcctccatgctcggagggaggaggctggccataaggagttgggggaggccagtggagttgggggaggccggcagaaggtgctagtagaggtggccggtggagaggctgaaaaagaagatggccggagaggcgcagcaggtgccgttaggtggagtcgccacttggagaggccgatcgtttgctgcagttttgcttgttggaaagccgtgggacacgatgatcagcagtgtggtcagtgtcctggtcgacggcgagggttcctcccaactggttgttgttccctcctcccgtccattggagaccctacacctcttagactggcctacttcagtcgtggggtgccccatgttaaggagagagacacgggtttggttggaaggttctgcttggtgaagatcggaagaccgtccactctgtcagcgccttcaaagtccttgcagcagcgaggtgtgtggtgctcgaagctcttgtggcgcaaccgtgtggttgagttgggggtggagtcggagcttcttgcagtggcaagctcggcaacaataacccccttctctcgtccttggaagcgtctaagggttgtgaagcattgtggcggccttggtttcgtggttgtcagggagcaagagcacgggtgaaagccctgcttggtcttggactacggctgataacgtcgacgcctgtgggcgccgttcccttcctgaaggcgttgttgcttgctctccttttcttcgggtgaaaactttattccgattcttggacggacgttgtttgtgttctctgacgcttttccttggaggtttcgtttggaagaccctgccctacgttgtcattgtggtcgcctagctagttcgtagtttgttcttaagaagtcggagctgctcctctgagcttggcaacgatgacttttgtttcgaacttcagtagttcctcatgtgggtctttggccggtttcccttaattaaccacgcacttgtgaggttttcgggcccggttttccctaaaaactaggccacctctcttcttcttaaacgaaaacaggaactttcaacaaatttaaaattttgttaagatctttcaacatatttaaaatcgaaattattttatagtcaaattaagcttgcaaaactaaccaagtgtactgcaagtttgaaattgcaaaaaaaataaaaaatctacaacttgaaaatctaaatatttcagtgggaactgatagaagcgaaattgtggaaatttctggctgaaaaagttgaaagttgaatgaattttcgttaactaaaaatactcaaatttttggccgtaatatcctattgcaggggtgaaattccagaagttccattctgaaatattgaaccctgtgtactgttattataggaataatcactcgatccattacatcgctcattatactggcagagcatgtgaaaattgatgtttcggttttgctcgtgatacaaattaagaaagcaggtcctggggttttgcaaagaaaccttttatatccatcggtgtagttgcagctagggctgctttggaaccctccacagtattccagttttaatattgaacggtaaagtaaatctcaacaaaatcagagttacatatgcagctaatggtaaccctaaataaaaaaaatactgagtagctagctagtccttctgagtaaaaacagattagggatttaagagaatatatttgtaagcattaactttagtgacgaagacgtctacatctcctttaagcctacaatatgtgaaaaacaacttagacgcacagtaaaatctgcatataatctggcacggacaactgaatcaatctaataaaatagccaaataggtgtgagaactcattaaaacctggacaaggaggatgaattttaagcatatatgatccatcctcggtaggaagcacataccaaggtacaaacacagaatgcttgaggacgacaggagcggtgcaattcttcagaaaaacaacgtggattatgcattttcttctacatataccaaaaatatcattgaaaatttaaccatccaggcgcctgcagcaccagcaagaaaagcccaccggaatggaaattcctccaacgtgaaaatttgtcagtgaaatgaaaatttgcaatccagtttgcattagttcagagatagacagacagagattttcggcatatgcaatggagccgccttcagggagtttataaagaagaggataacttaatgattagtacttctcatgtggagaagctgaggaggacagggaggagggagattgagaagaaggctgaaggccattactgcgccgctgcagcttcggtaaataaatgcccccaatcagtttgttgaagtgaaggcgtgtgtaacagtttcaggtgaggctgtcgtctcggattccattgtagaggaaacgacgggaaagatgctagcagcggcggcctagtaaggccattcacaatgcagtgtttcattacactgtttcccagacgccacatcagctgaaacgaagatgaaacaagttgaaacgtacaatgaaacagaccttctcaatgctgtgtttcactctagcgtttccaatgcaaattcaaggcatttaattccagccacatagtgggatcgtatgtaacacaaacgtgtgtagccacttgaacacaaaacaaaatacatgcattcagcacagataggtacgattgttcacttgataaatttaaatgaccattcaaccaagttcactacatagcaaagtttagataactgaatagatgttaactcgaggtgaaatatgacagaactaagctacaaatgacgatgacaagcaggtaactggaggcaaattgacgatgcacccatagatttcattgattctttcaccctgtacaaatgaaagtagttcagacatgacaaacaggtttacacatgcagtagataaatattggaggatcacaattgcatagtaaagaaaataacacatgttctaacaccctgtagctaccaaaaaagagaaaaacatagtgatttgattctcagaacttacattgtgaagacaacagactggaacctgcaaatagatttttttttagggaacctgtaaatagattggaacctgcagagattaaaaaatatggcgatgagcattcagaaatttacaagtggaccatagatatataaattacaagaaaaataaaataattacatttactgattctcaatttccagttctatgtgcagcaccaccaaacttattccaaatgtgttccaccaaatctttcttaagtcggttatgagccgctcgatctcggatagaaatatctttttctaaaactctatcaaatggtgtgttctgttcaggagagaactcaggttcctgaacggttgatgaactaggaggcacatttagatctaaatcttcttcaataattctggtttccttctcatcttcaactatcatattgtgaagtatgatgcaagctagaacaacatctcgcagtacacctcgatcatatagacgagctggtcgttttaagatgcaaaatcttcgctgcaatacaccaaaggctctctcgatatcttttcttgccccttcttgcatatctgcatacaatttctccttttcagtgtttgggagtcgtattgacttaacaaacactgcccattcagggtagattccatcagcaagaaaatacccagtattgtattgattcccatttaccatgtactggactctaggagcttgtcctttgagctccttgataaatacagtagattggttcaatacattgatatcattgttggaacccgctgctccaaaaaatgcatgccaaatccaaagatcatgcgatgccacagcctcaagaatcagggttggcactttctgatctccacgagtgaactgacccttccatgctactgggcatctttcccaatgccagtgcatgcagtcaatgctgccaaacattccaggaaaaccacgtttctcaccaagttggagaagccgttcggtatcttccatggtggggcgcctaagatacctctcaccaaacacatcttgaagacctttgacaaaattcttcattgcctccattgctgtagtctctcctatcttcagatattcatctagttcatctgcgccactaccagtagccaactggcgaatagctgcagtacacttttgcagtggactgagtcctttccgattaacagcatccaccctttgtgtgaaatacactgaccactggcctaatgcctcaacgatgcgaagaaaaagtggcctagacatacgaaatcttcgacgaaaaattttggaagggtaaagaggattttctgaaaagtaatcattcactagttgctgatgtgcttcctctcgtggcctcttgatgtgcttcctcggatgatgtcgatggtcagaagcctcgttttgaagaccttctatagtggactgtactaccaccgtggcttcagtgagaagatcatctatgatctcatcctcagccaggaactcatccaacaagttcactggaacttgacttccatcagtattttgctcagacatctttgaagaagagagaaacagtaaagataaaagggaggaggtcttcgtatgagaaaagagggaatgagtttctgagaggagtagagagatggctaaactctgcataaataggcgcccactgcatgtgaaactgactgcctagtgcagcattcacactgcatgtgaaactgactgcatagtgcagcattcatactatatgtgaaactgacagcaatacatcattcacactgggtaattaatataactaaatattgcaccattcacagatatgcagctcagatttgacaaattcgtgatatgcagctgactgcatagtgcagcacagatatacagacaatataactaaatattgcagcattctttaattattataaataatagtgcagctcagattagattagatatctaaccttagtcagcaaataacttttcctccagcttttgtaatgccttgtctcggcgagccttctgttcttcagacatgttacttgtatcttgagtgagcagggaattgtatacctcaaacatctttgcttctttttgctgttctgctgccttcaaatttacgtttgaaatgtgaatctgtgcttcagtgaccttctcacgctccagcttccgatcttgcgtcactttgataattttttcaatattgtcccctaggatgacaattccttctgacatactgtccttcttgcgttttccattgcgctcggcttgtgctgcttctctaccaatgggacgcttttgttcatctggaatatcaaccacttcagccttgtttttgtccttctcaatcattgcacaccacttgggctcttttctcagtatcttccaccaatgcacaagtgcaaaaggctttccaaatgtatttgcatacatctgttgtgcctccttctccagcatgtcatcgtcatatccgcttgtattcatttgagttaccttagtccagtaatcattgaattctccaatcgatgatttgaggcgtgaccaatgaaccttcaattgatttatttcccttgtacgcttcccattcccttttctgttgaactcatcagtaacctctttccaaaacgtatcacctttcttttcattcccatgaatgggatctttagaagcattcaaccaagcactagccaatctctcttcctcatcatgagtccaatatctcaaacttctctttttagcacttgcatcattgattgcatcttcatgaatatcaatttggactgtattgttagctgcagcttggggtgttggtggtggagtagacattgtgttggtagtctgaccaacaaggtgaaaattttcaccttcttgtggctgcggcagacagttctgttggagaaaatttacgaagccttctgtaggatacaacctgaaaacataagaagcaaatccaattgaaaccgatggcagcataagaaaatcaaacatagtaagttccagaagatgatcctgacatagtaagtactgacatactaacaggttacttaagcatcatactgatgatcctgacatagtagcagtgctgacatagattttttttaataagatcctgacatagttcagtcaagcaagtactacagtatgtgtaaggaataattcagtcaagcaacaagttcagtcaagcatatatgtcaagtaacaagtttagtcaagcatacagaagaccatgtagggcaagctgttgctgtggttgcaaagaagaccatatatatcagtactaacaggttatttggttagctatgacgacagcacagagtgtagggcaagctgttgctgtggttgcaaagaagaccatgtctgcattccatacagaaggctaaaaatatataccaatgttaggatgatacccttggcatttacactcaaagcatttgttaccaatgtactgacaaggagatatttaacaagctttacgtatgtgaattacatgttgtacagtacactgtccagattgcaaactgaatcttttgctttcaatttctgttatacaagccgcaatccatactgcatactgaatactgaattttcactaacaaagtattactgcaatccatactgaatactacattttttctattcattactcaggcatatatcaaattaccaatgtactgacatactgattctaacaaatttcattgagcataaacaggaactaattactaatgcatgaagaagagagtcatatcatgtatcatagtgtacaatgaataatctgtgacaaggagaaaataccatgaacttgggccttgttggtttccttgcagaaaagcaaaattggggggtacagagccccatcctgctccttgcggtggccatgggggcatggttgacatcggtacagcaggggatgaactgggggcagcaacagcaggacttgacgatggagtaggcggctgaactgttgccggcgatggagcttcaggaggggaacttgcaggcagcggtggctgagctgttgccggtgatggagcaggcgccgacgacctcttcaggcccagctgcttgcccccacgcttattccctcctctgccggcggcgctcagacgggatccaccacctccttgtggatccatggctgctggacggcggacggcggcagatggacaggattcaccacctacttgtggatccagctccgcaatctccgctcgtggttcttgcgctagggtatgggacggacggggcgatggggactgagtctggcgctagggttgcaggtgagattggggaaaaaagcttcgagccagtgctttgggggcgggaacatggaggtgctgcgcgggaagatgggggactcgcgcgggaagaatccggcgatgcgcgcgaagatggcgaagagcagcgctcgcacgggatcccggaggtgaaacgatgaactctcaatgctgtttcaccccgtttcagtgacctgggaaacggcgctatctcgtgtcaccatggtgaaacgagtttactctctctcctacccatttcatgcaaatattgctcttttgctgacttgtcactgtattaaatgcgcatgacactcaaatgaaacacccattgtgactggcctaacgcgaagctcctcggcttcctcggttggtaggggagagaaactgaggaataaatggcctggtgggaaattgctgggctgtcctactcgcagcaatgttcattgggatacagaaaaggccatataggttgtgcatggtggagaaagaagaaatctcggacagacaaatctaatctgatggctaaaattaattgaagtgacgtggcttcaccatagggctggaaaatagcatcattgatacttagtggggatcaattgtatagatatataggattctttgttcaaaaaatattatcaatataaaatacccagttaagctgacgtgcgatgtttttaaaacactctcaatctaccacatagcatagcttaaaaatagagagagaataagagagaaacactactaaaaaacaaataaaggatacggcgctataggttatagtgccggaatagtaaaaaccggcatatataatgtttttctcacctcaaatgcgcatccacggagcgccgtcggctacaacagaaaatgatccagatgcgtagggagcacaggaaggcaagtgcatgcatgaagccaagacatcccacgactacaagccatacaactagcaagaccacacattctacaggtgtggcacatggggctgctggagccgtatctgtgaggagcccgagcacatcatcgacatattctagaccaagaggaaggccaagcacgtcatcgtcatcgccacggcaactccctccactactactccactccacatctttgccgctgcaacaggcataacacgtgaagagaatgtcaggcaggagcaaatgtttgtggtgctaaacacttatttattctgtttgagggcataatgtgcttattttgatttggcttggttgcattatgaacaactttaaataatggttttataagctctatgagagtacaacatttattccgtgatttgtcatgcatggctagaatttatttttgatattattacacttagttatattataaattattactccttattatgaaatagtgatgttttactttatttccatagacaatttgtatagcctatgttgaagaggaaataaacattgtgaaaagaagcatcacaaaatacaaaattgagagatgcaagacaagttcaatctgtgaaaagatttgaactatctttcgaatcgcacacagcgattattgacaatattgtttccctagagaaacgactatatgtcaatatccctaaaaattggaaaaaaaacatttgcacataaagcataatcattagaaagaatgtgaaatcaatttcgtcactaagaaatctaggctaaaagaagactattttggtagttatttttgttgaatcttaagaatcatgaaaattgcaatggatatagtacaaatacatctcgtatcatatgcccgaacgcaacgataagacaaatacatctcatatcatatgcccgaacgcaacgatgagacattatttgtcacgcacactgaccatgcgcatcgcgccattgttgggtcccaaaactaataattcggaaaccgacatatttaactgtatcaagccctggatcagtaagttgatacagcttcaacaatctggatcgtctttgcatacgtttagacatagctttgaagaagatattattacataaagtaatagggtatttacgagattgtggctaactattacagcagaagttttagaatgacctaactctgttgttttactatagacttaaaccatgtaaataacctagacttgaagattaagtaaaaagggaattaacttatgtgattgaactcctgacttcggcaagaacatctaatggactctgaaaaaggaggttgaagcaagggtgagtacaacgtactcagcaagctattatattaatcaacaatgaatgtatgaaatggtaatatttgagtagagctagattcaattgcagaaagctgagaatatagaggaagaaagcctgggatgtctttatgcaacagtatttagtaaagtcttgaattaggtttctaaccaaataccatatgagtcccgatactcaatccgtgagcacggctattcgaatagattcatttatactttactgcagtaaatgtacgctttacccgcaatccacgacttgccaatattcattagcttagtcgtagcccagccttaggttattaacaatagtggcacctgttcgatgaactctagtccccatgcgctctgaacgtaacgttatcagcagcgagaggagttctggcgttcccgaggtttttagagagaactggttgagagaccccacgtcatctcaattaggttttcacaatatacacacacagcgatcgcaatataatcaagatatttacctgcgcctcggtaaatatcacatttgcccttcgcggcataagtttgcctccttcgcgaggacttacatataagaaccactgtacagaggtaccacattgttaattaacctaataactaggtctatccccattctagaagctgcagtcgtactcatttgacataagtatttggtggcaattatatcgatcgagacagtactagccacccggaaatcaaccaaatcttaagtattgtcccaatctaagtttgttatatttttatgcaatctaactaggcatggctaagcaaaatctagcatatatctagtttgctatatgttcaagttatgcattcaaaatcatgaatggctaatgcatagaataaaactatagagtataggataattatgctcaaaggagagtaatgataacttgccttgctccaacacaaataaatccaagataggcaacctgattatccgatgctcgaaataccacaggttgccatccagaataaaatagactctattaaagaagagagagaaccaaattcaataaaagccataaaataacaagaaaacgatgaagagcgagaaaggctaggtttgggggtataaatatctccttaatgggttattgagctagtattttatacgtaggctctaaggggttggaggctaggttatagagggaatcaagattaggctttggtggaatagtggctagggtttagttgttctcgagtcgatgctgaaatagcatatcggctcgtatttcatgtttaagctatgggtagtttggagggtaaatagttggtatggagtttggatagcaggctggctagggtttcatttgattaagccgatatcgaggtaggataaacatcggcaagggttttgggtatttactagtcgtcatagaattgggtagtatgacgactaggtttggtgtctagccaatgtcagcagacaatgttatggctagagggataggaagtttgtgtaggtttagaggggtggaagtgttactccaacaaccgtgagtggcggcggagcggctaggatcacacagagcttgagagcaaactgtgtggcgtacagtggaggtcgagggaatagtgaagctctgatcgttatacgcattgaggcgtaaggtgtcagaagcaacactttgacgttaggtttgggttttgtcagactttacaaccaacgttttgacgtcggggtcagtagaccgtgcgaacgtccccatggaaggtgtaaagttccaaacggtggttgtttagtggctaaagggtattttgaaaataaaaggaaataattgaaaggtgaatataagtttcaattataagtttaaatcaaatatttattcaaatgatatttgaataaattaaagaaattcaaataaaatctttaaatagcaaatttggtatcaaaagtagggtttgaatttagataaatttaggtccaagtttcactagaatcagatctacggtttaggagatatgggcttctaaagattggaatttgaattaaatctagaaaagacgaaaatgtactgttcatgggcccacctgtcagcctttctttctctttttctttttcttttctccttcttcttccttcttctcgtcttccttttctcggttccagagagagccgagagaagagagaggagaaggcgagcggggcggcggcgctccggtggctggagggcggcgacgtcatcggccacgcatgttcccgctcactgcgcatccggggaggtcggtggcaagcagagggagcgagggagatggccggaacagcgagtagaagagcttatctccggcggcaagagaagtggctgtggtggcttgatgaagtgggtagggaagaggggaaagggaaaaaacggactcgccagatggaggcgaagccggtggtgcgaggagaggaaaggaggagctacggatggggagatcgaccgacgatgtcgacgatcggccatgggaggagagagagaaaaagatctcagagcttgagttctgaagaggaatggcgagtcttgccgtctatttatagacgactaaaggcggtggctaatgacggtttcggaggaaaaggagaaggggagcacggcggcagtggcgtggagaggaggatgacggtgccggctttgtcttccgattggtcgacatttgcggcgcgcgtacgtggcggccgtggcagagttggacggcggagaaggagggcacggcacggcgatggtggcggcgcaacttggcggcgaaggcaggacaacggcgacggcgcaccaaatggcggcggccggttccttagcggcgacggaaggcgttggcggcggcgtgcgcgtgcacggcacgcgcgcttgctatgggccgacttgggccgcgcgagagagaagaagaattctgcccaaagttgaaaaggaggaagtctaattttcctagagattcaaataatagatttagaggaatttggatggctagattttgaaaaaggatttgaataatttgaatttgaaggaaaaatgactgagagagagtttagaaggaaattatatttgaatataatttccaaaagaaatatttctccagttggtttgaggagtttatttaatatactcaaatagaaattcaaaatattcaaaaccataaataatatggctctagatttgaatatttttgagtggagggaatatggagggaatagagtaaatagaattctagcccaaaatatgtggtatgaaatttaaagaattagatatgggctaaatgaggttttgaatttggggcggagggataaagtctattctcttagcacaagagcaattactcacaatatttgtaataataatatttcttgtgccgaagagggaatcaagccacagggattaaaatggtggctagattaaaaggagaaactcgaatatttggatcgagaatcaaatgataggtttaagatcaaaggatgggttaacaattaattccaataaaattggaattgctttggtttaggttctagcacagtataggatggtttcttggaccataattcataatagtaaaaagggtttttcaaactaaatttaaataaaggaagttttaggcgaaagaaggttttagattaaaaccaaatcaaggaatatttcaagataaaattttaaatgaaaatcacaaaagcttttgaatatcaaagaaggattttatgcaggttagctttaggaggtctcgctaattataatgtcctaggtttaaagaggttattaagaacataagacccggcatgatgcaagatttgaaaatagctaatttttggtatgttacagccattcatcggcatgcaccacgtcacaccgtgacgcacaccgaggccagcaccagcgctacgcgttggacgttgcactgtgcaccgactagcaaccccgttgtaccgcatgccagccaatccgtgccgtattagccatgcgtgttacaccgtcagccacaccgtaaccacactggtcgcatacctcgtgccactttgattgcgcataccgtcgaaccttggacgtgcatgaagcacgcaccaccatgtcttgaaccaaagaaaaattgatccataccctacataccttgaaaggtatacccaaaatagaaagaaactagtaatatctgcagacaaattccgggaaataacgtgcttacctatttttgacactatgctcttgccaaaccgatatagcaagaacacacatattgtcataagcacactaagaaaaggcactaagtactggatatccacaaaaatggagtaaatactaaggatggattaaaagggttcgccacaatgttattcaaattcccgcatcttgaatggacatgcagtctcaaaagcaacgaattatcaacatttgaaccatttgaaatgtgccatccactcaagaatccaagtggtggtccctggtacatgtgcatatctcacgaccacagtatgagctcttttcgaaagttaggaagcttgaatggaggtatgtatggagcctaaattccttgactaaaaggagacttgtttctagacattgaggaggagaaaatgaacccttaagttgtgctctttaccctattttcccaactcaccctacctcatttttctagcacacgcttcccaaactgctaaccaatgtgttttttgcaaaaaaaaaaatctatactaaagttgctttaaaaaaatcatattaatccatttttcaagaaggattagctaataattaattaatcatgcactaatgagtcattctgtattgcgtgcgtgagggattccaacagccaaacccagtcttagatgattcttgtgagaaaaatggttaaacaaaggattattgcatactcaatcaagctctaaggaatgcaaggcatcaaaagaacagatgtattgtcagaatttcctatcgtccttaattacttttgtgattataagagcatgactaaattgcatctaccctaatgtaatgaacaagacgagggtgaaataccaaggaatgtaaaggtataaggaatgtaaaggtatctatcatcttgtctagagacgtcgaaaataatatgccaagaactccagctccttaaatccttaaagtaattagagacatctggtgaaaaggaacaaatgtaactttcata

SEQ ID NO: 31231 - DNA, 598 bp, Oryza sativa
tttagcaggatccactacaactccaccggctgagattacgtggcctacaaaggcgacttcttttaaccagaactcacattaactaaactgtgcatataatttatgcttccgaagttactcgagtaccaaccgcaagtgctccacatgctcttgctcgtctttggagtagattaaaatatcatcgatgaatactaccacaaatttgtccaagtaatccatgaacactttgttcataagattcataaagtatgccggggtgttggttaatccaaacgacattactgtgaactcatataatccatagcgtgttgagaacgcagtcttgggtacatccccggtcctaattttcaattggtggtatcctgatcgaaggtcaatcttagagaacaccttagctcctttaagttgatcgaaaagatcatcaatccgtggaagtggatacttgttcttgatagttacttcgttcagtgagcggtagtccacacacattctcatgctaccatccttcttcttaacgaataacactggggctccccaaggtgacgaattgggacgtacaaatcccttctcttgcaactctctgatttgctttttaagt

SEQ ID NO: 31232 - DNA, 776 bp, Oryza sativa
aatccgtgaccgtctaaaagtggcacaatcacgacaaaagagttacgctgacacccggagaagagatctagaatttaaggaaggggattatgtatatctgaaggtttctccgatgagaggtacaaaaatgtttaaggttaaggaaactagcaccaagatatgtgggaccttttccaatcatcgctagacaaggagaagttgcatatcatgtacagctccaaaaaaatatcgctgatgtgcacccagttttcctgtgtctaattaaaaaaagtgctacaagtgccggaggaccaagctccgttggaaaaaattcatataccattgatctcacttttccaaaccacccagtccggatttgggatgaaccaaaaaaaaggactaggaccaaagtgtggcgtatgtccaaggtacattggagtattcttcctgaggatgaacccacttgggaaagcaaaaaattcttggagacagattacccgcatctaagcgaaatccaataaaaaatctcgggatgagatttattaaaggggggtaggtttgtaccaccctgaaaattcgaccaataaaaacaaaactctaaaaatgcggaccttcgaaaactttttaaattaactacatcatgccgattctattcgcctattttatttggatttgatttcgaaattcattagtcgtgagtaaagaatagttaattacgaataaaccctaaaaataaattggcaaaataaatataatttaaaataaagattagtgaggatagaaattaataaaatttt

SEQ ID NO: 31233 - DNA, 701 bp, Oryza sativa
acggtaatttttcggacttcccgaaaagcacagagtaaaacgactataacttttcacccgggagtccctttttgatgaacttggactctatgaaaagctcactcagaggattacccaactcaaccaaaaagaaggtctaaaaccactcaaatgataggttaatgcttgggtttctctcgaggtagtactatgatagctcactttgagcatcgaggcatacacaaacacctcgacgttacatccctcttaatagtacggcattcctaaactcaaatgtaaataagaagataattataccattaggaatgcctttttttcatctttctttcattgtcttgagggacgccaatgccgataccgtttcaccatatattcttcaaatgattgatgcggttacttgtagcttcaaatggtctcgcacggtccatcatgacaaagtcgtcactcgcccttcaccaccggatttggttcttcggtgccaagccccttgcttgcccttcaccgccgcatggtccatcgcgaccgagtatcgcttgcccttcaccgtcttgccataatagccacttcatatcacacatcttcaatatcttcactttgtcattcttggtattattaggtgtaattgtatcacttgagcatcaacacctttgtaatccttgggacctatttctttcattcaactcaataaaattattagtccc

SEQ ID NO: 31234 - DNA, 385 bp, Oryza sativa
agaagtatttttgctgctcgcattatctaattaagcattggattatctgcctgtcagggctggaggagggtaagctgagcagcacaaatggcaacgcctctgacccaccagcagctgtaagcacctttccttatgaactcgagtaatttatcctgcgcagcaacagcgcaggttgttgcgtttggtttccaaatggaagaaggctgtgaagtctcaacttgtgtttgtgcaggatgcggcggcgcaagaccactccgtggcgtcgatgctgcggaacgcgagcacgctcggcgacagcgtgctgctcatcgccgcgctctgcttccactccgtcttcgagggcatcgccatcggagtcgccggtaagattattattatttttttg

SEQ ID NO: 31235 - DNA, 922 bp, Oryza sativa
atcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccttaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatatttgtaaattgggtacaatatgatcaaacgtattgcatgacttgccttgctctcgcactgacgagacctcagcaacgtcttcgagaaaccgtggatcgacaaaacggccgaaacctacgcgacaaacaaagcacacaagcaaaacaggctataagacaactgaaacagggaacaaaaccattttta

SEQ ID NO: 31236 - DNA, 743 bp, Oryza sativa
atgccacctccaggagtatgaactcgcattggtatcttaagcttcactaaagataacccatgtgcaccagcaaaaagcttggaaatgaaggaatgggttgcaccagaatcaaacaatattactgctggtgtcgagttgacggggaatgtgcccaatataacctctggtgctgactgcgcctcctctgcagatgcatgattgacccgggcctgaacgaacttgggtccagcacgtcttggcttcgagcactttccaaccgtgtgtccgggtttgttacaattgaagcagagttcgggcttttctcccaacctcttgggctgttctggcagagctggctgaactgattgagctggaatctttagtgaactcagagtagggttgaggctgtgctgctcactgttgttgtgactatcactatggtggttcttgttgaagctacccgggtggtagggacggtactgccggataatcatggtggaaggtccaccgtgatgtcccattgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtaacgcgcgaggaggttgaa

SEQ ID NO: 31237 - DNA, 518 bp, Oryza sativa
agtccaaagtccatggcctagggtaaaaccaaaaaaagaagggggaaataagttataattcacatggcaaatgatgatttactttcttctgatacatttaagagatgaaagttacttcagatgaagacatgaaacgatccctctctgtccactgttgtaccatatccaaggtttgcccagtaaaagcagcaaacatcttatcaactttctgcatccagatttttcagaagctttaatcgcttagagagcagaatcaagagaaattccttaccctcatcaaacatctaattcaaatgtacactgaagaaaatatagaacttgttatctatcacaaaacacttacatcacgagcataaatggtttccccaacctgtcgcctcacctcctccacattaccctgcaaatcatccaatttttagaataaaaaacaaacttcaagtacaacaaacacaaaggcaagcaagtatgtcctagcaagactgtatattgtaagtttcatgtggccagctaaaatgatg

SEQ ID NO: 31238 - DNA, 515 bp, Oryza sativa
acgtcttacaaacatcataaagtcttacataaatacagcggaaaattaaaagataactggagctaagccttgacttggaccgcagcgggatcaccactccacaggcatcatcgacggcacggacgaagcctactcctcggagaagccaccatttgacgcatactcaaactctggggtttggggaaaatagagcaagactgagtactacccactgtactcagcaagtcataccggaataggggtatgatgcagggaattatcaagggatagctatagaggttcgtttgcataaagcgagcatttataaacagtagttgaaagtagtaaaacaattataataattaatcaatattaatcatccactgtccaacgctataccacgttgcaacaggcccaaccacccacctatactattcaattccattagactagactagggtgaaactaatcacggtgaatctggttgaccgcccataaccgcgggcatggctattcaaatagttttactctgataa

SEQ ID NO: 31239 - DNA, 688 bp, Oryza sativa
cggtgtccgtggactcccactagttggcatagtggagttcattttacaagggacatgcaggtattttagggatcggttccaggcagttcttccctctatgccgaacaacagcattttattcggaactttcatgcagaaaaagctagaggagttgcgtaaaaaggccatgaaacatcgagctctagtgcaaggtacccaacagcacaggtttgagatactttgtcaagataaggcaggcaggggtatctaccgtaagagagtgaagcaggaatgtgttctcaaagccgacggcacatgtcattgctcttgtgcaaagccgaagctgctccacaggccatgcacccatgtcattgctgccgcaacggagtgtggcataccatatgcagtatatgtgtcacagtacttcagtaagcaagcagtatatcatacatggagtggcgagatttatgggttcggcatagctggggagttcacagagactaacaatgaagtactaaatattcctgacccatcgaagctccgaggcaaagctggaaggaggaagactcgtcgcatccgcaatgatatggacgagtcggaggctggcagggtgaagcgttgcagcaaatgcaatgaatgtgggcacacctacaagcattgtcctaaagacaaggagaaaccaaatgcggcgggaggcaggactatcagg

SEQ ID NO: 31240 - DNA, 1815 bp, Oryza sativa
aaatcaatcatatgttttatgaataataaggatccgataagctatggcacctcaatctttttttaatttattcctgttttttatacgttccaaaaggaaatagttatacattatgcccagcgaattagacaaaaaaaaaacaatcgaattgcaaaaaccactgttcgagattcgagaaagacatagccaaccctaaaagatatatactggagtagtcgtgtgtgttttagcacatttacacgtggtcgatttcctagttaatttttttctctgtcttttgttaggaggaggaaaaaaatcgatatagctaagtagcgtcgacttgggttgactttgatgaacctgaccatacagatgtttggtgcatttgcatcattgcatgtatccaaggagaccatggatacacatgcctggtgcagatcgatacaaagatttgggctgaattctaaggaataattaattatttgttactcttataaataatgataaaggatttaccattgaacccatatgtcatagacgcatcttaaagtgacaaaaagttaaatgtttcgaattctaaacataagttcgcctatttttttatttatcgtgagcacacgtgtttcgtgtttaaaaattttctttaaaaacaataaataaatctaattttaagtttataatattttatatttaaatatacacatttcgttctccgtgcctcaagtttcgaacaaagctactaggaatttgtcctcttgattcgattggcaatgtagttctaggaatttgctgctcgcctgctcggggccacagagggttacgggctgggctgggctatgtctgggagcatagcagacaaggctgcaggaaccaagcagcacagcatcaacagcaggttggcaggcagcccatacacagcctggcaaattaagtcgcaattccgtcctctcgacctgtttccgagagcacccaaaattccatccctaaaatttatttttttaatcctaaacataattttagatgtgaaaatattaatctctccaaaagatattttaaaattaacttaaaaaagacccacccattagtatcaacagaaacacaaaaagaaatcgctccaccataccttccctacgcacgatctcttctcacgtgtcatcctcttcctttgctgtgcaaaaattgtgaacgagtgcctcctcacttatgaagaacgagaaagaaggagaaggggattccaattttgagacacatatgaggaaacgattggagcaaggttttttttttaagaaaaaaagcccaaatttttggattgggcttcaattagggtttgattgaggccgttcatattaaatttgagttgtttcatacaagatttgttcttaaaaaaaacatgctcactcaagacactaataagtgatgttttagacgtcattaacacataattgggaaaaaatatgtggtagaaactatatatatattgaaaacctgaaaactaccattagataaaaatagacatatgagatttgtccatgtcatcacgagtaaaaattttactcgtagatttactctcatgatgatatggacgaatcttagacatccatttttcttagtttttcactacatattttttccccatataatttgaaccattaactatatcttatagatctgaatagtttcataaacaaaccataatattacaaaagctttggttacaacatttttggtcatgttattttcatatgcctaagacccatgttaaaaatataattacagtcaaagttatctcctattaacggtatggagtttaaatgatgtatttatttgtaactg

SEQ ID NO: 31241 - DNA, 522 bp, Oryza sativa
cgaagaaattctagcagtttggactgaggaggtggagaaccaaactgcaggttctgctgctgcagctgtgcttgctgctgcacctgttgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaaggggataggtagaaatatgagaaaaggaagaaaaacagggggctcagaaactaatctttcttatgaatttaagtgcaattatcttaatcttgattaaaacactgaaaaagaggcacgcaactcctaattgaggcagtcataccactgacacatgatatcgaccgccgactagcccacaagcatcaaacctaaacacgaaaactagcaagcaaacagactaagaa

SEQ ID NO: 31242 - DNA, 699 bp, Oryza sativa
  unsure (1)..(699): unsure at all n locations
tcacctttggtcagtaactggtaattgctaattgctcacagatcacctactcacctctcggctgcacggctgcgccgagaggtggagctcgccgccgccggcggctgtcacgtcgccggccgccaccgccggacctccccgtcaccccgtgagccgtggcgcctagaggccgctggagagaggaaaggagagagatggaggggagatggagatggagagggaggaagaagatgaggggtgagtataacatgtggggcccatgcgggtcccactattttttattactttatgtgtgaaaatgacatgtaggtcccacatgctttattatttttccggatcgaattgccacgtaagtgcctcagtgtcacgtcaaataaagaccgagtcaaattagccacgtaggcatcacgtcagccaaaaccgctatcaaaaccgccgagagaccttgtttacctggtttttataagttgggggatgggtcgtatccagttttgcggtcaagggacgaaatcggacagggcgacaaataaagggacccaaagtgaacttattccgcaacagccaccgcgggcggccacgcgggctggaccagcccactaaactggcccaggcatagaacggagccacccggccacannnnnnnnnnnnnnnnnnnnnnnnnnnnnnnnnnnnnnnnnnnnnnnnnnnnnnnnnnnnnnn

SEQ ID NO: 31243 - DNA, 1070 bp, Oryza sativa
  unsure (1)..(1070): unsure at all n locations
gaccattggagctcttgcatatgaatttgtttggcccaccaacctataagagcattggtggtaatagtcattgtcttgtgattgttgatgattattctcgctatacttgggtgttctttttgcatgataagtctattgttgccgagtttttcaaaaagtttgcaaaaagggcccaaaatgaatttagttgcactcttgtgaaaattagaagtgacaatggttccgaatttaagaataccaatatcgaggactattgtgatgatcttcatatcaaacacgaactttccgctacctactcacctcaacaaaatggtgtagtggaaaggaaaaatcgtacattgattgagatggcaagaactatgctagatgaatatggtgtttccgattctttttgggcggaagccataaacaccgcttgccatgcaaccaatagactttatttgcatcgtctcttgaaaaagactttctatgagctaattgttgggaggaagccaaatgtcgcctattttcgagtttttggttgcaagtgttatatttaccgaaatggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaataggggcacgagaatttggatgttgtaggtgatgaaggcttgatgagagttatgaagaacatgtctattacagatgtcaagtctattgaagtgaaagacaagccatccacctccactcaagatgagccatctacttccgcttcgtcaagtcaagctcaagttgaagtgaagtaggataaggcacaagatccacctatgcctccaagaatacacaccgctctttccaaggatcacccaattgaccaagtgttgggtgacattagtaagggtgttcaaactcgatctcgtgtcgcttcgatttgtgaacaaaactcgtttgtttcttgtcttgagccannnnnnnnnnnnnnnnnnnnnnnnnnnnnnnnnnnn

SEQ ID NO: 31244 - DNA, 727 bp, Oryza sativa
  unsure (1)..(727): unsure at all n locations
acaacaactacccgccgaaacatattccgcctcgccggtagagagggctacgaagttttgtttcttggatgaccatgacacaagggatctaccaagcatttggcaactaccggatgtgctctttctatccactttgcaaccggcataatctgaatcggaatagccaacaagcttaaatttagcaccttttgggtaccacaagccaatagtataggaatgctttaaatccttttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcgagatgtccgttggttgccataggtgtcttgatgggcttcgcatcctccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttcaacttgtgtgaaaccttgcgccaccaaccttgccttgtttctcaccaccaatccactttgttcctaaatatccactttgtnnnnnnnnnnnnnnnnnnnnnnnnnnnnnnnnnnnnnnnnnnnnnnnnnnnna

SEQ ID NO: 31245 - DNA, 604 bp, Oryza sativa
cctccggtctcccccgccctcttcgctttgggctgaggccgccgtgctcgcccagtccttttcactctgcccaaggtggcggaaacccaaattgatggagcgatgaagatgcagatggagttgttggtggggatgtggaacttgtcggcgacccacgacatctccggcgcgcgctgccgcgtccttggccacgcaccggaggcggttgtggaggtggacggtgtcggcctggaggtggacgtagtggagcacgtcggtgacgtcggcggcaaccttgaggcgagactgccacgacgcgagcagggtgaaggacgggttgttcgggttgcggtggagcgcgaagagcggcgacgcgtcgaggaggagctcgtaggcgaggaagagcgagccgttgggcgacgcggagacgccgaggaggcgcgcgatggcggcgtggtggcagtggccgaggacggcgaggcgggcggtgacgtgcgcctggtcgcgcgcggagcgggcggcggtgtaggatcgaatcacaagaactaagccaaccagagggggggtgaatggttggtatacccaaaaaccgaaaacttttagcggaaataaaagttaccctcaa

SEQ ID NO: 31246 - DNA, 678 bp, Oryza sativa
tgattgaggtagagctgttgcatctctccctctctataaactttgaccacacttaacaaattttgtttcattttattatttcaggcaaatgagatattgtcatctttgatgttcgcctcaggcaatatgctacaaatcaactaactaaggtatgtaatctctgtctaatctagtgttgtactgttgtgccattttaagccatcatgtaccaagactccaagacctaaaaatatgtgtggatcgtataagaaagctggcagtgaaatactaaaaataacttgtgatcatccaacagtcaggtgttaggcttgtgagaggcattgtgaaggatgtacaacccaacaaattaatcctggacaatggagaagaggttccttatggtttgctggtatggtctactggagttggtccttcatcattcgttaagtcgttgccatttccaaagtcaccaggtggaaggtattgtaaattggcttgaccgtatggagtttcatgtatatgcatcatatactgaatgggatttgattatatgcacctgcgcaccttctgtactttgaggaatagggatatatatatatatcttctacatgtagttcatttgtgaatcaggtttcaccatgcactataagaagcttctactatctataggcttttggtatccacccaattactggtgta

SEQ ID NO: 31247 - DNA, 695 bp, Oryza sativa
gtcggcacgctcgagttccgctcggtcgcgaagcttctcgcgcgcatcaagccagccgtgtcaaagtccaccggctcttacttcctcatcgcccgttgcaccgccgtcgaccccgacgctcacacggtgagacccccatagcagctctgggttggtgtgtgcggccaaatggccactggttttacagacgtgcctgcgtggggaatgcctgtttccaacattcttggaggagtgatcaaaatgtgggaatgatcgaagctcgatcctttctatttttcctcgtgcagaatcgatacttttgacctttttgaataggggagaggagtgaatcggatttctgggctttgctggaggaatcttgactttactcatctgcatcgtgatccatccacagcatgtgctgcgtgtctcttaagtagttgattgagtagttggtgagctgccttttggtcacatcgaaggagaagaaagttagaccaataataatggggaaaatagctagagaacgctgctgaacttgcgtatattcacgaattcatctatggttcgtcagattctatgtgatactgtatttattgtttagtactccatccggcccaaaatgtagcaacctatctagtagagtactaggttgctatattttaggacgaaatagcttttgcctggaaaagaggcatggtacttcgtgaatattc

SEQ ID NO: 31248 - DNA, 742 bp, Oryza sativa
ccctccatccttttctttttcagggatttaataaatcatttttcctttgtcccataaatcaattccttattccaaaatcccataaaccatttcctttggtcccgcgtgacaatgactgtcaataatattcttgagaatattataaatttcataaaccatttctcctattccagaaactccaattaaacttctaaaaattcatatcacccaattcgcaactccgattgactccgttccacttccagtattttcataaaattgagatctatttaatggcactactaattagtctaaataggatctttcttttggtctcttgtttaggttttcgattgttgcgtatagttgcggttatcggtttttcgtcgatcgcgggttttcccgaagattcgtgaagcttcgtgaagaccttgagcaaggcaagtcaccctttgatcaattgcccctataattgaaaagtcattattattttatttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacatgggaaataggtttgtgaagccttcaaaacccgacatgtggtgtcggtgtgtttgaaaac

SEQ ID NO: 31249 - DNA, 704 bp, Oryza sativa
  unsure (1)..(704): unsure at all n locations
ggcgttggggctccggtggcgctacggcgacgtcgacgacggcaacttcgcggtgcgcggccgcgcggtgccgctcctcgtggcgctcctcttcgtcctcgtctgcttcgtcgccgtctccctctacctcgactgggcgtgccactgccaccgctacgaccgggacacgacgccgatgcccgccaccaccagctccggcttctcctcgtcgcacgctgcggcgaccgcgccaggttcagcctcatcggtgaccggcctcgacgacgcgacgatagcgagcatgcccgtggcgctgtaccggcccgtggcgtcgactgcaggtgatggcnacgacgtcggcgccgcgcagtgctcgatatgcctcggggagttcgaagagggcgagaaggtgaaggcgctgccgctgtgcgggcacgggttccacccggagtgcgtggacgcgtggctccgctcgcggccgagctgccctctgtgcaggagctcgcttctcccggccgcggccaccaccaaaccggacgtcgccgggagcgatgctgtctgatcatatgcacgcacagggctcgctcggtcgtcgcatgtaaactgcgccgtgcgcccgtacgtgcacattccattgcattgcacccgccggtgcctgggctactggtccgaaggttcaggcggtggnnnnnnnnnnnnnnnnnnnnnnnnnnnnnnnnnnnnnn

SEQ ID NO: 31250 - DNA, 724 bp, Oryza sativa
  unsure (1)..(724): unsure at all n locations
aagaagacggacgtgcgcgccgggtcgatgttgtcgttcacccagctcgcccacgtcgtcagcaccttccgatacgcctcgatcctcacgacctcgtcatgctcctcccagctctgcccgcccggtctcctgcaagatcacccctatcagtcactgtcatcccacgatcgatcgccgttggttgcacggcacggcgttgtgatcgatcgatatatcgtgcaacgtaaatttagcgtacatgatcttcatgttgagggtgttcatccaccagatgtaggtgttgaagacgaggtagtcgacgccgcgccagttctgtgcgtgcgccgcgatcgcgtccgccttgatgatccggtgctggatgctgtggatcttggggtcgtcgtagttggactccaccaggaacggcgcccagtagaactccaccgtcgcgttgtactcctgcacgcacgtacacacgcgtcccgacaattcagatcacaacaggcctcgacaacacactatcagaaaccgacccggcggctgatcgagcacaagttggttcaccggttctagctagccaccgccaccaccacacaccaactgctccctggtctagtcgcagcacccgtgcgcgcgcgcgtggacccggcccgccgttggctggcttggctagactagacagatggggatnnnnnnnnnnnnnnnnnnnnnnnnnnnnnnnnnnnnnnnnnnnnnnnnnnnnnnn

SEQ ID NO: 31251 - DNA, 1087 bp, Oryza sativa
ttaaatataggcttaaaaatacctaattgcacagattgcgactaattacgagacgaatcttttaagcctaattgctccatgatttaacaatgtgttgctacagtaaacatttactaatgatggattaattaggcttaataaattcgtcccgctgcttactggcagattctgtaattagtttttttattagtgcccgaatgccctatacgacaccctatataatatccgatgtggcacgccaaaactttacacccctcgatctaaacaccacctttgttgattgagacagagatgccatggtaaaatgctactcccttcgtttcaggttataagatattttgacttgccgcttcaaatttgatcaagtttatagaaaaaagtaatattttcgacctaagataaatttattataaatatatatttaattattaatttaataaactaatttggtaatgtgaatattattgtatttgtctataacgttagtcaaacttaaagtagtttgactttggtaaaccacaaaactgaacaacaaaacctaaaactggagggagtataccacaaaaaaaacataatggacaacaaaactctcacagtagccattagccaaagaagatgtcacggatgtagacaaattgaacagttgttgattgagccagagatgccatggtaaaatactagcaccatattggacgacaaaactttctcaaagtagtagaaggaaatgtcacgggtataggcaatctcatcatggtaggaaaacagcatctgaggtaagttgctctacatgttgtcatttgccccgatgcgtgcactcttctgctgaatagctccaccagaaagttggtgttcattgttgtgggctaacaatgtcaagaatctgcaaacacagaggaaacaaaaacgtgcaagtgtctggttaattaacttagagttaacaaggaatatcttgtggatagaagagcaaatgcaacggaaagagaaaccttattggtgaactgttgaaaaacttgtccttccatcaatttctctaattcctgaggatgaattaatgagggagtgggcatcataaaataaaggtggtaga

SEQ ID NO: 31252 - DNA, 428 bp, Oryza sativa
aggtgtattgggggggtagcaccggaagagagaggaggccaagggcaatcgattcaatggagcggattagccgggggaaaaacgacgccggctggcggcggcgaccaatctcgccggcacgccgacgtggccacgcgcgagaagagcgaagggcgcgcgggctcgggctaagccgaaccagtacgcgaccgcgatgcgcacgcggggacgcgggacccgatggtcaccggcggcgcacgcacggcggcgttaggcggcggcggaagcggcgacacggcgcggagacaaaggagaaggccggcggccttggggcagccagggggaggtcaaggggatccccgggagcgtggcggcgagaggaatcgacgcgagaggagccgacgacggcggatttcgacagcgatcgtcggcggcgagcaaagagggaa

SEQ ID NO: 31253 - DNA, 739 bp, Oryza sativa
gtggcgcctttagcctttgtccaatttttaagcgcacttagggataagcattcggtctaaccgagaaattcgattctgtttctcggtctttttaaaatttcggtcataaaaaacttaagaccgatcggtcaaaaaaaaaactgaggaccgagcacttcggttttcagttagttcggtttggtctcggtcatgaccgaataacccgagcagtctcaaaaaaatcacaaaagccaaataacaaatataaggttgacaaatcaaaagcaactcaatagatcaagatgcatatgcaaatgcagattcagaaagacaaatcaagctctagcctctatgtttgaatcccgtcaatctccaccaggtgcgccgaatcctacggccgcggtggtgaaggacgacgccggcgtggtggaggcggaggcggcgcgatggaggcggagggcgggcggaggtggaggcggcgccgacgcggtgggccgaggaaggacgaaggcggtgccggcgcggaccgcgcggtggagggcggaggcggaggcggaggcggcgccggcgcgatgctggaggctgcgccgacgcggtgggccgtgagcggatggaggtggcaccggcgcggtggaggcaggcggcggcgtggcatggtgctggagtctggaggctgtgagcgcgagtgtgaggagtccgggcgtgcggcgcctgtgagaaaattgcatatctaccatcccataagaatggcttcgctaga

SEQ ID NO: 31254 - DNA, 1394 bp, Oryza sativa
  unsure (1)..(1394): unsure at all n locations
ctatatattatagcattgaatatgatttgggttggtttcagaaataaatgaatatgatcctggtgacagtggagtcaaggcctagatcaccattcaacctttcttcttcttttgaaaacgaaattttcttatatttttatgaaagggttacctggctagcttttcggtcaagaaactttcagggtaagcattgtccgggcgtacaaagcgacaatagaatgccagaaatgttggtgattccgctatgttggtgtcgctctgtcgcttctcctgttctcctctcatgcatcgacaggaccatgggccatctgttgttaagcgagttatttgttactgctacttgtagcaactaaatctgatttcctgggctgtctcttactctgttgcattccactgcattagttattcccatttgaccaagtttcttcagtaaacatgtatatgttccttagcctaagatacggagtttgcttctgcaaatgtataccatctccacattgtcatcgctcgattatacgttatgactacagaagaaggttacgttttcacgccaaagtcaaaaaaatcaaggtgtgtttagttccacgccaaaattaaaagtttgactaaaattggaagtttgaagaaaaaagttagaaatttatgtgtgtaggaaagttttgatgtgatgaaaaagttgaaagtttgaaaaaaaagttagggctgtgtttagatccaaagtttggatccaaacttcagtttttttccatcacatcaacccgtcatacacacacaacttttcagtcatatcatctccaatttcaaccaaaacccaaactttgcgctgaactaaacacacagcctagcaagtttgtaagtttggttgaaattgttacgatgtgatagaaaagctgtgtgtgtataaaaggtttaatgtgatggaaagttgcaaatttagaaaaagaaaactttggaactaaacagggcctaaaccaggcctaagagctttgcagtccattgaccaggctgaccgagctagccagtaactaaaaagtaatactaatgtatgttgattcagtcaagcaagatcaattgttctataatctggatcaattatacatctagcagttcggttgcaatatccttttcggctcaacggcgtagctgtacttgtggggtgacacttcaattccagttacgccaatagcccaaaatgccagagagaaaaggatacacctccggtggtctcgggtgtcacgtactttacttttcttcgtcatctccggtatttttcgtcatggaacgcactgaatcttgaattattaactcacgaaatcgatcaaataggaaataagaccaccagcaaggccgtgctagnnnnnnnnnnnnnnnnnnnnnnnnnnnnnnnnnnnnnn

SEQ ID NO: 31255 - DNA, 1300 bp, Oryza sativa
  unsure (1)..(1300): unsure at all n locations
nnnnnnnnnnnnnnnnnnnnnnnnnnnnnnnnnnnnnnnnnnnnnnnnnnnnnnnaaaattccatcatcagcataggtgtgtgtggttaaattttagtaaataaaaggaaatcaggtttgagtaatagtatgtgatagctatttatcaacagaaaataaaccattttgaaagcttaggatgaccaatatttcagcaccagtactagtaattgaatttgtattatatgagataagccatgaccaatcatgttgagatgtataatggccactgtacctcagccttcctttgtgcccttgcttctccctctgcctctatgccatcaagtttcagcagctccatcataagaagctccgtcaagacaacaaaatctttatcctcaatctttctccctgcaaacacactcttctccaaatcacatacctggtaatagaacaaaaacaaaaaccgtatcagcatcaagatataagaagagttaatgtttaatggaagaggctggagaaacattattccttcaccttggcagagagtctgtcaacttcagctcttacacggccaacagcctcacaagccttcatcatgctctcatccataattactggctcggccctctgctctacattggcaggggcaggcttctcaagtagaagaagttttgttccattcttgaccccagctgtatgcaggaactcattgtcactcttctccttcccacggaagaagagcctctgccttccaggctctacgccagttgcctgggtaaggacccctttcnattcactttcatacaaaagagtgaacaattaatcctacctacatatcaaagcaatggaaaccagttccttctaaggaaccagatcatgatgtactgcttctgcgaactactccaaaaattcgataagagaaggcttctttcaaacgttgaactatataacattgagcttccatctgtacagaaaatgataaaatagtgtaaatttagtaaatcacacaacctcagttgagccagtatgtgcacctatttaacgtcatgaatgaacaggagtgtactaatacaatacaacggtacaacagttttaacgtcatgaatgaacagaagtgtacaaatacagcggtacaacagtaattcagtgtgggcctaatggtggacggatatagcatgacgcacagacatgtcgtcaaatatacacttaaaaactagtatatttttgtcgccatatacctaggtacatctgcttgccacagtccaagaggatattatagttaaaagagcaggaccataatccatctgcctgccccctg

SEQ ID NO: 31256 - DNA, 1247 bp, Oryza sativa
  unsure (1)..(1247): unsure at all n locations
cacgtcggacaaaaccaggttgaaaaccaccaagagaccttggatgaccggatttgtatagttgagggatcccgcatatctggttttatggttggaggacgttttttatctcgataacaagttgagggaccttcggtgtactttttccctcgctgtactactactgctgcagctagtcgccatgggctaggcccaagaacagcagagctgttgctgcatgcacggttagcgaattttttttatttatacatttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgatcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaagtataaataaaaaaaattccacggttagctccctgcttgcttttatttttcttttcttatctaattattacggggcgttacataagtcatgcagaaaaatatttgagtttgaggatcgacttgaaagcatannnnnnnnnnnnnnnnnnnnnnnnnnnnnnnnnnnncttatctttgtcagtggccaagctacgtcatttgtaccatgaacctaaatatgatacattatattaaaccaagtttattaatctagatatacttcaatctaaggttatgacatgcaatctattttaataaaaatcttaatggtggaatgccaagtatctgaaaggaaaggagtacgtaagttcacc

SEQ ID NO: 31257 - DNA, 1067 bp, Oryza sativa
  unsure (1)..(1067): unsure at all n locations
attcttttgagcctatctctctaatctgattcttacgtttttccagcggtccaatcaaatggtcattcctgtgttttttttatgtatttttcaattttctgttttacgcttgtattcctatcataatgctgtgtttttcctatttttttttattttttcattgctgggatttaaaggtgcctaaaatatttcaaatccttgcatgagtgtgatgtgacatgccgagggatgtgtgtgcgtgtgcaggtataatataaaagaaaatgtcaacattgtagccggacccgcggagacagcgtcgagccactcgagcggcatggaagggcaaaccgtacgctggagcaaggaggctatctagacaagtctggcagctatagcaagctagccggtcctgatgaatcgaggaataccagcctactgcctttgcctagaaataattttaactccctaaaacatcaaatcggccgctgcgtgacatagcatcagtcctgccaaaatctttgcctctgatcacacgggtggacgtcgccatcctcgttaatgaagccctttattcccgcacagcccaatcctgccagcctgcaggcatgatgcaaggcgtaccagcggacagcagatacacaggggtatgcaaaggccggattcagctagcgctcgtattttaactcgggccgagtttagaacctgtttgattggtgaaataaaaatttttagtagtcacatcgaatgtttgaccggatgttggaaggggttttcagaaatgattgaaaaaactaatttcataactcgcctggaaaccgtgagacgaatcttttgagcctaattaaaccatcattagcacatgtgggttactgtagcacttatgactaatcatggtctaattaggctcaaaagattcgtctcgcgatttacatgcaaactgtgtaattagtttttcattttatctatatttaatgctacgtatatatgtctaaagattccatgtgatttttttttggaaaaagtttttagggaactaaataagaccttnnnnnnnnnnnnnnnnnnnnnnnnnnnnnnnnnnnnnn

SEQ ID NO: 31258 - DNA, 607 bp, Oryza sativa
  unsure (1)..(607): unsure at all n locations
nnnnnnnnnnnnnnnnnnnnnnnnnnnnnnnnnnnnnnnaattttttgcggtggcggagtggcgaggccaagaaacggggagaaatcgcacaaaaccacggcgttttccgcatggcccgccacgcggcgcgaaccacatccactgccgcgccacgcctctcggccgccacacgaccgtgcccccatcgcgccgggcttcccgtggaccgcgcccacccgcgccggcctcacgcgcggctgaggctcacgtagcacgggtccacaccaccgaacaacaacccacccctcctgcgctctccatcccatccgcatccctaatttcgcctcggcctcgccacgccgccgcaccatggccgcagccgccgcgtcgtccacgcccctcttctcgccctgctgcgccgccgcgaccgccaagctcggggcggcgtgcccgtcgtcgtacggatcccggcggaggccgtgcacgcgccgtggacgcctctcggtggtggccgtgcagacgggcccgcagaagccatcgccgtcgtcgtcgtcccagcggggacggaatcggagacgctgcagaacctgctgaagagggagtacaagtatgggttcgtgtctgatt

SEQ ID NO: 31259 - DNA, 12332 bp, Oryza sativa
  unsure (1)..(12332): unsure at all n locations
cctgcaggcatgcaagcttcaggttcataagtgcatccatctcatgtgcaaactcgtaaggaagattctcgaaaacagccctgcagaatccaccaatcatcgctgcaacagccttttcatggtctatccccctttgttggaaataaaatagctggtcctcccctatttttgaagtgcttgcctcatgctcaacacgactagaaatgcaacccacctgttatcacgcaagttggaacagaatgttagtgtaaatgtaatttcagccatattagataaagaaatagatgatacgcattttaggcataagtatagtactggaggctcattagttacacatctgtattcaaaactgcaaatacatgtaattgcagattatggaagtgcttgtgcataggacatgcgtgcacagagataactcatgtctagctcaagatcacaatgggccatcaagaataccatgagaaacattaactgctggaactaagcgagtagcctagaggtgatggtaagcaacttaaaggtacagtgatattgcagaaagaatgcatgacactattagacaaacgaggtcaacccagcggcttctatgaggaaggcagcgcaaaggaggcccgagcgcttgttaggaaggccgaaggcggctagggtgctgaagggcggaaagctaaaaggtcatctaaaggtgtatttgaatgggagcatgatgaaacctgaagcggtactaaagttgtgctggctatacgccatcagtgtcatataaatgttccagatgaataagtatgagatttttcctgcttttgaacatgaaaacgtgcatggcaggagattttctaaccataagataaattggactaaaccaatagtttgactcttatagtttttagccagcataaaagttaaattcagtaatatggaatcaacggcgaccatatttcttctaatatatggaacagtgtgtattcccaaaaagggtgtcattaccatttactttgcatgtcaatatattgaaacttaaatggagaagactgattgtaaccaaggactacgaagattaatatgaaaccctccaacttgcaaaattatcaaagcccctattaatttatacatgctctattgcttttgtaaaacagaaactgaaaaatgacatacagaacaaaggattaacaacctactcttaatagtttgcattataaaaatgcaattggcccttcatgccaggcaaatcaagaacagcagagcagttacctgaatagtcggataggtgttggcagcagcgttatccccaatcagcaaagaatcacactgtgaagaattataagcattttctgcgcctgagtttatctggaccaacccacggtagcaattccgtgacttcccagctgagatacctttggatataatccgactccgcgaattctttcccttgtggatcatttttgtccctgtgtctgcctgctggtaatccttcgtcagtgcaactgagtagaactctccaacagtatcatccccaagaagctccacacttgggtacttccatgtaattgctgaacctgtctcaacctgtgtccatgagatcttagagccccgccctttgcaccgtcctctcttagtaacaaagttgtaaatgccccccttcccctcctcatcaccagagtaccaattctgcaccgtagagtacttgatctctgcctgctcctcacacacaagctccacaaccgccgcatggagctggttggagtcataagctggagcagtacacccttccagatagctaaccgtgctcctctcatcagccacaattagagtcctctcaaattgcccggtctccttgtcgttgatcctaaagtatgtcgatatctccattgggcaaaccgtatccttgggcacatagcagaacgacccatcgctgaacacggccgaattgagggcagcatagtagttatctgccggcggcacgacgctgccaaggtagcgcttgacaaggtccgggtactcgcggatggcctcggaaatggagcaaaagatgacgcccttcttcatgagctcctcccggtgggtggtggcgatggaggtggagtcgatgacggcatcgacggcgacgttggcgaggcgcttctgctcgctgagcgggatcccgaggcgatcgaaggtgttgagaagctccgggtcgacctcgtcgaggctgttgagcttgggcttggtcttgggcgcggagtagtagcagatggactggagatccaccggctcgtacacgttgtcgctccaggtgggctgcaccatggtcaggaaccggcggtaggcggcgaggcggaagtcgagcatccacgccggctccgccttgagctccgagatgcggcggaccgtggcctcggagagccccttggggatggagaaggactcgaaatcagacacgaacccatacttgtactccctcttcagcaggttctgcagcgtctccgattccgtccccgcctgggacgacgacgacggcgatggcttctgcgggcccgtctgcacggccaccaccgagaggcgtccacggcgcgtgcacggcctccgccgggatccgtacgacgacgggcacgccgccccgagcttggcggtcgcggcggcgcagcagggcgagaagaggggcgtggacgacgcggcggctgcggccatggtgcggcggcgtggcgagcccgaggcgaaattagggatgcggatgggatggagagcgcaggaggggtgggttgttgttcggtggtgtggacccgtgctacgtgagcctcagccgcgcgtgaggccggcgcgggtgggcgcggtccacgggaagcccggcgcgatgggggcacggtcgtgtggcggccgagaggcgtggcgcggcagtggatgtggttcgcgccgcgtggcgggccatgcggaaaacgccgtggttttgtgcgatttctccccgtttcttggcctcgccactccgccaccgcaaaaaattccaccgcacacgcgacgacgaaaccgcctctggctgggggctttagaccttcaacggtgcccgttcacccgcgatccgacggtgggggagcccctcgccgtccagatctcagcctctcggatcggacggagcgtgaggtcgtcgggtcacccaacattttctccacacgcggcgactttctagcaaaaacgcagttcgtttaacgagagtcgctcacttctcgttcaggttcagcaatcgcaatctcgtctcatcgtcgccggccatggcggcgtcgtccttgctccggtcgctctcccgcatctcgcgccgcggctgcgtgggaggcgcggggccgagcccgttccaccacagccgcctcccgtactcgccgttctccaccgcggcggcggatgcggtggagaggagggggttcgcggggctggggccgacggcgaagggggagaaggcgcgggtggtggtgctggggaccgggtgggcggggtcgcggctgatgaaggacatcgacacgaccgggtacgaggtggtgtgcgtctccccgcgcaaccacatggtgttcacgccgctcctcgcctccacctgcgtcggcacgctcgagttccgctccgtcgccgagcctctcgcgcgcatccagcccgccgtgtccaagtcccccggctcctacttcctcctcgcccgctgcaccgccgtcgaccccgacgctcacacggtgagacccccatagcagctctgggttggtgtgtgcggccaaatggccactggttttacagacgtgcctgcgtggggaatgcctgtttccaacattcttggaggagtgatcaaaatgtgggaatgatcgaagctcgatcctttctatttttcctcgtgcagaatcgatacttttgacctttttgaataggggagaggagtgaatcggatttctgggctttgctggaggaatcttgactttactcatctgcatcgtgatccatccacagcatgtgctgcgtgtctcttaagtagttgattgagtagttggtgagctgccttttggtcacatcgaaggagaagaaagttagaccaataataatggggaaaatagctagagaacgctgctgaacttgcgtatattcacgaattcatctatggttcgtcagattctatgtgatactgtatttattgtttagtactccatccggcccaaaatgtagcaacctatctagtagagtactaggttgctatattttaggacgaaatagcttttgcctggaaaagaggcatggtacttcgtgaatattcaccatctagtgcatatttagggtgcagttttcatttaaactttacaaacccactggatggttaatacatgaatttcctataccaatttttctctgaaaagttgtttcacctatttattcatcgtcctttgacctttagattgattgcgagacagttactgaaggtgagaaagataccttgaaaccttggaaattcaaggtagcgtatgataagctggtctttgcgtgtggagctgaggcctcaacttttgggatacgtggtgttactgaccatgcaatatttctccgggaagttcaccatgctcaagaaattcgcagaaagctccttctgaacctgatgctatctgatgtacctggtatgccacagaaacacaaaacaactcaaatcaagatatttgtgttacttaggtaatttgtcacattgacaactatcacacactcacacttcactggcacaaaggaatcagtaattactcgttacttttacattttgtttgtctcttgatgaaatttgcaactacattaacctgggctcttattgctgtttcttgtttttctctgtttgattgagcagaatttagaatagaactattacattttaggtatacttgttttttacaaaataccttgtgtgctgaaatctaattttgtttatatcctccttattataaccaattggccaatgttatttgttaaaacaggaatatcggaggaagaaaagcgcagacttttgcattgcgttgttgttggaggtggtccaacaggtgtcgaatttagtggtgaacttagtgattttatcatcagagatgttaaacagcgttattcacatgttaaagattatatccatgttaccttgattgaggttagagctgttggcatctctccctctctctaaactttgaccacacttaacaaattttgtttcattttattatttcaggcaaatgagatattgtcatcttttgatgttcgcctcaggcaatatgctacaaatcaactaactaaggtatgtaatctctgtctaatctagtgttgtactgttgtgccattttaagccatcatgtaccaagactccaagacctaaaaatatgtgtggatcgtataagaaagctggcagtgaaatactaaaaataacttgtgatcatccaacagtcaggtgttaggcttgtgagaggcattgtgaaggatgtacaacccaacaaattaatcctggacaatggagaagaggttccttatggtttgctggtatggtctactggagttggtccttcatcattcgttaagtcgttgccatttccaaagtcaccaggtggaaggtattgtaaattggcttgaccgtatggagtttcatgtatatgcatcatatactgaatgggatttgattatatgcacctgcgcaccttctgtactttgaggaatagggatatatatatatatcttctacatgtagttcatttgtgaatcaggtttcaccatgcactataagaagcttctactatctataggcttttggtatccacccaattactggtgtaacatggctatctacatctttggtacctgtgatagatttactggttgcctggtcacaggattggggttgatgagtggttacgtgttccttctgcccgggatgtgttcgctattggggattgcagtggatttcttgaaagcacaggcaaggatgttctcccagctttagctcaggtacttatctgaacatcttcctacagtccgagtcaatcacaaagtatttggcaaactaatatttgggcttccttaatcttttctggagtaccaagaacactgggaggaataggaaccagaaaaaaaaaagacaaaagggccttacatcaacattaaacagattcttggccatgacaaacctcatctattgtataagggcctgttcactttgatgccaaaaaaaatcttaccaaattttggcatgatttcttatatagttaccaaaatttggcagcaaactaaatgtagccacttttttggcaactttaccaaaatttggtaaggttgaaaatggcatcaaagtgaacaggccctaatttctgttctttctcatacaaatactttctgttgtttgaagtagatgcactctctcatatgattacttaattcaattattttctttagaagaaacttccaaaacagtatcatccctcattttgtttaaagaaaaccaagtagttccgcaggtttgaggtaaaggaaaacatgcagggtgtggtataagaccctctttaagttcagaaaacgctttacttaggccaggctaagtagtaacttaaaaggctaaagggtttaacataaaccgaaacaagatctttcggtgaaacaattcccaatcctttcactatcttggattattgatatcggttagaaagaaatgggcatcttctcgtattagatatttatacattctactgcacttgtactctggaacaggttgcagaacgacaaggcaagtatctagctcacctgcttaaccatgtcatgaaagctggaggagggcatgcgaactgtgagatcgacgttgatctaggtcctgcctttgtgtataagcatctggggagcatggcaactgtcggaagatacaaagctctagtcgatctgaggcaaagcaaggctggttactgtttctgtctgtaaaaaaaacttgcattgttctaaacttctgacgagttaactgaaattgtccctttattgtcaggaatcgaaagggatatctcttgcaggatttgtgagctggttcatctggcgctcagcatacctgactcgtgttgttagctggaggaacaggttttatgtggctatcaactggctgaccacactgttatttggccgtgacattagccgtatttaggtgcctgtttgtagatatctgaacgatgaacagtacagtgcatcctttcccacttctttttttttgtcagatatgtgtaatttccacagaatttttttcttaaataacactatcaaaacaaaccaaggaagcgagttcaaactttaaatactgatgattagtatcgctatctggagaagtctaagaatcatggaacgtccgtgcaacttatcaccatcttttaaaatccgtgggttctggcctccatcgcgattttgtgcactgtccacttgttcaggcttcatttttacccagagctgacttaagaagtacagaaaacaataactagagtgattactatctgtgaagaccgcatgtgaacaatatggttacttgtttcatataatttataaaatccttataaacctttacaataataaaattatgacatcttgaagtagttaaacctcaaaaacagaatccaagcaaaatttgatgtatgatcactctatcttcatatttaaacttcaaaattaatactgtactgggtacacatctacacatagaaaacataatgtacggactacaaacggcgcctgaaaatcaacatggatttaccttctatttagaaatttattaggtcatgtacaacctatattgtatcacctagaacttgggttaaatcctggatgatcaactgctgcactacataagtacaatttcttaaggacggaacatcattactgtcatatgcaagagttcaagaacattgagcatacagcaaagccccaccctcatccaacagtaggtgagagtaagatggtgcaattgattgagcagtcaaacaggatctgatgcagctcccaatcaacaaagcaaagcatactaaagtagtacatccataacatgagcttgctgaagcagatcttcatcatcatcatcatagcagtcataactcatgagcctcgttgtccacattggtgagatccaaatcttttcaggttccaatatgctgcttcattgctagagttctggtgacatgtgagtaattgttcacccagtagagctgcagcagcttgcaatagcaccttcatttcgcgccaggaggtagccctgaagctcttcacagctttgcttagagattccactgtttcatccgtttaaatagttgtgacaactaagacaaaaagcaacaatgttgagatgaactgtgtttggttctataatatgtttagcacattctttgaacagtatacacagtgatcttgtgttttctaattgaacagactcaatgcattttcattttacatcttggggcagttctgcagaaaaatagcattgaatctgttcatgtaatactgcaaaagagtaaaatatttacatggaagttattgaggtaattctgcaagccaaaaaaaaaaacaattaactggcttatgtgtgagcttttggaagatatgtaggatagatgtactgaaaacccaaaaacacagagttgtctcccttccctgccaagagcacctaagcaccacccaaacccttccgagtttgtttccatatgccaatctactatccatgccagtcatagatgcagaaaaatacctgttactctcggctagagacaggcatacaaatctggaaaatcaaccagacctctttgtgacagctggtctgggagctttgtattttgtccgaaatggaaatcaatcagaagaaatctcttcaaattctcttctgccaagttccacatgaaataaatgttacatggtcataaaatagaagtgaccaaagacaaacatgatatatataactcacatgtcatataaagttcaatactatgaacttccttattactacgagctaagcaattttgttccaaataataaacccctttctatgcacacaatcagtacttaaatgtattaagctctttctatgttaaatccgttcctcaatatgtagttccaaaaaggggagtaatcccatccccacaaaaagtgtgctattccttaaaagcaagcaagtaatataaaggttatcacagttacacccaccactgctcaatgaaacagcttccatggatcataaaattcacggcgatggcaaagtttaccttgtctattgaaacaatcaatgcgtgagtattttcattggaggataaacaaggactaaagatcaggctatgtaccttctcccaagcaacaaaagacaattgtgtccatggatccattctctgggtattccttccaacttcaatatactacattattgacctgttagttttctatatgtctgaaggagcttattgacacaaataaaaacacaatgtttatgcctattatttgatgcacaagaataccattgtgttggatgcacatttcagcatccaatttattgtcatggaaatgcagttgaaccattcattacctttcgaatgcaaaaatgtcttgatcaataactttccataaattaaacaggtacaggctacatgagaactaaacagataaacatttcagtgcaacctacgggggaaaatgaaaagagaagaaaaaatgttacactacaacacaggagacatcacccgaagaaatgaaatgcaatagttgaaaatcagcgagcatggcatgcagagtttagatcaacaccacaacacagaatgttcagtttatccttcgcctcttgttccgttggaggcccccgccatcagcatccaaagaacccagggcactgctcctccctctcctcctcagggatcttgatgaccccgcgttacttggttctcctgcactctcagagataccagcatccccctgtatcactgcagcagtgcttgagttagatgcttggtctgcagaaggtgctgcaacaacatgagttctgtcaaatgttgactcgagatttggaggattcgatgatgaagccgatgcaccatattggcttggtccagttatccttctaaaatcactcatggcagatgcaaatctttccgtgtcttcatacccaagaagggtaagtccacgcaaccagtcaattccatctggtaataatgagctcggaccatttctggatggatccgatgcattgtttctgatcaaaccactgtcaggggaagtggatccgccatcgggagggttagggttgtctgcttctctcagcaaccgtcttgctctcatccttgacgccaatctacttaggcgactggtgtgctgagcgtgagcagtgtcaaccatttcctgcacagctgattcaggcggaccttcaaacctactcgcagtattcataatctgttggtccagaaggcgcctccatgatgacaataacccatgagcctcaccaagccttcttgagatcggtcgcaaatggtgaaactgctgcctgaagctttcgagccgatttccatgtggtcttggtgggatagtaggacctgtttgtttcccaccttccacagccttctcggcatccaaacatgaattccctctcccatagatcggagtaatattcgcctcagtcacctcgcctttgcagactgggcattccttgtgattggaataaacattgagccattggtacaagcaaggccagcagaagagatggccacaagaggtgaccaccggctcgctggccatatcgaagcatatattacactcaaatgtggcagcgctcctgccctgctcctccgattcctcggaggcgcctacttccgcgccatcggcagctaccttattatgttcaacagtatcattcatcggttcatgctgcagcactgggactgcggcagcatcacgcccagctgggtaagcttcagaactgagtggcggaaggtccgacctaaaccgcctcgcacggagccatctgcttccagtctgctcgagaagccgccagtaacgggctgcggtgtcagggaggaaagaggacgatgccgtcgacgaagacggccggtcctcccaacctagcagttcgctggcacgcaccagcggcggcggggggtggaggccaaactcgaggtcgtcagggagctccgagaccaccggagccggaggcggcgcatacggcggcaggtgcgtctcggaagcaggcgggtcgtcggggttgtacagggagtagacctcctgcagcggaggggaaaggtcggcgtgagagggggagtacgggggatgcgacagctcgggcggtggcggcggcgcgtcgacggaggctgcggagaaggacggggaggagggcatcggggtgctgagggcgaggtcggagccgaggtcggagcggcgcgggcgcggggcgcgtgggaggccaaggtagaggttcagatccatcctcctgctactccccgcggcctcatcggcgtccatccgacggcgacgagctccagcttcctccggacagcaccaggtcgccggcttcagctccccaccttaccatagtaggtcgtctcccccaagaggaaaaccctagctagagacagaggcactgcgcgggagagctgcgttataggttgggtagcagtaacacatctccgccggtgctcacgccggcagattagcaggcggcgccgccggtaagcggcggctgaggtgggaggaggagagggagaaccggagaagagaaggggagagagagtagcagcaatgtggtgccaaaaagaggtgccctttttattgggtttggttaccgcagcagagaagaataggtttgcggcttgcaagttgctgaaacgtgctagcgtcaggtgaacgtgggttaatttgggatttggaaagccattagccgtagaaagaaatactttttacctgtgttattatcttgcacgttataaacccatctctctcttaatagcctaaaagaagcaaatgaggtggacccagttgcagtggctcatgtgtcatgtgctgttgctgttgcctttcagcagtcagctcaaacaattttacagctaaaaaagctgaaaaggtaatagtcatgattacatacgctgagggaaacaaaacaaattcacgatgatgatttacatttaagaacaacaatcccgtgccaatataaagcttgctaagacaaaccatgcagaagaactgtaacatcgggttctcctgaaacaatgcatcatttctactttggcccgctttagttcgcacacaaaaattttacaccgcatcacatcgaatgtttgnnnnnnnnnnnnnnnnnnnnnnnnnnnnnnnnnnnnnnnnnnnnnnnnnnnnnnnnnnnnnnn

SEQ ID NO: 31260 - DNA, 5119 bp, Oryza sativa
aaacctctcacagtagccattagccaaagaagatgtcacgaatgtagccaaattgaacagttgttatttaagccataaatgccatggtaaaatactagcaccatattggcgacaaaactttctcaaagtagtagaagaaaatgtcacgggtatagccattctcatcatggtaggaaacaagcatctgaggtaagttgctctacatgttgtcatttgccccgatgcgtgcactcttctgctgaatagctccaccagaaagttggtgttcattgttgtgggctaacaatgtcaagaatctgcaaacacagaggaaacaaaaacgtgcaagtgtctggttaattaacttagagttaacaaggaatatcttgtggatagaagagcaaatgcaacggaaagagaaaccttattggtgaactgttgaaaaacttgtccttccatcaatttctctaattcctgaggatgaattaatgagggagtgggcatcataaaataaaggtggtagagagaggaaaaaaataaatgtaagtgagaaaagttatattcgtatcagtattcagcagactatagtaaaaggaattaattcatcgaacgtgcccatttgaagcttctcaactactggtaggaaaatgaagtcatgatggtggaataagaaacagaagtgttgtactataacagtgacaatgttcattactgcaaaccattgtcctcaataggtattggcatattatgtgcatgttatttgagcagccggacagaaattgcaaacatagttaacttgttaaataaacttgcagttatcacaagagtagagaattaccttttctggctctgcagagccatcaatcttaagtagcatttgctgaagcttacaatctttcagagcatctcggatctcattagattccgctggcatggatacaaaaatcaagcaatgagttaattgatgatgtttatttctttttgcgagacaagacgatgagtattactatgattaattaaataaggtagaaatgctagcaggttatgaaatttgtacagggagggatgtggaaccaatatacaaaattgactagcatgaagcccatattctgcttacagtactatccttactaactatttgtcaactcttacgaataaccactctccaaatgccacttacgattgtccttacatttttgccaccggagagaaattttcttaacaatttgcccctttcaccgatgtggcataccagcatggactgaggacgtgaatgtcctttttgcccctgccactccccttcatctcattgagatcatccacagcggtgcacgtatgcttctggcttcctgcttgcggggtcacctcctcattgagaccatccgcggccacaccagccacgctgtctcatcaagcctcgtcaatcatgtgtcagcggcaagaaggttgtgcactgcatctgcatcatcttcttcggcaggccagataaccgcgaggccctcaaactcactgggaggatggcggagcaccccggtgcaggtcgtcatgcggttcattgatggcaaggccggcaagtgaggagcacgttgaggtacaaggagaaggtacatccgcaaggttgaaggttgtcatcgacagccacaaggagaaggtacatccgcaatcaatagcagccaaagaacatccatgcacgcacctaagtgttactgctacctaatggcttgtcactacacagcagtgcagaagatggacgagaaacagcggcggaggtgagctcaaatctgaaaaggaaagggagagaggggggaacacaagggaagggccatgggtaaaatggactttttgtgtctcttgtccacattggctgtcctcactagcatgcttaataggtgaaagtggcaaatgattaagaaaccttctctctggtggcaaatccgtagagaaatgtaagaatggcaaacggagagtagccatttataaaagtggcaaatagttaaattccccattactaaatgtgcatgccaatattttactcctatactgtaggtctgtaggattgggattaggttcagataattatgaaattgaagtcgatattcttgggttgaaatgctggactatactaacatggagacatttgtttcagctaacaaataaagccagaaatcaagtaaaagcaaaggattcctttttaaaaaacacaaatcatggtatgaaatagtcaaacataggcaatacctaaagatcttaatccattcttgtcaacaagccagcttggatcctcaacttcaagagattttgcagagtgcaatgtgtttggatattgtgtgggacaagtcgtgtccgatactacagacaaaaaattgagcttaacataaattttcttggccttcaagattcacaatgaataatattatagcccttataataaattctagagaaactaatttaaattattgattaaaaagcatagcatatggttacttcttcttctttttttgcgaggatagcatatggttacattgtttacaactgaaggtagtcatgatctataaagttttgagttcaatcaattattagtgaaaaccaaatagaagaaatggagagttaacaacagagataagtatggtgcatttttacataaagacggggtttgatccttgtcattaggacaatttgttgcttcttccagtgacctagagttccttgctgaaaacaatagaaggcacaactgtaaattccagtagattattttagaaacatgttagtaggacagaacaattgacaatttaatgaatgactatatgataagataattcaggcccttatatatgggcaagtacatgccctgcaggacttttaggtgtacacagtcaaatgctcatttacagtatattgatgtaattttatgtaggacccctctattttaatgatcatggtttcaactcaatttccatatatagcaggactatatagctgttgcaaacaactgtattgagtcaccaaaagctagagcacttacaaatttcctcctgaagagatgacttgctaacttcttccagaggtattgtcttctggcaaaatttatctgttggcaaaacgatatttagcacaaatactggctatcaagataataaatatattcctctaaaaaagggagatgaagatatttggtggccatttttgtttgcataaaggcaatgcataaatgatagttataatttgtgctgtgtttagtactgttcagcctttccctaatctcaaaccaagtacaatagtaaaattgccaaaatttcaaaacaaaaggtcccccgcagacttggacacttggagtgtgataagcagtttatcacttgctatatttttttaagacgtttggtttattgagctatgtttaaaaatgcggctggcaaagaacgctggccaaagagagaaaaggcagtacagggaagcttgttgatttaaaatacacaactaagaagcaacagagggaacacggcagtttgctacagccccctcgcgctacttgagctactttcagatcgcagcactagagctatatttagaaactaccaaaggatagcactgagtacctttgtgatttttaaagcatgccaccgagcaactgcaagggataatgaaaccgtttgtaaggcccaactgcattacacaatagagaaaaagaagccagagaaattgaacggaccatgctcttaattggtctacaatatgacatgtgctcttttgccacatatgtgtgtataacatgtagccctggccccagttgtcatacaccggactgtggcaaatgagccaatgccattcaactttagggcaaaagagcaattttaccaaacaaatctacaggacacatagaagatgtccaaccgtgattgcatcgctgaacaggtatgttagttcagtagtccatttagtttcagggaatcttgaaaaacagtttgtttagataatcatatttggcaatcctaaggttacatccttgaaacaattgtgcaagagaagtcataaagtatgatatgtaattctcttgcgtattcaagaaaaaataagcaaagtattacagattattgaatgatggacgtttgcctctgaatactaattcaatacagcttagtaccaaaaccaacactgacaccagatatcaggagaaaggtttacatgtcttgttttgctgctgcctttttttttttttactcatgcaaaaccactccagcagcaagctaccgagtcaaacccaaaatatatcaagctaattctgatgtaggctcatattctaaaaagaagctaatgcttccaaccattaatcatcaatctactctattgacctagcaaacccgtactctcttttcaagcagtaagcagtgaagtaatcgatgtgaacacagcaagtaggacattgcactaaaaccgtaacaagtgttcttcaattcaattgttatgctagctagtaggccattactgagcaccatgatcgaagcgatttcccaaattttaaggacagtggtatgcgacgacgctacccatggaagctgtaagcacagaagggtggagatatccggtggctggacttactatggcgtgcggcaagcggagcacttgtacttggacggcgcctccttgcacacgtcgcagctcccaccagccatctccagccacctcccctagcccctagggattcctccaggcgcgacctgcacccccagacccgtctcaggtgtcctgtggctgctgcgggagcggcgaaaggagaggaaagggggaggggacgcgctgaccttttaggtgctttcagctcgtgcggctaggctcgctccacggcgcgcgacgggcgccctcggccggcggcgagcggaagagggcggcggcgccgcggcggcaaaggtaacgggatatgcgagtggaggaatgggtgtggccgggtggctccgttctatgcctgggccagtttagtgggctggtccagcccgcgtggccgcccgcggtggctgttgcggaataagttcactttgggtccctttatttgtcgccctgtccgatttcgtcccttgaccgcaaaactggatacgacccatcccccaacttataaaaaccaggtaaacaaggtctctcggcggttttg

SEQ ID NO: 31261 - DNA, 6403 bp, Oryza sativa
  unsure (1)..(6403): unsure at all n locations
nnnnnnnnnnnnnnnnnnnnnnnnnnnnnnnnnnnnnnnnnnnnnnnnnnnnnnnnnnnnnnnagtaggtgatctgtgagcaattagcaattaccagttactgacgaaaggtgagtaggtaaaggcattattagcaaaaactgcatctatcggaacaaagttcattccggtggtcaaaactcaaaaccccagcgagctgaggtgtaagagcgacgtcgccggccgtcggatcgcgggagggggggctacgtgctggcgcaggattagatccatgaatccatccgtgccgcctacgccatcagacagccacgcgcgcgcagggtcagaaacgcgcgcggctgcacggctgcacgagaggtggagctcgttgccgccgccggctgtcgcgtcgccagccgccaccgctggacctccccatgaccccgtgagccgtggcgcctggaggccgctggagagaggagaggagagagaggggagatggtgagggaggaagaagatgagggggtgagtataacatgtgggtcccactattttttattactttatgtgtgaaaatgacatgtgggtcccatggctttattatttttccggatcgaattgccacataaacgccacgtcagtgccacgtcagatgaagaccgagtcaaattagccacgtaagcgccacgtcagccaaaactattatcaaaaccgccgaggaacctcgtttgcctggttttcgtaagtttggggacggttcgtatccagttttgcggtcaagggacgaaaatcggactgggtgacaaatagagggacccaaagtgaacttagtccggctgttgctggatcgtccaggcttgcaaggccctggcccatctatataattctaagagttcctttttttttcgaggaaaataggagatgttttctgatttccaacaggaaatggatgatttatttgaaatttcagcgtttgaaacaatgttttaactatgtattgagttgatgactgcttttgctcttcttgggtgtggaatataggatttcgcactaatctgtgacattttccccgcgtctggaatacgcaattcggtatcactttactgtattcttagtttctttgtgtttatcagtgatcactggtccataatactccctccgttttacaatataaatcattctagcattttccacattcatattgatgttaatgaatctagacacatatatctatctagattcattaacatcaatatgaatataggaaatgttaaaatgatttacactgtgaaacggaggaagtagctcgcaacgaaattggagaaataatgtgaggattattcgaagtaccatcacgaaaatgagccatttcctggttcagttcgtatatttttttcacacgatgaatgattcactcgtgctcaaaccactccaatactaggattacaaccaatccacacacacaccaacaaacaaaacaaagctatgcaacatgccgacgaccatggacaaatcttatatccgataccggaccagcgggtccttgaactgaagccgcccattatacaccctccacgcaaggtcctcgagtaaaaacgagtgaaatctccacccatccccatcatcgccggctccatccacctcgtcgtcgccgccctcttctccggcatccgtgaccgggaccaatggcgagatgacactgtccaaggggagagtgatcagcacggtgactgacaagcggtcagcctcggcgccgtgccctgctccgggtgcagaagaaacggggcgagccatccctctcactttcttcagctttccattgctccacacctagcacgcgtgccataaaaaacaagaggcattaaggcaaattcaagcaagttgttactgctttgatgctgctcaaagagtaaaggaaacaacagacatgacatgatggtcactttgtggtttctcttcaaaagccgagatctttgactcttttttaaggtcctttggtggattccaaaccgagctgtgaggcagtgatgcaccggttgatgcagacatggggcctaaatgggtccaaattgagtggtgacgcacagcctatactttagaatttgatgccttcgcaaaataaaaatggatgctttttagtacatgtctatgcttcttagagacagactctgccactcacgaacaatcaacacatcttttttctgtggtgaacgaccagcaaattcgtagctgtaaaacctgtaattaattttacacgtttgccatttgtttttttaatgcaaattacaaactgaatcaataatatgagtgtctacatgtcaatcatttatgtgttatctgtgcaaaaattaatgctctaatgtccttccgtttgcaaactagtcaaaatgagacatttgcacgcaagtacctgagcaatgttgccgatggtgacaaggagtgcgccgtcgcgcgcgcctacggccgtccactcgccgccgtcgtccatcacccagctcgccggcgccgcctccttcccggacgcttcccactggcaatggatgcccacgacgtacgggtacgccttcgccttcccggcggccggaggcgccgcctcgccagcggcaaccttggagacccacatcaagcacctcgccttcctcctcccttccgcgaacggcgcctccccgaagcccacctcgggacacccggacatcatcgccaccacctgcatgcccacgtcccgcatccgccgcgcgtactccgccgccgcagccgggagcgcgcccatctccccctcgtcgtcgacgtcgaacaccagggcggggtcctcggcgccgtccgcttcctgctgatcctcctccgtgaatccgagcgtgaggaggttcgacgcgcggcgcgcggacgcgtcgacgagggagagctcggcgagcgcggaggacggcagctgggaagggacgccgtgtccctcgaggtggaagtaccccacgtcggcggcggcgtcgagacgaagggtgccgctagagccaagcgaaacgagaggcggcagcgacggcggggccctggagcgagaggagagcggggagcgtagaatcggcgccggagaggataggagcaggcgctggaggatcgtcgagagcgcggcgtccgtgcccccacccgcggcgccggaggacgggagcgcgtggtggtggttcgacggcgtcggcgggggagggcctgggaacacgctccctcctcctcctcctccgttggcgccggacatggatgacgctgcggcggtggaggaggaggcggccatggagacggcggccggagcggtggactcggactcgaccgacgtggaggagaaacaagtttttggtaggaaactgggaatcgtggctggtgggaggcgttggcgccttggcggcgtggcgtgggagaggaggcgatttattcgggtctagttggtctgtcagtgtgggcccatcttacgcgagagtggtgggccaccttaggagattgagccgacctggaccggcgaagcaggggatgggccggaacagggctttattcctgacctcaactactcccacaaatccctcttctcagttctgcttagttagcttgctttttgtgaatttgcaaataaaaatcctccaaattttcagttgtaccttgtttttctctcaaaatgtagcagctcgtactttttacttctacgagacaatttgtattcttttcggtggttcattatctctgcactagcatgaagaaatggaaacggaatagcctcaattagcttctgtgcttgagaatttttcacatttatagcccataaactaggaaaatgttgaaccggataagtgaaggaaaaggaccaatagtccaataccactccacagcgactgacaggtatatctatctcgaccattggattgttgcttcttccacatagcccggcagccggccatgcgtgtcgttcttgtagctttcatactgcgaaacaccttctgcaaaatgaaaaaaatatgtcctaaatacacgagcaacgacgtctgagaaattgtcaagtaattcaagaaagcaaccgtttgccttagcagtttaagagctgaccccagtgattagttaggagtagctttctatcgctgaacacaaaatcaaaacgcttcgtgtctccattggacggagagaccagcacgagacgtgaaaattcgccatccttcagagatcttgccacgtcgtgggacttgtcggatacgcacacgtacgtgcgattaatctggcacgacgatctcttttctcctgtcgtttcaatatattattatacggtcgaatggatcgacagggacaaatggcattgtagacggtgacacaaaatgcagggaaagaacaacatgtttggcgaatcatgcagagccgagctctcttttactagtactagtacatttcaaggacttttgcggctgcgatgcttaaattatgggaagggtgtccattctattatcgtcttttagtgccctgttagaatcttgcatagtcagtatcatgtactagcatttgctattttattgcccgtgtgtatgctgtagtctcggctgttaaagagaactgtttgctttgtcttcatgcacgggcgatatttgagaaatttgtagttgcagtcctttagagttgatatatattggcctttgataaaaagaagtgcagggacaaattcgtttttatgggagaccttcccccggaaacaagcttgtctgcagcgatgtgacgctccagtttcatgcgttttggtgttaggttggacaacatctccatcagtgacagacattatacaagtagaatttctttacattaattcatcattttccagcgatatctttatggttttgtaagccattattacctactagtatcttaaataatcaagaagagaatgatctcttctaccggaggaaaaaagggagaaaaatatatgcctcgcgtgcttagtcgttggatcatggattcagaggtctagattaaaccagcaaccgtgggctactccaagaagaatggttagcatggaaaattgttccctcaactatggtttgagtttcattcacgtcccccaacagctcaactgtaaaccagttatataacatcccctaattactaacacaagtgcaaatcaagtctctcgacgctttagacaacggtttcatcttacgcagcatcatgtgactcgttgaccaaacgttcatctgacgtggctggaaacggtacgtgacttgatgagatgtggttcaggctagggccatgggtaatcaggctggggctcctatctctagcatcgccccttagaccaccaatatggtggtgtggagcgacgaacgaggatattattgctacggttgctatcttgccttgccgccaccctcgagcgtcgactgaatctcttccacccacgctacaatccgtgataagttgctcgaatctctcttccacccagagctatgccaatgtgttcactaactatggccattgcctggctcctctcgatggacgcttgtcacccgttttccactgctacaaaattatcggggatacaatgttctattgatggcaaatttagtcacacagaggaagggtagacgaagaagaagggaggagaaggatggcatggttgccatcgtttggtgacttcttggccagcaatcatccgtctaccgctcgtcacattctccactccaacgccgagctatgacctcaaatcctctttctccactgcccttgagtcccccttctctagtacgaggagaggagagttggacacccgcagcgccagctgtccttgttctcgttcgcaatagatggtgggcaggcaacggttgggacacctaagaggcgagagtgaggagtcggggtgactggccgggtcgagagagaaaagaagatagtagaaagaaagtatgaaatgaaatgtggaccctataatttttttattaactttttgttggttggattgtcacgtcagacgaacattaagttaatgtgccacatatatgtcacgtaggatgagtttgtcgtccacaccgctgagggactcgatttgctctggttttgatatttggggatgctctgattgcacatgcgaacgttaaaggaaactcagaccccggtgtgagggacctacggtggacctttcgctggttagcattgctccataagtaggtccaaaattctggaaaggtgtcctaaaggaaaatgtatactttgactcccatgattcatgtcctccaactacaaaaccgggtatatcgactactccaactccaattatcaaaaccagttttggaggtggttttggctgacatggcgcctatgtggcggtcttgaccgagtttttgtcctacgtggtgcttacgtggcattagaataaaaaaaataaaaaaaatatgtaagacccatatgttattca

SEQ ID NO: 31262 - DNA, 47686 bp, Oryza sativa
gggacccacatgtcatccactctctccttcccttcttcctccccctctctctctccccccggcctttctcttggccggaatggcggcggtggcggtcgagacgacagcggtggcggtggggacgaggatggcagcagccaaggagtgcaacgctgtggcgatggggaggaagaagggaaggagagggaggatgacatgtgggtcctacaatacttttttttgaatgacatatgggtcccacatattttttatttttgtttttattctaatgccacgtaagcgccatgtaggacaaagacttggtcaagaccgccacgtcagccaaaaccaccgagggacattgtttgcaccggttttgatagatggaggagtcgatatacccggttttgtggttgatggacatgaatcatactcgggcaatagttgagggagtcaaagtatacttttttctgtcctaaaagaccatttgcagcaactagcaaggcccaaacgattacatgttgagctagcaggccaacttctactgtaccatatggagtaggaagagtatgaatgtgggccatcaggcccagaaagaagagattttttactgtccagcagaatttttggtaccgcgcggtactgcaatcgtaaccgtccattcagccagatcaaacgacccacaatcgtcggtaccgcgaggtacgggaatccggtgcggggtacctccccctttgttcgcgtgtatggaactggtggaagggcagaattggattttcgcgtggttagtcaattttcgtagagacggtacaagtccccgacccgataatctgtctcttcccgatccccttccgtcgtccctggcggcggcgcagccaatctcgccggacttcgcttcctccctcactgcaaccagccgtcgccaacttgcccattcccaacttgcccttcctgtagccagtctaggtccggccgccgccgacttctgggagtcgatctatccctggatgacgacgacctcaatgcgcaaacaagaagaggtgaccatggcgacaagctcagcgtggcgaatatggcctcgacagctcatccgccgacaccatcgcaagcctttgttcgtggaatcgccatcgctgtggtatgcattggatcgcgagcactagcaaccctggaaggaggggacagaaagaagaaaaaaacgaagctagatattgagatgtctgaaaggcgtttggccatggatcgcacaagcaagaagaaattgggcaagcaaagaaaagagatcgaagaatttcagaagtttgtttatgggatcactagttgtaatagtgtcccttttattcaagatagttgacaatttgttcaatgaccgccgatgttgattttgtttaagatgaaacagtaagcttaaggtctacaacgaaagaacagtttacacatcagaccaagaaactacaaactttcagaaaatctacttcttttttactactattacattcatactttcagcaaaatcaagtaggttcattacatatatcaaaagacaaggaactaggtccagaacttggcacacaacataaatcaaactcagcctctcccatcaacatagcatattcttccaatgaatatagcagcaaagcaatgtttcgtatttctttcctgctggacattgctttgctggtcgtcgtcatccagggatagatcgactcccagaagtcggcggcggccggacctggaccggctacaagaagggcaagttgggaatgggcaggttggtgacggttggttgcagtgagggaggaagtgaagtccggcgagattggctacgccgccgccagggacgacggaaggggatcgggaagagacagattatcaggtcggggacttgtaccgtctctatgaaaattgactaaccacgcgaaaatccaattctgcccttccactagttccatacacgcgaacaaagggggaggtaccccgcaccaaaaattcaaaaattctactggacagtaaaaaacctccagaaagaaatttctccaccaaggccgtcagggcccataccagcaatacaattctccgatcagtggaaaacatgagtataaaaatacaaaattcggccgaatcggccagcatgcttcgtttgccatgctattaattagtcaatccttaactcagttttaaactcagcccaggtgagttcgaattaccctatcataatttataattttaccagaaaaaatacccgtgagttacaacgggtaaacgctattttaatcatattattgttggtcggtttaactaaagtaaaattcactgcgggaatttgcatgatcgaactgtaattagaagtccaatcatctcaaattagtatgcaagtttttaaaagagatttcttatatgtctccttctccttctccttctgtatttataaaagcgaatgaactcaaaaaccgattcaaacacggatttgtatttccaaatgcaaataatgaacttaaaaactaactcaaatatggatgacgtaccaaagtaacagcaaaaacatattcaatttttataatagcagagatatgccctcgttttccatagtacgattcctaaattggtaaaatgtatgtttttttaccaaaattttctataagaaattatattaaaaattcatatcaatccatttaaaaaaattttaggtaacgtttaattaattatgtgtttaataacttgaagttagcatagctcaactgattagattacatttggttaaaccagttcacccggttcaaattctagatttgaaacgagtgttcgtatttacggttaattattcttttaagggtatgttatgcctgtgtgttcatagtggtacagaaaatgcactgtggctaacccacttctggttaagctaaacacacctgctgaaccatcgagcaatcgtgggcggcacgcacggctgttactctgcacaagacaaaaccagggaaaaaaaatctctccgatccggatactagctgtttccctaagatgcgaagcggttgataagttgattcattccattttccaagcatgactacgacggaagagcagatattcacgtgtgaccaaacctacacactaaaaagaaaactaccaagccacatcacacttaagaaatgtttgcacatttcctcacaagagaaggctccagctcaacggaaaaaaaaagcatgcctccccccaaatcccaatcagtaaagggtttgcttcagcaaaagaacaaaaggaattatttcaacaatactatatacaaacgaacaatcctaatgaatgatagattacattatcgcaccatgttagagacgttttgctggcggcgatatgatgcacactacctagaacataatacgtctctaaacaaaacgggaacatgccaaggtccaaagaaccacacataccttcagattacttatagaagtaaaatcgaatccatgtaatgaaatcatcaagaaaggcactgctacagtgctatttaacctgaattatattcatcctctgccaaagcagcgactgatcgatgggtggcacgtccaatccctgatcctgtcaacacccaactcaaacgcgggcgtccttctccttccctcccggtgaagctgacgcagtgacactccaggttgcgcgcgcgcatgcgggcggctgggaagggaagccccgtctaatcaggaccagtgtcgtacgtggtccttccagcccgcatgacggagaggccatgtcgtttacgaaccaccatcggatgggtacaaacggaaccctcctcgtcccggctgcgccctgcccgtcccttggttagccggcacttgttgaagatctcatttgcgagctcatccagccatcctgatgaacttcacgcagaagaaacttggctcaacagcccgaagcgtatgttacactcgatcaactaagaatagagagatgtttctctgtaatcctgctgctaaatttttttgttagatccccacccatagagtactaattatagtattagagcagcagcattgcagtttgtacttgctaagttgctggtacaacactacaacttgctggctgtcctggtcataggtcaaaaaccgtactttgctcacagtgtccaaaactgcacctgttcacaattgatcagcttctctgaaccgaggaatggaagttgaaattaaagcggtgtctctccaatcatctcccggcggggccatggatgaaacagtaaaccagcgaaagaaaagcatcggtctatcagatcggaataggaaaaggaaattcagattcctcacattaccacttgcacttgggctaccagactcggacggccaatggcgttttcttttctgctcccggtcgctctctaatttgcccccaaattaaccaacgccggttgcgtcccaggacagcacaagtagagccaatcggtcaacaaatcatcttacaagacaaggaaaatgcaatagtaggagtccattagcaaagtgccggtgccatggacatcgctgtaatggcgaacacgattttcggacgatgcaaattatcttctggccggtaggcagagcaaagaaaaacagctataaaggggccaaaaaccaaggttcctggagatcacaggactacaggaaccgatacaaaaacagtgttttccttcaggaaagctacaagaatagtgctagtgagagcggcgacagaattgtcattactacttcgtattaggtggttggcaatctggtagaccattagaattgacagtagtttagctccaaattattgcgtcaaagttctcgacgggttgccgtaggtccgaggagaggtgcactctgcttgtcatttcaaagttacgaaacagcaaattcgtcaggttttgagtgccttcaaatagcaactcgtcgatcagaaacggctggacaagaagtcatattcagctggctagcacggccttgctggtggccttatttcctatttgatcgatttcgtgagttaataattcaagattcagtacgttccaggacgaaaaataccggagatgacgaagaaaagtaaagtacgtgacacccgagaccaccggaggtgtatccttttctctctggcattttgggctattggcgtaactggaattgaagtgtcaccccacaagtacagcgacgccgttgagccgaaaaggatattgcaaccgaactgcgagatgtataattgatccagattatagaacaattgatcttgtttgactgaatcaacatacattagtattactttttagttactggctagctcggtcagcctggtcaatggactgcagagctcttaggcctggtttaggccctgtttagtttcaaagttttctttttctaaatttccaactttccatcacatcaaaccttttatacacacacaacttttctatcacatcgtaacaatttcaaccaaacttccaaacttcctaggctgtgtgtttagttcagcgcaaagtttgggttttggttgaaattggagatgatatgactgaaaagttgtgtgtgtatgacgggttgatgtgatggaaaaaaactgaagtttggatccaaactttggatctaaacacagccctaactttttcttcaaactttcaactttttcatcacatcaaaactttcctacacacataaatttctaacttttttcttcaaacttccaattttagtcaaacttttaattttggcgtggaactaaacacaccttgatttttttgactttggcgtgaaaacgtaaccttcttctgtagtcataacgtataatcgagcgatgacaatgtggagatggtatacatttgcagaagcaaactccgtatcttaggctaaggaacatatacatgtttactgaagaaacttggtcaaatgggaataactaatgcagtggaatgcaacagagtaagagacagcccaggaaatcagatttagttgctacaagtagcagtaacaaataactcgcttaacaacagatggcccatggtcctgtcgatgcatgagaggagaacagaagaagcgacagagcgacgccaacatagcggaatcaccaacatttctggcattctattgtcgctttgtacgcccggacaatgcttaccctgaaagtttcttgaccgaaaagctagccaggtaaccctttcataaaaatataagaaaatttcgttttcaaaagaagaagaaaggttgaatggtgatctaggccttgactccactgtcaccaggatcatattcatttatttctgaaaccaacccaaatcatattcaatgctataatatatagttcctccgttttaaatacacgatgccatcggcttttagacaaaccgtttgaccattaattttattaaaaaagggagaatagctactttagtctctaaagtttctatgtatgatcaatttagtccctaaccttttaaatggtctaaaaaaatccttaacctttgtcataaggtctagaatagtccttaggtccaccaaaatcatcatatggatatgccatgtcatcattcatataaaatatatgatgaattgtctaatttactcttatgtatatcatagaaaaataaatataagggtgaattagacataaccataggaaaaaaatacttatcttttcccccttttgaggtatatttttgctcttacatataccatatatttttttaaccttttctttttgtttttttattttcatatgcgtaaggataaattggacaaatcatatagattttgcataggaaggtgacatggcatatccatgtggcgattttggtgggaccaaggactatattagcctacatgacaaatttaaaggacttatttggagaatatgaaagattaagaactaaaatgacccaggagcgaaactttagggaccatattagctattatcccattaaaaaatattgaaatttgcaaaaaaacataagtcatgcttataattaatataattaataataaaacgaatcaaaacaaaacatacaatattttttaataaagcgaatagtcacacttcatgtaaaaatttgacaacattatatatatttacaaacagtgtttcttcaggtctagaagtctcaaaccggcagttggctcgacgtgtggtaccaatagtcacaaagctgcaagaactccacgtctcgcatcattctaccaaaaataaacccaaaggaggaatcaaggcctcaagggccaactgcttccctcgcaaaagaaaaaaaagggggccaactgcctcatgtgaaaacgtcaccatgtaatcgtgtaatgtgtatgcatgtttgttaattctctgctccctcccagccaatctgtacccataagccaccacgttgaccataatgatttagtaccatatacgataatacgagtagataaaccgctatatggggtcgcgcggagcaaatctgctcgtcgccgaaatcaagtatagtaagcataattaagtttcctaaccagcccaaaattttactaaatccgttctggagagaacacctaatcctcaccaaagcttaacagtattgtgccgcagatatacacagtacttaataatggctcccatgagtggcgtgctgtaccacgtttctgcatgcctcgtattggccaagtctgcgaggctttgaattggtaaggaataaaaccctccctgtttccgatccacccgtccaattaaatcatgcttagtggccgattcaacgcctgatcacggaggagaagggagggggaagcatcacgcgaaattttaagtgtgagatggcttcccctcaccaaatccccagcctccctctatagctttgctatgctgactacttcctcgccatctccataaagcttagcttgcccctctcgctcgcgtctctgtctctcacgcacgcgcaccgtgcagagcgaagaggagagggggctagctccgggtgccgtcgccatggccaaccggcgcaagttctcgcaggcggggggcggcggcggcggcggggtgttcgacccgttcggcacgaaacaggccgtgtcgtcgctgcggaagggcgggcggctgccggtgtacgtggctggcgtcttcttcgtcatcttcgtcatcatcatgtacggcgaggacatccggtcgctcacgctggacccgatcgcgcgcgcggggacaacgccggcgcggatcgtggagccggtagtgacggaggagcgccacgtcgcccgggtcaaccctcctcggcgcgaggtctcgtccgcggagaaggccgccgcgttgccgctcgacgtcgacgagaggccgaagctggcgacgccgacgccgacggaggcggcgaaggaggtcccgaaggtcgagaagatcaggaagccgaagaaacccaagacgacgaagaagaagccgaggaagccgcggccggcgaagaagacggtggcggcggcagccgggggcctgctcggcgtgccggagacgtgcgacctgtccaagggcgagtgggtgttcgacaacaccagctaccctctgtaccgggaggagcagtgcgagttcctcacgtcgcaggtgacgtgcatgaggaacggccgccgcgacgacacctaccagaagtggcggtggcagcccaaagactgctccatgcccaggtacgcaaccacgacgagccaccaatcacaatctgtaatttgcaccgggcgggaaagcatgcgccgtttcttctgaaatggaaacgctccagccagctggacacgcaagtataaacggcaagttttgaatttgtacgaattgattcaggttcgacgcgaagctgttcatggagaggctccgagggaagcggttcatgttcgtgggggactcgctgaaccggaaccagtgggagtccatggtgtgcctggtgcagtcggcgatgtcgccggggaagaaatacgtcacctgggaggaccagcgggtcgtcttccacgccgtggtgcgtactccgcccgtctccatccatccatccatcccgtctttaagattcgtaccgagctgctcgcatgatgaacgtgcatacatacccatccccatctgtctagtctagccaagccagccaacggcgggccgggtccacgcgcgcgcgcacggctgctgcgactagaccagggagcagttggtgtgtggtggtggcggcggctagctagaaccggtgaaccaacttgtgctcgatcagccgccgggtcggtttctgatagtgtgttgtcgtggcctgttgtgttctgaattgtcgggacgcgtgtgtacgtgcgtgcaggagtacaacgcgacggtggagttctactgggcgccgttcctggtggagtccaactccgacgaccccaagatccacagcatccagcaccggatcatcaaggcggacgcgatcgcggcgcacgcacagaactggcgcggcgtcgactacctcgtcttcaacacctacatctggtggatgaacaccctcaacatgaagatcatgtacgctaaatttacgttgcacgatatatcgatcgatcacaacgccgtgccgtgcaaccaacggcgatcgatcgtgggatgacagtgactgataggggtgatcttgcaggagaccgggcgggcagagctgggaggagcatgacgaggtcgtgaggatcgaggcgtatcggaaggtgctgacgacgtgggcgagctgggtgaacgacaacatcgacccggcgcgcacgtccgtcttcttcatgagcatctcccctcttcacatcaggtacgtaaaccagcctacctaccttgttacaattcgcattttttgtattctaccgtacgatcgatctcaagtatttggagtatagctggcacgtacgaacgcacgattgagcaatcaattaagctagtgtgtcagtatatctcaagtctcgacggtagtacggtagagtgggaaacgccaaaatcttggaacttttgcatgcaaaaacccaaagtaaaggtacgcacgcttgctgttggcgtcgcactgccaaagaaaaagaacgagacggcatgcaccgcatatggtgcgtgcgtgtgcgtcctgcagagaattttacacggattggtggtggagtgggcgccccgtctcggccggctacgcgcgaccgagtcggttcccgtgggcgaaacgaacagtacgaatcgaagcgggcccaggccaatagaaagagacgagtcacccggccgcctcgagccagattgtagttgtgcgcgcgcgtggaaatgtcagagaccctacatatgtgtcttgacttgtggtggtaattataaagattaaaccgtgcaaacgattcgtgttaattagtgtcaggcgactagcacaccgtgagcaccggacgcaacacatggattattcgtcattggcgttggccatgagaccgtcccttaattacttcaacgtggccgcggtcctgctataacatgctaccgcgacaactgtagcaaaccaactcccattaatttacttatagggtttgacatttcagttagtggcgtatcatctgtagactaaagtagagagagtgagtatctaacacgctcacacgggatgccttgccatgccggccagcaaatgactcctgccagtacaccatagcacggctaaccgacacacagctccgttgctgaaaagcttaaaattatctgcaaaccccaatggtgaccacacttgagcagtttgcacaaccacaccactgttgaaaactacgcttttatatgtatcacttggagcggcatcttcttagctaagctgtggcttctttccagttctcacttagcacgcactttctgcgcccaagaatgtgcgtcacataactgacccggtctgcaaatgtccaatcaaatgaggttactatcgggcgcccctattattgtttctgcttgttgtggccatctcgcatttcccaaaattttaatactcctactcccctactgcgccatgggtatatatgcatagttgtgtgtacctgttcgctcacatgggtaggagaattatttgcacatgagtccgagatggaagcttctccgcacgatctttttttcccatttggccgccgtttgcgagccgtggatgagtgaatcccacgatgacgacgacgatcccagacctgcaggacgggcaccgtagttcgtgatgacatattgaaaaatactagtatcatcgttgtgagggctcatcatcttgtgaccggaattctaggatctcggagtacagaacgcattgaaccacggagcaagtagataaattatctaatctgacacatatataggggttgaagattagtagaggggaattcaaatctggttggctgaacctagctactacacgtcgcttgtggttgacgatttgcttttcttcttgtgcaattcagcttgagagttcctcaaccccgtgttctactggtggagaattcaaacttacaagactgaacaaaaagaaatggtggtttgcaattgatatgtgtgatgaaacataaataaggcctggtagatcgatgcccatacgtgtattattgcgtactttacgatgaagggacagatgctgctttgttagtatcggatcgaacagaaggttgtgctggttactgttgcggatcgatgtcaattaggcttgataaggattggcatggcccgcggatgacgccttacgaaagctctccctctataaaaacttttaggacagtcccaacccataacactagatatggtttcaactctacatcatcaagaaactagtactagacactactcttctaatgcaaacaccactattccgtacttcaatttaatgctacttatctcacatgatgtcttggatgttgtgtaaaaatcatgtctcatacaagatatggtttccttctctttcctcatttattcacttgccacattattttttgttctacgtggcaacttatttaattatatggacaccatactagttattgggttgaaaatccctaatattaggaacagtcttatcctgaaactgataggtgcttagggtcccgtgaagcaaaccactttgatttgtctgcgaattttgaagtcaatgattcccttttgtatactacctccgtcccacaataagtacaatcatgagttttcgcgcccaactttaatcgcccgtcttatttaaaattttttataattagcatttttgttgttataagatgataaaacatgaatagtactttactcgtgacttatatctttagtttttttaaaaaaaaatttaaataaaacgaatggtcaaagttgggcgcggaaaaccatgactgcatttattttgggacggatggtgtaggaaagaggatgcgagaatatggttaactagtaaccggacaaaattgccgaggttcatgtcacatctggtaaacaaacaaatcaccggggttttatcgtcagttaattactagtagtattactgctttccttcttggattaggaagaaggccgaaaaaacatttgccgtgtccagctgtgtgatctcgaaagttgttgactattccgagtagggattgcgtctacaactgaggaacctacgcttttggcttctttgggttcggaggcatgtcacgtcaacagatacagttaaaagtttggtcaaccaaagcacaattactccgtactaccgatatcatgtactccctctgtcccataatataagtaattttgagtttttgcttacaacgtttgaccactcgtcttatttaaaattttttaaaattattatttattttatttgtgacttattttaatatctacagtactttaagtacaacttttcgttttttatatttgcaaaaaaaatttgaataagacgagttgtcaaatttatcgtgggacggagtgaggactacgatccccatgcttatgctactatgcataggtctgctaaataatttgcccatgatttcaccgttatcaaactgacaaaacttacatcctggtcgttaattcggtttctgaaaaatctgttttcgtggctctgcagcccggaggtgtgggggaacccgggcgggatccggtgcgccaaggagacgatgccgctgctcaactggcacgggccgatctggctgggcacggactgggacatgttccacgcggcggccaacgtgtcccgcacggcggcgacgcgggtgcccatcaccttcgtcgacgtgaccaccatgtcggagcggcgcaaggacgggcacacctccgtgcacaccatccggcagggcaaggtgctgacgccggagcagcaggccgaccctggcacctacgccgactgcatccactggtgcctccccggcgtccctgacatctggaacctcatcctctacaccaggataatgtccaggccgcagctggtatagcaaattccaagaatttacggagaccggattactcataggcagagctggttggttatacacaatcatcgtactgaaaagagatttttcttcttcttttcttcacattcttttctggccgtttcacctgctgtcagaagatgtctttcatttgttctttttcttcaggggttaggttaagtgggaagagatcgatacagtatatggttatatatatggctaatgggatggccatgcttgcgtacgttacgtgcctgcgtgcacagatgcgctgtaaggttcctgaccaaactgtacattggggaagaaaaggattaaagcgaaagagatgaacagatatggtttacagagaaacggacggcttcatgcgtccagctgcagatcgagtagtggtggcctcgtggggatacctactgcctacccatgagtccatgacagaaaactctgctcgatctgttcttttctccgggtattttttttccctacttacacacgggaaacagatcgaaaaggcactttcagttgatcatttcgatgtaaagcctgaaaatcatctacctgaaagttgagtgacaaaaagaagcaccacctgtcaacagttgaggagggggactacagctccactacgagccgtccatgcagctgaggcatgcaagcctgctgcttcttagtttcctgcatttttctgtatgcgtttcgttgcggtagcaaagctcgcgtatcctctttgtcgtggcaagatgctgctgctgcgacaggtaggacactggacacgccacacgtcgacgaggccgttccatgtatgcgaggagcaaagttgctgggagataaagcacggggcgtgctttgtcttctctgtagaaataaagggactgtctatatccgttggcagaaaattttacctcttatcttttaaattttaggccacttttatcttttaaattttgtaccatcggatatgctttaagatttgtgcagagacattaaccctagctctcctcccgttcccctcgcatcgctcatttcgccgccaccatcacgcatttctccgctatgcctgatcccctgccgccaccgccccatcgtgccgccgactgcctccccaagccgtcaacgacgagatgccccgccaccaacatcagcccaccgccctcttccaacaccacagctccagcgtcgctgccagcgcctcaccgcccgcccgatccaccgcccaccgtcgggctgtcgtctcccccgcccatctctatagagccggcgaactcctccccttcctcctccccctcccaccccaccccgggacactaacctgtagggtcctctaccggagtctaaagtgtcgccagcgtcagagaagaagaggaggtcgccggagttggaggagaaggccaggagcatgaatattgaagctaatccagtgtcccaaaatctgcaagatttggatatgtaatttctgtcgaaagaaggttagcaattccgagaaataaaagttgttacgtgtaacgaacctcgccgtaccacctagtgtggagttaaaatgaaatgaaggaagatattatatgtttaatttactttattttaaattgattttatagtttgtattaagaggatgcgcacataataaaaaaaagataagttatagctaaaatattttaatgcccgggtttctgggcatctagatctcgtatactcccgcccccgcatgccactctgctagtacgtgcacgaggaagaaaccgatcgagctgatgaggtcgcgtcgtactaccagctcagcagatcagcctcatttattgtgtaagatcaggcgcgatatggtgctcggcgatcagcaaggttggagtagctatggcctatgagcacaggtcactcgacgatgcgtgaatgcgtgatgcgtcctgtgcaccaaactgaacagatatatagtcagattaacgaatttaacgatttggccggcccttttccatttccagtcctatgttcatatagctgtggagtccttgtgcaacgaatgatatcagatgcgacaagtgtaggagcgtgtgtctatgcagtcgaatgtccagaaaattgtccattttgccaacatgcaggtttcagaattgggaccattaaatggaccattagttctactaggcccggcccatgcaggtttaagaattgcaacagtggggaagccacagcttcagtcatcagtcttataaaaagaacaagggattactgaagactcaaggccccagagttacataccattcaggcattcaccgactggcacatttaactgctagtgagagagtgtaaggcataatcatgttcctaaaatacacaacaaactatactactctactagtagtatatttctgtgaggaaaatacactaccattacttaaacttgatcgattttcgtttcccaacgattttaagtactacatttgctttgcatggacctaaggaaagccataggaagcatgggccggcctgatccatactaattcttctaggcccggcccactatttcttccccggggcccgagctcgtttataacctagagaacgccccctgaagctgctcgccgccgccggccgccttataaatctatcctcctcaaagatccctatctcttcaggttcaggctccaagcaagcaagtactccttcatcttactcctagatttcatccatcctttgcgttgatccttctccaagatagattcaatagtagagttcccgtctcagtctagccgtattgttttgttttcgctgtaaattttcgttcgatttgtcgtgtactgcttgtggcggcaactttatcaagaagggccatgaattaacttttggttaatcatggactaattaggctaaaaaaattcgtctcacgattttcatgcaaactgttaattatttttttatctatatttaatgttcattcgtctcacgatttccatacaaattgttaattactttttttctatattatgttctatgtatatgtctaaagattcgatgtgacgtttttttagaactcgcgaaaagaaaatttttgggtcacatcggatgtttgaccggatgttggaagggtttttcggacacgaatgaaaaaaataatttcataactcgcttggaaaccacgagacgaatcttctgagcctaattaatctgacattagcacttgtgggttacggtagcatttatggctaatcatggactaactaggctcaaaagattcatctcgcgattttcccctaactgtgcaattagttttttcatttatctatatttaatattttatgcatgtgttcagagatttgatatgatgtttttgggaaaaattttggggactaaacgaagccagttggaattttggggactaaacgaagccagttggggtagttggggtgcagacaggtgtttcgtgtgtccacgtctcgaaacaatcatgcagaaacatcgttcgctgggttgcagcacaagctcgcacagcaatcgtatccttatgtattgcgtccgttcgaccgttccgtttcgcgaagaaagtacctattaacatcatgagaaactgaacgctaaagcgccctttgagggcaagttcaacgctctattgcaatgacatcagtgcatcactttcctcttggtgacagtgaattcaaaacagaaactgcaagtggcatccgttgctgtgagctaagttaacgaaaccatgtaggagtagtaataaactaactgatgcacatattaactatactattaatgaacttactaactgatgtacagattaactaagaaattaatcagtttcccaccgcctgaacctccggaccagcagcccaggcaccggcgggtgcaatgcaatggaatgtgcacgtacgggcgcacggcgcagtttacatgcgacgaccgagcgagccctgtgcgtgcatatgatcagacagcatcgctcccggcgacgtccggtttggtggtggccgcggccgggagaagcgagctcctgcacagagggcagctcggccgcgagcggagccacgcgtccacgcactccgggtggaacccgtgcccgcacagcggcagcgccttcaccttctcgccctcttcgaactccccgaggcatatcgagcactgcgcggcgccgccgtcgtcgccatcacctgcagccgacgccacggcccggtacagcgccacgggcatgctcgctatcgtcgcgtcgtcgaggccggtcaccgatgaggctgaacctggcgcggtcgccgcagcgtgcgacgaggagaagccggagctggtggtggcgggcatcggcgtcgtgtcgcggccgtagcggtggcagtggcacgcccagcggaggtagagggagacggcgacgaagcagacgaggacgaagaggagcgccacgaggagcggcaccgcgcggccgcgcaccgcgaagttgccgtcgtcgacgtcgccgtagcgccaccggagccccaacgcctgggacgacgcgtcctgcgctgccgccatgctgtgcaacgtactcctacgcggctgagccaaagtccaaacgcagcagccgcacgcacacgtcacgtattcacgtagtgtcggtttgtgtcgttcgtcgcgcctcggcggaacaaaatttaaggcgcgcgcgcgtgcggttcgctgcacgctgcgacgctgcgttacgtggctaacgcgggctcggcgatccctgtccccagccggtgctcaaaatgcgcggtgtgccggtgagtgtgtgatatggtggttcctagcttgtttcccttttacgtttgacgaaggctagtcgttcatgggccaagaaatgaggcagcgactgttggctcgacgctgttcatgtagagtgggacacgacagttaccacagagattcccaggaatgtttcacgtaccgattggttgttctcaatatgcagatttgtggaaaaacagaggcctcctgcggttactttgaatttctggaagcatcttaatcggtgttattattcttcgctgagttttgtgtggctgtcgttggttcgtgctgacatgcatggtactgcttgctgagctactgtcacatgtcgggattatgctagcagctgaaagaaccatctaggcagagtagtagtcctatttgattggtttgtgcgggtcagtttcatcgttatgacgggtttgtctagatacacaaatgaccaattcagattgtagccaaaataaatcttatcaagttttaataatgctaaaattttagcaagatgacaatattactaaaattttggtagtatttcttatgtgttaaccaaatttagcaaactaaacgtagatatttttttaacaatataaaaaaaaaggtatggttgaaaatggcatcaaagtgaagaggtccaaaatttggtgatatattcacttctccagttgtccgtgtagaccatattggactcttgaaagtttgcacaggagccacgtcttcacagactccactagctagttctgtgaacatacgtgcaccactgcatgaagtgaactcgttcccattttctcccacagtcacaggagcaccacgatcggcatggcactgacctaataacaacaccctaacccccatgggccaggcccaatctgaggcgatgggcattgcaaatagagccgaaatagatgtaagtggatatacccgtaaaccaatttatagatcaaattagtaggtaaccgtgagttaatttataggttatccaataattttatttataaatagattcacgggttgacctatttacatcctaagctgcatcgatccctccaatgccccaccatcacgcttctaccagttgggtaaaaaaaaaacacaacaggctgaacagcttacgtgttgggcctagtttagggtcaatatacagaatccattatatgccattgagtttgtctcatttctatgattagctattgactttgtcacgttctacaatataccatcgacttttgcttaacttctacgatttaccatcaccatccggtcagtctccgttagtaatatactacattttttttcaaataaccaaaataactttaggacacaaatatccaaaattagaataaaaactctaaaatcgttatttttgcatacctttttagaggcatacgggtgatcgacccaattgcatggaaaaaatgaccacatgcaaaaatccttttttatagtgccacctaggctcgcacaataaaatttaaatagtttttatgacttgtgaacaaaatttttatagcaaacgtttcacaaaataagatttgtttgggcttttttttaagataaagaaaactttcagactccaaggggttcgtttggaacaaataaattaatttagatgaaattttaaagataggatttctatagaaataattcctatgtggtcatttgaaatgaaactaggaatggctctcctaaacccctttaaaattctttaggattacctcaaaccatagaaattttggtggatttttgacataaattcgaaccttctggaaaaaaaattcctttgtgtctatctcttttctgattcctatatttatcctgtgtttcatccaaaaggtctttttcgcaggtttttttgtgtgtttttctattataggatttaagatgggctcaaaggcacttcaatcctactagtgttttttttctaccaccccgtgttttaaaaatcctgcgttttaaagtagttctaagggcccctttgatttgtaagaaaagtataagaaatttggaagattttaatcctatgggaaaaaaattcctatggaaaccatatcgtatcatatcatatactttgaaattcctatggaataaataatcctatagagattttggaggaaagttagtaagaggttcaatttcttggaaaaattcttttgagcctatctctctaatctgattcttacgtttttccagcggtccaatcaaatggtcattcctgtgttttttttatgtatttttcaattttctgttttacgcttgtattcctatcataatgctgtgtttttcctatttttttttattttttcattgctgggatttaaaggtgcctaaaatatttcaaatccttgcatgagtgtgatgtgacatgccgagggatgtgtgtgcgtgtgcaggtataatataaaagaaaatgtcaacattgtagccggacccgcggagacagcgtcgagccactcgagcggcatggaagggcaaaccgtacgctggagcaaggaggctatctagacaagtctggcagctatagcaagctagccggtcctgatgaatcgaggaataccagcctactgcctttgcctagaaataattttaactccctaaaacatcaaatcggccgctgcgtgacatagcatcagtcctgccaaaatctttgcctctgatcacacgggtggacgtcgccatcctcgttaatgaagccctttattcccgcacagcccaatccctgcagcctgcaggcatgatgcaaggcgtaccagcggacagcagatacacagggggatgcaaaggccggattcagctagcgctcgtattttaactcgggccgagtttagaacctgtttgattggtgaaataaaaatttttagtagtcacatcgaatgtttgaccggatgttggaaggggttttcagaaatgattgaaaaaactaatttcataactcgcctggaaaccgtgagacgaatcttttgagcctaattaaaccatcattagcacatgtgggttactgtagcacttatgactaatcatggtctaattaggctcaaaagattcgtctcgcgatttacatgcaaactgtgtaattagtttttcattttatctatatttaatgctacgtatatatgtctaaagattcgatgtgatttttttttggaaaaagtttttagggaactaaataagaccttagttccaaattttttcttcaaacttccaacttttccatcacatcaaaactttcctacacacataaacttccaacttttccgtcacatcgttccaattttaaccaaatttctaattttgacgtgaactaagcacacccaaaatttcggtatgcttgggtgtgcttagttcacgccaaaattgaaagtttggttgaaattgcaacaatgtgacggaaaagttgaaagtttatgtgtgtaggaaagtttttatgtgatcgaaaagttgaaagtttgaaaaaaattaattattgtagctacagagttatatacaatcgtagtttggtactcgtagtacgatattggaaggttttctcgataggtcgatcagcaagaaattatacctttacagtcagtactatctgcgtctggttcgtggtcgtccgcaatgacaccgtcgtcggcttgccgcgctaggacgagcgcaggtgtgttgggagtctaatttacaaaattccaatgatttagaatgatcacttctatttaatgtcaaatttattaatctactgtcatgaggatgaagtcattgtaatcggtcattttaatttacttgctgccgttcttccttttctcttcttcctaatctttcggttgccttcttctcttggttcttgctgacgtaggagaagtagagtgcgtcaacatctcttttgataattttttgatcacctcacgattagcgtcggtcgattggacgacttagcttttagggttttaacattgagagagtttgagagtccccgcgaattaaatttcaaaatataccgtttatttaatttttttaaggaatatttgggatgaaaattttttttttgcgaaaatataccgtcgatctcgcacaatcattgcgcgaaaataacggatgcgtgacgtcgcaggcggtatcgcgtgggctatgtgcgagaccgcgcggtcttacgaaatgaaagagcgaggtcttgctgaaacagtctgcgacagtattaaccggctccatttaattagtgatcaagtacataattaactattagctaataataattagtgattaattatcgtgcacggtgcggtctcgtactttcaatgcgcaataccgtctgcaatgtcacatccacgtcattttcgcgcaacggttgtgcgagatcgtgcgagatcgacgttatattatcgcaaaaaagtttacattcgaaatattttgaaaaaaaaaatagatgaacaatatatttttcaaatttaattcgcttccctgctacctctcctccgctttatttattttgtagggatactggtagaactcaggtgattaatcttctgttacctaggttcgattctgttttacactaatcatacaaaataaaactttatcttatatttttttcttaatatataggaaaggcaacgatggttctatcttttttttaattatttttatcggcagtagtgaacccataaatcaaggcaccggcgtgacaagcacacgatcaagcagcaacgtcgtcgtctcgcggccgcccgaccggccggcgccgtggcctggtgcgcgcgacgcgattgcattgcatgtgcacaaccgtacatgtgcggcaccggcccgtgcagcacgaatgcaggatgcaccactgcacacggctaagctaagctgcgggggcaggtagggggccagattttccatgtcgctactccgtgccagtgccactgcagcgtcgtcagcgactctcaggcgcgcgcggccacatcatatcatatcatatcatatcacgtctcgtctcgctctcggtgcaggcggtcctaggcgcgcgcgcgcgcgctcgtacgtacacaggccggaatgtcacatggcaatctcttcacggcgacgcgacgcggtcggtccgtacgacgacgttgcgcgcgtccgggttctcgctggcgagctgggcctgacagaactgactgttcaatgtgttcatagactattctttgtcacggaagagagccgtgcctccgagacgaccatagcaagttcggtgtggagtaggagtactagaactaaaagatcatcaggtgttccaaattggaaattgagattttcccaaaacgaaattaagatgaggtccggagtataataacgcatggcaaagcccctatagctagactcactaaacatgctcattgccgtcagctttgtgacatcttaaacacacaatcacccacccggccaggagtttttcccatttaatggagaagcttgaagcaatgaaattgttggcgtcaaaagtctaaaatacatgcagtcgtcaaagaacctggattaatttgcaatgagcagatttttttttaaaaaatactaaccggttttcaggcaaatcgactaagaaactactactactctagacatgaaggaaaaaaataaaaaagataggtatttctagtcgcccctaacccgaaatatacataggggcacctaggatcagtggcctggtattaaatatattttagaatagattttgagtgcctccaaatttgttaaagttcagttattttattcatccgttggatgataatacaatggttgccaacacctcctaattacacttatttaaacaaagtcacttctttagatacatggttgaaaaatatgttactctaaccagaaaaaaaatataaaattacatgaaataaacttatagctaataaaagggtataaaatttacgtgcattttttttaacttagattaaatataaagtaaaaaaaatcatatataacgacaaatttgtagttagatatatgcattgtggaattatagatgactgaaaatgtataactccttaaccgtatgaaatctatcaaatccctaattaaaatagaattgcacatcatgttccaatccaattaacgtaaattgatggagagaaaaatatcacgtactctccatttatcatatataagcatttctactctatccgttctaaaatataaacaacactatcaccttctggcagttctagctacttcctaccttaccagtgtattttgaggtaaattacaaacacccccttaattagccgcctccgttgcctacttgcctccgccctgcagtgatctgtcatgcatggcttgtctctgcctcccatcctctatctcctcctctttgcctagcctccatttgtttaagctgatcgaggcgaccgcgcgatgtaacacggcaaggcatgcacgtacacgcgcggacgagaagctctgactcgttgcaggctagaatgctacagtacagtagatagctggtacgtgttaagaccgagtttagttccaaactttttcttcaaacttttaatttttttatcacatctaaactttcttacacacataaactttcaacttttctatcatatctttccaatttcaaccaaacttctaattttaacgtgaactaaacacacacttaatcttccagaggcccggaaggtaggagtagctatatagcctattgttgcaagcagagccaatatatatagaaggaaatatatacctggtacgtacgtactcgtcgatatggaagctaagctaagctacaccgcgaagcggctgggcactgttcatgcatggccatcgaccgaatagaatagaaagtacacgtacttgtagccactgtgtcacagcgacttccatttccaagaactgtactcgcgcacgctcggttggaagcttgtaggcgtacggtatcgggcgccttcgattcaacgatttcctcaaagtgctataacatccttccaatgatgatgatcagagatttggatgactcgagtcttgtgcaaccatgcatgcgcatatatgcatgtgtcgttaagttataagctcgacagtgaaatcccatcttgtttggaagccgaaggttttccaaaattcgttgaactttcttaggataattatggaagtgataattcagtgtgttcaactctttcgcgtttattatattaaaaaatagttttttttaaaaaaaatatgtgtttcaaatcccgctaactctatttgaattaatttctctcaacgtatatatgtgtggttacctattatcctagtgatcacagagccagaaattctaaaatttataagtagggaggtgtttgctgcggtcatatataacttgtctcatactcctatttgcttaaactataataagctagcatttgcttaagcaaaaataatttgagtacgatggtaattcccgatagaaatgaatggagggatcgtccaaagtaatgcttccaagagtagaccacgctaataagtcccataagcgctcatggagcttatatgacccaatgactgaaatatttttttcaatgacagcatcggctacgtacagggcttcaaatatccaccaaacacaagtctgtacaaggtaaaacaactggagtagacagaagactagaggtgaagctagctagaaacgaataaagagccattattctatgctgtctctttgccaccatctccggggatgtgttacctcccgggtggtcatgtgtacaaaggggtgaatgtgacacaggtaccaatcatgtgatcatgtatttcacaaaggcactcaataaaaagggattgtacggcttccgaagaccctagctggctaggcttcttttcaccaaaaatatagcgggctttcgatcactggtactgtatgagtgctagtaaaaattaaagtcgagatctctagagactagagctatcccatccatgtacgtacctcttcatgaattaaagcatgtattgtgaactaacaatgtcaacattattcatgaccgaatctgtttatttcatctctcgctgtatagtacaaattaggactttaattttgcaaagttgtagatatatgtattaattaattgtttaaatgttgtgatatttttcttaaaaaatataaccattcagttgatatttaagaacaaaaaacatgaatctaaacgagtgcacgtgcacttgagtaggtacggagcacaatttttctgcccactgcactgatcatcagaaataactaggccaattacgaaaacattgcctacgtttttttattaatagaagaagccttgcgttgatcctttttcaaacgtaattaaactcatcaatttaaattaattaaactcatcaatttaaaatcaattcaaaccctggtcttaggtgggttgactgtaaccctattttcttcttaattgattggcagagttcctatcccttttctataagaattcaaagcatcaaactatgagactagagggggaaaatacaataacagtgcatgatgtatttcttaagaggggaccgtctattgtccaatataaaaattcaatcaaattaaaagagtagccagcttacatcggactcatgtaagatcgtaatctaatatatatttcctggtcctattacataacccatgatatcttcattgtacatttttgtcacgctctcgtcaccaatgaagtcgctaaaggccccttctctcttccccacctcttcagcaatactcccatgtgccccccttttcttctttgtcggtgattcgtcttgtcgcacttttcctgtctgtagtggcttatgcgacacactccctctactacatacctaaacatacttggtctttctcaccttctagtggaatctaccactgcctcatccagttcaattcattgcttggaataatataacgacgccctttaatttctctgctcacctttaggttttagccatctagatcatccctacaagctctagacacacacttcatgctgtgtctcttcgattggcgtttttaatttgttggtgtcaagtcttagagtatgaatctcaacaccaattctcttatttttcctctttattaaccgatttggttcagtgatatcactgaaccaccaaatcacttacaagattgaccaaatcacttacaagattggccatgacgatggttaatccaaataacatattggcccgggttccaacttctaccctcttagggtaagttatgagcacgagaattacagaatctaggaacaaagtaaatatcaaaccgtacttgacaaagctttatcgatcaaatataagaagctttatctgataaaacttcttgtccagttataatttgtactatacatggttaaaaaagatcacgcggagtaacagaaccatgcatctatgtgcttatactctcccatgcgattgtacgcgcgcagtatatatatgcataccgcgcgtctcctcccagcaagcggaaatagctccaggggctgaaacaaacccagcacatttgtgtttgtacgcgcagctagctagccacgagcgcggatccatctcctagctagcgcaccatctatggatccataccacgactaaaacatgcatgacccacgcggcttccccatccacccgcagccgtaccacctccaccccacggccggcggcctcggcgagggcaggatgcggggcggcgggcggcggcgccccggcgccaagctctccaccgacccgcagagcgtggcggcgcgggagcggcggcaccggatcagcgaccgcttccgcgtgctccgcagcctcgtgccgggcggcagcaagatggacacggtgtccatgctggagcaggccatccactacgtcaagttcctcaaggcgcaggtcaccctgcaccaggccgcgctcgtgcagcacgaggagggctgccagcacgccgacgtcgccgcggcgttctccgccgccgacgccgatctggcccttgagctgaaccatcgccacggcggcgccggcgatgatgacgccgggatgacgacgctggagatggcgccgatgcaagaggcggtgggctacggcgacggcccggctcatcagatgatgcagcaagcgctcgatccagcggggcagctgatgatgggcggcgctcatcagctgcctcctttgccttgctgtgtcttcgtccaggagactgacccctcgtgctactcggtgtgcaatgtccacggtgaggagtctggtgcgcaaggatcttattagctagctagtgagacagtggcttgcttaggtagttaatttccttaagtatgctcgaatattggctctacccactagctgtctagctctacttagcttacctaggtcgtcaaccaatatattaccggttggtcatggtcccttaaattagctagactcttgatttctgtaagaatgcatatatgcatgcatggggttctgttggagcaatgcataacagagctttgttttacatgcatgcgtgcatgcttcctagatatcattctgaaatctgaacttgtttgctcgatcgcttaattgctatctcaccatttcggttagtctgatgtttatcgttcagctccattctgtgttaatttcttttcctttccatttgcggcatgtatgatagtacgtatattcttctcactacgtcctaaaatataagggattttaggtggatgagacgtatcctaatacgaatctggacatgctccctatctagattcatagaattaggatacattatatctaaccaaaatcccttatatttaggaacaaagggagtacattactactcgctcccccggtcacaaaaagatggtttgaacttttaaaatcaacaaggatggtagctcacgtattcacgcgggcaagtatatcataagcccgtatttgaaaaacttataaggatcagaagtacattttcttcataaatttatttgctggctttgctcaaatatttttcattaggtatttgttatcttcatactacgtaatatttaattcatctctataagtaattattattttcttcttcatcatttaaaaatgaggtagacttagtttgtttagaaaacatgtctaatagttcaaattaaaaataaggtgcttttttctttttagattgaatgttttgggatttttttaacaaatcttaaaaaatattatttttaataatggaccatcaagctagccctccttttaattggttcatattaatgtaatttgttatacatatatttacatatggatcagtaaagatagattagatatatgtatcctgatcttgcttacaggagacgtgcacaggtacgcccgacattaggaagagatgagttttatttcctttgagatagattcattggtttcaccaacttgagttatctatatttacaaacataataatgacccaaagttctatacttattaaatatatattttctaattaaaattgtttattattgcatattgttctatttaaaatatatgtgttgctaaatagattgttaaaatatctatacgattttccctataaatgtgttttatttcttttacttactaaatatagttagtttgggtcttcaactataatttttttggtaaatattctaatgttctaatgatgtattatgtattttctacataatatagcatgaagaggaggagagaaaggatatatggcgtacgtacgtgcacacagtacgtgcaccagtgcacgtacacgatacggatttaaagtgggtccaccgtatttaaaataaaatctatggtttaccttttaagaattattagatattccttaaatttattaaaacaccatgtggcgacttaggagcgtttgtaggatttacacgtggcggcttgagagcgtttgtaggaaatttaatagacttttaatatataataatagataagatataacttcgacatatagtgttatactattatgaaagcttagataatactagctaacttagctactcccgtcacaaataactgacgttttggatgtgacaaataaaattgtcgacaatgcattagttttggtacttcctccgttttatattataagacatatgtgtttacattcattaacatctatataaatatgggcaatgctagaaagttttataatatgaaacggaaggagtactaattactactatctctattctagaataatttcatttttaacttgcttttttctcgtttgtcccaaaataagttcattctttaaataataattgcataagtgtttgtaaaagtatgaaaataaatatattaggaacaaattaacaaatgaataatttcattggtatttgataaagtaaaagtactctgatcttttatattgatatgtgtgagataagtgaaaaataaacttattttgagataaagagtgtactatttaacttataacaggaaactattttgatccctcgaggggactcccctcgttatttgcatatcactcaaatgattatgacaaaaattgaaaaaagaattgagaagttgtattaacatgcgatatatcacttcacaaatatacaagttcaaaaatcaacttctacatcttgcaacggaaaaaaaattaaactacaacaagttaatatgtattcacagttaaatttgtttttttcgttgcgaaatgtagaagttaaatttgaacttgcatgtttgtggagtgttatatcacatgttagtacatcttctcaatttttttataactattagagtgacacgcaaacaacgaggggatgtcacctcgagggatcaaaatccactcccaacttataacaaagtgttacacattaacttagggtataattaaccgaatgcagtagtataagttacaacaaaattctactacctccgtcccaaaataagtgcagccataaatatctgtgtttagcgctttgaccatccgtcttatttgaaaaatttatgaaaaatattaaaaaaattagtcacacataaggtactattcatgttttatcatctaataataataaaaatactaatcataatctttttttaaataaaacaaacggtcaaacgttgaacataaatagtactaaaactgcacttattttgggacggaaggagtacgttccaaatggaccactagcgggcaccctcaacgccttcctcttatcactatctctaaaaggattttcattataaaatggcaatacaaagcgaccacatgctagctaggtgacattgacacattgttggacttggacgtaagtgcccttaaactcatcagttgcaaagatacacagtttatactgactaaggtatatttcttccggattttctatttcagatatataaaaaatcttatatttttaaaaatatatcacttccattaaattgttattaaaatactgtaaaattcatagttgctatttcctaagaccatatgcagtggcgagttgactcgtgtaggccacgtaaaatggttcgagtcgacgactccctcatctccacaaatgctaacccgtcatcatgttgggctatcctaattaataaaaaaaaatcccaaacatgaaagcaacgtgaccataatatttaggggcatttgcaagccaaccactgtttttgatattttgtaaaaatgccacacgagtggtagtttatggcagtttttacaagtattcaaatgacagttttacaacaataatttaaacagcggtaaatttataattgctcctaatatgtacttctgcatgcatcaactcatattatgcttcggtttttttgcattatgcaagattcttgtgttctccggtgaggaagactcgattcataagttgccagctcgttgtatatttatatgaggcctcacagcacgagctcagttttgttatggctccgcttggtccatgcagtcaaatcgatagagctagacgtttagttttatctatttaataataagagatgatcatagtcgatttagataaaagaaaatttaaaggctattgataacaatccggctcaggtggggttggctgaggcccaataacttaagattgctcggacctcaacagttcataggcacacacactcggggaaaggcccaatctccctaaaagacactggtggagaaggagtttttactcccggttcgtaaccccctgtaaccgggactatgaatccgggactaaagatcgctatctttagtcccgaatgaaaaaaccgagagtaaaaatccatttttagtcctggttggtgtttctttagtcccggttggtaacagatcggttgctactttattctattcttttcttcattgtttttaatatattgattcactctatctcatcccaaaatcccaaatcaatcatccccgaatagtctccaaattctcaaatcaatatctctaaatacatcacaaaatcttaaaaaaattacatcacaacttctacaaaattcatcacaaatacatcacatattcatatcacacacaaatcgtctcagacccgaattgtaacgctccgcttttcgtgaggcgttaaaaactaattcggcaaaatcctaattgcgaaaattttcgttctttgtgtgagagtctaagtcgtgccaagatctcatctcaaatcacattgttccctctcatcgaaatcaaaatcctccacctcaaattcctcttccgattcaagtctccaaatcaaattccgaaattcagtcgcatcctttgaatcctcgctaaacactcgctcccaattccgaaaaataccaaaccctatcttgagctttccttgattcctccctgaaccctcgagttcgaatatcgaatttgaatccaaatccaaactccaattctctccaaatcagccttctctgtgaaagtctattttacctccctctggctcagtgggccgactcttcttccccagcccatctcctctcagcccgcttcacctcctccccgcacgtgcgctgcatgcgccgagagagagagagaggcatcgcctctcttcttcctctctctttcctcgctctctctctctgcttcctttctccctctcctcagcgccgatttcccgccgccgccgttcgaaatccggctgcacccccgcgtcgcgcgcgctcgctcgagaggtggccgaccggccgaacgccgccgccatcagcccttgcgccgccgacgccacgagctgccgccttgcccccgctccatgacaaaccgaccgccgccgtcatcgccgacgtcatccatggcccctgccactccacgccgcatcgtccaagaatgggagaagcagctgcttcccctctcctcaatatggcaaaggaccaacccccctttttccccccttctttttttccctttccccgaccaccgccggcgtcaccacctctgcgccgcttgaccgctcgcgccacccgcctcatctccttgaccgccccaaggtcggttctctcaaactgacatcgccacctataaaacccacaccccctcccatacctctcgcttcctctcctccatcacaccactgccgcctcgccgttcgtcgtcgttctcgccctcctctgccgtcgtgcgtgtcggggaacttgcgagcacgaggagtcgacgaggagctccgcgccgcccccatcctcgcgcctctccatctgttcttccccggccgcgccctctcggtgccgcgccgccccgccgtcgcgtccgcctcgccgcgactccatccgcgccgccgactccatttctctcgtcggtgagctccccaccgaaccccttttcccctgtcgcacgccgcgccgcgcccgccgccgtgtgtcacatctcgccgcgcgcccttgctctgtcccgggcgtcgctcgccgtcgccggcctctatcggcgtcgcccgtgccctctcaaccggtggaatgagctcgcgacctcgcgtagatgctccagctccaacgaatcgaacccccgttgccccagtgaagttttccctctttgctcgccgccgacgatcgctgtcgaaatccgccgtcgtcggctcctctcgcgtcgattcctctcgccgccacgctcccggggatccccttgacctccccctggctgccccaaggccgccggccttctcctttgtctccgcgccgtgtcgccgtttccgccgccgcctaacgccgccgtgcgtgcgccgtcggtgaccatcgggtcccgcgtccccgcgtgcgcatcgcggtcgcgtactggttcggcttagcccgagcccgcgcgcccttcgctcttctcgcgcgtggccacgtcggcgtgccggcgagattggtcgccgccgccagccgccgtcgtttttcccccggctaatccgctccattgaatcgattccccttggcctcctctctctttcggtgctacccccccaatccacctcgccgctgttcgccggttcacgtcgctcgtcgccggccatcggattagcctgcccggcctcctctcccttccccatccgacgtggcatccatgtggatgccacctcagccgcctggccccgcggagaccggtcaaaggtctcccggtccaccgatccaacgcgccgccttgcgtgcaccccgctcgcgtgagccgtgtcgccgccttgtgggtcccaccttgcgcccggcacggtggaccgcgtccaccggcttgcgtcgcgtgggccgcgcctcgttcggccttgggccgcctccctcccgcgcgccggcccgctcgcctcggccgcgcccgcgcatctcttcgggccgcgtcccttcgctcggcccaagtccaattaacatccctccatccttttctttttcagggatttaataaatcatttttcctttgtcccataaatcaattccttattccaaaatcccataaaccatttcctttggtcccgcgtgacaatgactgtcaataatattcttgagaatattataaatttcataaaccatttctcctattccagaaactccaattaaacttctaaaaattcatatcacccaattcgcaactccgattgactccgttccacttccagtattttcataaaattgagatctatttaatggcactactaattagtctaaataggatctttcttttggtctcttgtttaggttttcgattgttgcgtatagttgcggttatcggtttttcgtcgatcgcgggttttcccgaagattcgtgaagcttcgtgaagaccttgagcaaggcaagtcaccctttgatcaattgcccctataattgaaaagtcattattattttatttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacatgggaaataggtttgtgaagccttcaaaacccgacatgtggtgtcggtgtgtttgaaaacaaaatgaattttgaaaactcgcgatgcgggggttgtgcctatgtggcactgtcccgtattcgcatataaggaccgattcctgtgggaaactcatcgaacataatcaaagtgcaaccacaaggtgaaatgggacaccctggctaagtaactagtcggttcaggaaaacctcgcatgccaatagttgggaacgccggggcggggtcggttggagccaaaccgggttcctggtaatgcaagaacgagaagcttgctgaattaccgatcgaggtggttggagtttgaattgtgaacgcctaaaatggcctatgtttatgtgaggatttgatccttctatgtggcatgaggtatccctgggtcggcttgggaaaggctttgtcgcgaacctctgacaccggccagtgtctggagtaagttcgtgtcgtgtgggtaaagtgtaccccctctgcagaggttaactaactgttcgaacagccgtgcccacggtcatgggtggatgtgaggtggttcccgttgcgtagatttgtttgcctgtgctttgtgaaaagttgttgtggtgtgggaatcgtaaccagaatcagcctatgtggcagatggacgatctgagtggtcagaaacgaatctgtgtgattcgggatgtctgcgggcatcatagattaggcttcccgagtggaagcagattgttgtgctgctgggcagctggactctgggagtcaccgtgggtaccagcactatgtcctgggactggtaccgagatcgcggtttcgtaggaagcggttcacgttgttttccctacgacacgctcctgtcaggtgccgttgtacggcggtatcagattagggtgtgacacgaatcacagattctcaacaaaaaaaaaagaaagaagacgaacggcccgttgcctcgccagccaccgccgcaccgcccgccgcgtcgccgtgaagcatctaggctcccggtgttaattttggtaattaatgacaagcgctaattgtggactaaccgttgtctttgagctatacattttaagttaggtccacatcatatgtgcgcatggatgattatcgatggattaaaattgacggcgcaaagcaaagggaaagaagacggtaaaactagcgctttaatttagaattgatcgtggtgtagggcgatcaaatttgctagtttatttttagtttcgccgtactattaagaggggtaatgacctagcaaagagatgattacaattgccacattaggtcattgcattttcatttgtgctctctttttcatcacacacacattcacttgcaaattcactgggttcggcctgaccaggggcggtcagaccggccacatagtggcggtctgaccgacgtgccctggccggtctgaccggcggcatttgcgcggtcagaccggccccctggaggccgggatggtgctgctcgggatggccgatacagagccgacggagccgtattcggtcagaccgagccgatgacggtctgaccaagccgaggccggtctgaccggccaccccatgccggtctgaccagccaggccgttggggccctctgacagggctacaacagctagttttctagccgttgcagagtagcacggtctgaccggccacatacctccgatcagaccggcagagcacagagttaggggatttcgcccccaacgactagttttggtgggtgggagtataaatactcccccaccagcagcaagggggctctctaggcacccaattcaattgcatacactccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcctggaggttgccgtctcctagacggcttgtggaggagttgcccggtgacctctccgagaagattgtggaggaggcccggcgccggtttgtgagtggtttggagttcaccaccttcggagtgaagtaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttactttcctagagatataattgagccactatcaccctaggtttgcaaaacataaattagttgcttagttagagttcaccctcaccaagcctagcaacttaggttagatttgattaggtgttatttattctttaaatcgcctattcagcccccctctagtcgacatctcgatcctgcaagtggtatcagagcttggtctctcttgattgggcttcaccgcctagagagaagatgtcgaacgaggtgaaccatgtagggaaggcttccatgtttaatggcacaaactactccacttggaaaattaaaatgtctactcacctcaaagctatgagcttccatatttggagtattgtggatgtaggctttgatatcaccggcacacccttgacggagagtgatcaccgtaacctccaactcaatgcccaagccatgaatgccttgttcaactctttgagccaagaggagttcgatagagtgagcaaccttgagaccgcatatgagatttggaacaagttggcggagatccatgagggtacaagtgagtacaaggatgccaagcttcatttcctcaagatccaatatgagacattctccatgttgcctcatgagagtgtgaatgacatgtatgggaggctcaatgtcattgtgaatgatctcaaggggcttggggcaaactacaccgatcttgaggttgcccaaaagatgcttagagccctaccggagaagtatgagacccttgtcaccatgctcatcaactccgacatgtcaagaatgacacccgcaagcctcttggggaagatcaacaccaatgacatgtacaagttgaagaaggagatggaggaagcctcaccctccaagaagtgcgttgctctccaagccaaagttgaagacaagagcaagagcaaggtgaatgaagtcaatgaggacttgtaggaagagatgatccttcttgctagaaagttcaatgatctcttgggaaggagaaaggagagaggaaggggctccaactcaaataggagaagaaatagaagacccaacaagactctctccaacttgaggtgttttgagtgtggtgagaagggacactttgcttccaagtgcccttccaaggatgatgatggagacaagtcatccaagaagaagactggaggctacaagctcatgaagaagcttaagaaggaagggaagaagattgaggctttcatcggggaatgggactcaaatgaggagagctccgtctcatccgggtccgaggaagaaggtggtgatgatgcaagctccaagaagaagaagatggccgttgttcccatcaaggaggctccatcactcttcgctccactttgtctcatggcaaagggctcctctaaggtaacatcccttagtgatagtgagagtgatgatgattgtgatgatgtttcctatgatgagcttgtgagtatgtttgaggagctccatgcttatagtgagaaggagattgtcaagttcaaggccctaaagaaggatcatgtttctttggaggtcttgtatgaggagttaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatattgcatcatctagcatttctacctcttgggatgatcttatggatatgcctagccctagctctagctctagctcttgtgtttctatttgtgatgcctcacttattgttgagaacaatgagcttaaggagcaagtggctaagctcaacaagagtttggagagatgcttcaagggtaagaacactcttgacaagattttgagtgagcaacggtgcatccttaacaaggagggacttggattcactccaaagaagggtaagaaaccttctcaccatgccactcgttttgtcaagagcaatggtaagtattgctccaagtgttgtgaggttgggcatttggtgagtgattgccccggtggtaagcctcctaagacatgcatgttcgattctcattatatgcttaggaaggcttatgatggtagtattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgatagtggatacactcaacacatgaccggtgatagggctatgttcaccacatttgaagtaggagagaatgaacaagagaaagtgacatttggagacaatagcaaaggaaaggtaattgggttaggtaaaattgttatctccaatgatttgtcaaatgaaaatgtctctcttgttaaatctctaaattttaatttgctttcggttgctcaaatttgtgatcttggcttgtcatgtgccttcttcccacaagaagttattgtttctagccttcttgacaagtcttgtgtgttcaaaggttttagatatggaaatctttatttggttgatttcaattctagtgaagcaaatttgaaaacttgtttagttgcaaaaacttcattgggttggctttggcataggaggctagctcatgttggcatgaatcaattgagcaaactttcaaaacgtgatctagttgtgggcttgaaagatctgaagtttgagaaagataagctttgtagtgcttgtcaagccggcaagcaagttgcaggttctcattctactaagagtatcatgtccacatctagaccattggagctcttgcatatgaatttgtttggcccaacaacctataagagcattggtggtaatagtcattgtcttgtgattgttgatgattattctcgctatacttgggtgttctttttgcatgataagtctattgttgccgagtttttcaaaaagtttgcaaaaagggcccaaaatgaatttagttgcactcttgtgaaaattagaagtgacaatggttccgaatttaagaataccaatatcgaggactattgtgatgatcttcatatcaaacacgaactttccgctacctactcacctcaacaaaatggtgtagtggaaaggaaaaatcgtacattgattgagatggcaagaactatgctagatgaatatggtgtttccgattctttttgggcggaagccataaacaccgcttgccatgcaaccaatagactttatttgcatcgtctcttgaaaaagactttctatgagctaattgttgggaggaagccaaatgtcgcctattttcgagtttttggttgcaagtgttatatttaccgaaatggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgttgtaggtgatgaaggcttgatgagagctatgaagaacatgtctattagagatgtcaagtctattgaagtggaagacaagccatccacctccactcaagatgagccatctacttccgcttcgccaagtcaagctcaagttgaagtggaggaggagaaggcacaagatccacctatgcctccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatatttaggaacaaagtggattggtggtgagaaacaaggcaaggttggtggcgcaaggtttcacacaagttgaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggtttggaggatgcgaagcccatcaagacacctatggcaaccaacggacatctcgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaaggatttaaagcattcctatactattggcttgtggtacccaaaaggtgctaaatttaagcttgttggctattccgattcagattatgccggttgcaaagtggatagaaagagcacatccggtagttgccaaatgcttggtagatcccttgtgtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccccactcctatgtgacaatgatagtgccataaaaatagccaataacccggtccaacattctagaaccaagcatattgacattcgccatcacttcctaagagaccatgttgccaagtgtgacatagtcattagccacataagaaccgaggaccaactagccgacatctttaccaagcctcttgatgaaacccgcttttgtaagttgaggaatgagttaaatgtcatagatttctctaatgtggtttgagatggtgcactatggttgcttcttttgcattttgtatatttgctcctatttgctcttatgctttggacttattgccatttggttcttcattgtgaaaatggagcatgtcacattaagggggagttttggactcttgcatgtgctctacttccttttatatgtgagcaaatcaactaaaagtgctagtagtgtttttcaaaatgcccaagtcaacataagtcaaaacttttgcaaaatcaatgaaatttgaaaactatttcttggaaaatgtttcaaaagggtccctatatgttttccaagcctcacattgctagaaaaatgatttttgaacgaaaaatgccattttggctctcttttgaagaatctagattcttgtttttggccaaaatgagattaaaccccataatgagtttgagaaggaatctgagaaaagattcaaaacaaagttggtagagaggagtatttgaaatgttttaggtattcaaatcatattcaaaaaccaaatatttcaaaagttgtttgaaaatcaaattcgtccaaaaacccctatagaccataaaaggccacctcctagcactcaagtgagttttgttgcaaatcttcataaatttcaaatattatgaatggttggcaatatttcaactcacacatttcaaaattgctccaaaaatcaaaattttattgatatttattgagtgggggcagccaactgtgcaagggctgtgcacagtcggctggggggccaggcggtctgaccggcgctatatgcgcggtctgaccggcctggtggcagcggtctgaccggccactagggctcggtctgaccggctgcaacccggcggtctgaccggacgcgtaaagctggtctgaccggcctaggatggtgggcccaggactttatcctttcttcctcatcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaacactaggtgaaggaagaggtgttcttcgatttgcaccaatagagggtggtttcttggtgtgattcaactccttcaaccggtacatcactctccctcttgtgctttgctctcaaattggtctatctaaatctctagggttaagggtagtttcccccattgcttcaatctctatgaaatagacctacaccttgatgttcatgttccaatcttgtggaactttgtcctagcaatttttagaatcatttgtgtggattgtggaaggattcggttgtgctactgtcagcggcggtctgaccggcctatggccgtcggtctgaccggccgtgagacaccggtctgatcggccaatggccgtcggtctgaccggccgttggccatcggtctgaccggccttggctctcggtctgaccgcccctgacaggcagcacccccattcctccctcttcactatgtggcttctaaaattgttgcttatccatcctttgctccttgtttttcagccatgcctccccgcactcgccatggtcgtcgtgagcccacgcccgatcccgtcagtgagaatgaggaatcaagcggagatgagtatgttcaaagtgatgatgacaatatggaaaatgttgagggtgatgagatggaagtaagtgatgatggtgatgacaatgggagtggaaatggtgaagatgatgaggcaagtgatgatgggagtcctctcgattcctccatccaatttgtgcttaatttgaggaatgctcaacaatacactatcctccgtcatcatgatcaattccggaggcctaacgattgtaatgatccaagatttcatacacggttccaaaagtccgtgtatgcacaagtgtatgccaacaaagccttcgccgagcacaagtggatttcttggaggcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcggggaccctccgatgctctatcaaccgccatgaattcaaggagctcttgcacattcgcttcaacaacggggatgaccttcatgatgagcacacccacaaccccttccccattgatcacttttctcagttttatgaagaagggagaaggcacacatatggcaaggtggcgggtttgagggctctcccaagtgtgatcaaccgcatagtaagggccaccatcctcccaagaggcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctcaaactctcctcccctagagctcctcgtgtgcgccaaccaacattcgatcaaggtgcaagctcaagtgcagcccccctcctcctcaagggtatgatccaagtgtttttttttccatccacaatatgcctactttggaatgcaacccaatgacttcttcaacccggtccttggggctattaataccctaagtgaaagcattcaacgcttatccaccgggcatgaagcattgcatgaggatgttcgtggcttgcgcaccgatgtttgcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggactagtagtagtgaggttagtcacctcatatttaataggctaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttctgctatgatggatggttggtgtgacattgatatatttgtgaccatcttatgcccatggatgaatatttctttaagttcacattgagatattgctcttgtgtttgtgatatgttgaaatgtgaaattgaattgtgcattggctccatatttgctatttgtgattgttatgcatatgtttagggggagcttttgcttgtcaatacaatatatgtccatgtgctatatgtctgattatatatatttgtggtgtttgtcatcaattaccaaaaagggggagattgaagcatttaggcccccggtgttaattttggtaattaatgacaagcgctaattgtggactaaccgttgtctttgagctatacattttaagttaggtccacatcatatgtgcgcatggatgattatcgatggattaaaattgacggcgcaaagcaaagagaaagaagacggtaaaactagcgctttaatttagaattgatcgaggtgtaaggcgatcaaatttgctagtttatttttagtttcgccgtactattaagaggggtaatgacctagcaaagagatgattacaattgccacattaggtcattgcattttcatttgtgctctctttttcatcacacatacattcacttgcaaattcactgggttcggcctgaccaggggcggtcagaccggccacatagtggcggtctgaccggcgtgccctggccggtctgaccggccgcaagaaggcggtctgaccggagcataaggccggtctgaccggcggcatttgcgcggtcagaccggccccctggaggccgggatggtgctgctcgggatggccgatacagagccgacggagccatatttggtcagaccgagccgaggccggtctgaccggccaccccatgccggtctgaccggccaggcagatggggccctctgacagggctacaacagctagttttctagccgttgcagagtagcacggtctgaccggccacatacctccggtcagaccggcagagcacagagttgggggatttcgcccccaacggctagttttggtgggtgggagtataaatacttccccaccagcagcaagggggctctcttggcacccaattcaattgcatacactccttgcacctttctcacactcacttgagctttgtgttcatccatctagtgtgttagagggttgtttagccaagagtcaagtgcatttgcttctattgtagagctagtgtggcacttgatcatctcaacaccgggtcattgcttgttactcctggaggttgccgcttcctagacggcttgtggaggagttgcctggtgacctctctgagaagattgtggaggaggcccggcgccggtttgtgagtggtttggagttcaccaccttcggagtgaaggaagaactaccccgagtgatcctggcttgggtagtcctctccgtgggccggctcccgccttgcccaccccttgacgaagggggcgtgcggtggctttgtggttgagcggtggactagcaacttaggttagatttgattaggtgttatttattctttaaatcgcctattcacccccctctagtcgacatctcgatc

SEQ ID NO: 31263 - DNA, 11280 bp, Oryza sativa
ccctaatagtcccctcccttccgcccgactttagctttcaaagcggaactaaaattgtttttagtcccttctttaatagtccttccttaatagtggaggatgtcctcatcattctcaccccccttcctccccctcccttccgcccgactttagctttcaaagcgcttaatagtccttccttaatagtggaggatgtcctcatcattcccacccccccttcctccccctcccttccgcccaactttagctttcaaagcgggactaaagatgttttttagtcccttccttaatagtccttccttaatagtgtaggatgtcctcatcattcccaccccccttcctccttccaagctaagcaagacgctttccaccccccttcctttcggcccactttagctttcaaagcttcccacccccctgccttccgcccgactttagctttcaaagcgggactaaagatgtttttagtcccttccttaatattggaggatgcccttacagtgggtaatagtgtaggatgtcctcatcattcccacccctttaaataagggcccaggtggggttggctgaagcccatagtggaggatgtcctcatcattcccacccccttaaacaagggcccaggtggggttggtcgaggcccaataagtaataacttaaggttgctcggaccccaacagttcataggcacacccactcggggaaaggcccaatctccctaaaagactagtccaataggggaagggtggctctcctttttaaggtggcttcctccttccaagctaaacaagacgcttttcaaccccccttcctttcggccgactttagctttcaaaatgggactaaagatgtctttagttcccttccttaatccccctttttctttccaagctaagcaagatgcttcccacccccttcctttttgccttctttaaaagttaagcaggactaagttaagcagagactcttccacccccctcccttccttccgccctccttccaagctaagcaagacgcttcccaccccccctcttttccgcccgactttagctttcaaagcgggactatttagtctcttcccgcccctctcccttccggccgactttagctttcaaagcgggactaaagatgtttttagtcccttccttaatagactttttcaaagcgggactaaagatgtttttaatcccttccttaatagactttagctcccttccgtccgactttagctttcaaagcgggactaaagatgtttttagtcccttccttaatagactttagctttcaaagcgggactaaagatgtttttagtcccttcccgccccccctcccttgcgcccgactttagctttcaaagcgggactaaagatgtttttagtcccttcccgccccctcccttccgcccagcgggactaaagatgtttttagtcccttcccgcccgactttagctttcaaagcccccctcccttctgcccagcggaactaaagatgtttttagtcccttcccgccccctcccttccgcccagccgcccgaatttagatttcaaagcgggactaaagatgtttttggtcccttccgccccctcccttaaagatgtttttagtcccttcccgcccccctcccttccgctttttgaatagaaagttaatgtatctaaccaactattttacaggagtatctagttggcgaaggcgatttcagaataaaaaaaagtaaagtcaaaatcatttagaacttctaaaaggttctcgaaaaagaggtaattttttttgggcctgtattctttttctaggttcactaggattcttagctttctttttctaggttcactaggattcttagcggttggggcttccagttatcttggtaagaatattcagaatcaaaaaaagtaaagtcaaaatcttttagaacttctgaaaggttctcgaaaaagaggtaattttttctgggcctgtattctttttctaggttcactaggattcttagcggttggggcttccagttatcttggtaagaatattaactaaagatatttttagtcccgcccagccttttagtcccttccgcccccaggtggggttggccgaggcccaataacttaaggttacccggaccccaacagttcataggcacacccactcggggaaatgcccaatcttcctaaaagactagtccaataggggaagggtggctctcccttttaaggtggcttcctcctcccaagctaagcaatgtgggattattcagaggctcacacggtcgccgctcgactttagcgtctctgccagcgggtaatagtgtgggatgtcctcatcagctatgctgctaaaatttaaagggctatgtatattttagaatattggaattaattactttctgagaacgtaaatgtgggctagctagctgtatatacatgcatgcattggttttcctcggagcatatgcatcagatggctgtctagcagtcctccgtaagttaaaaaaaaggatggttgtcaagtactaattaatttaattagtctatcaccgacctgccaccggccttggggccttgccacgcttccggcttcgcttccatttcccagcgaggacattacactgtcttgtgggcctcataatttagctcacagggcccacatctcaactgcaaaatcctaacaatgttagtactgtacttctgtagtggtactacactacttactaccgctaattgcagtactttaccatctagtgtcggcgcaaccataccatcatgttagccgtaccataaagtctgctatcattgcgtaatcacggtttgtgcctttgtgggccttaattacgacgtttacccttggccatcgaagacaaggattaggcacaccaaacatcacgacagctcctcgttagtaccacattttttttaatcatcaggtgaacggcagctatgaacaaagctgagattttatcctgtacgtacaagtggaaattcaggtttcagatgggagttaattgaaaaaagaaaatctgcaaccgaatcgtggacttatctgcaccgctagtccgaggaggctgtggagagttcgactcggcgataccagtaggcgcacgcggcgcaccgcaccgagccgtcccgcgagcgatctcacattctcacgaaccaaacgtgtcacgagggcccaaaaaccacgcgccccgcgaggcgtcgaccgaccccaccgcgaactctcccgtcctatccgcagcggaggcagcacgcgacgcgagacgaggcctccacgccagcgagcctcctttgtttccccctgcggcctcgcgagaatccaaagttgtacttggcgaaaaaaaaaaaacagctctcgcaaaatctcgctgccgctgccgctcgcgagcaagctctaccgccactgccgcgcggctgttcttgcttctccggaggggaaggaaccccgcggggagggagccttccacccttcgcaaaagccacgcgccaccaaatcctccttttctcctcatcttccctccatcccttcctccctccggccgcgcgtcgctttcgccgcgaccgaatcggtggggtcgtgtggggggaggagaggggcgccataaaggcggctggggtcggcgatgatgagcggcgttggaggaggcagatcgggcgggagggacgcggagggcgagtgggaggtccggcctggcgggatgctggtgcagcgcagggacggcgacacgggtccggccgtcaggctcagggtctcccacggcgcctccttccgcgacgtcgccgtgccggcgcactccaccttcggtatgatcctcgcctcctccctcctcgtgaaactcgccgtgggcgattgcaacgagggtgccttgtgatcggttatgtttcgattagtatttttgatgtaggcaagctcaaacgcttgcccggaaagtgcacgacgaattgccgctcccggttagttacagcagcgaccaccatgctcgatctgctatgttgcacttgagctacggatcttgaccagtcaacccggcgattcgtcgaggagttaataagatcacatcgtccttgtctccttttccgtgaatcgaattggatgcaaatctagattcagaacaaaagcattgcaatactatgtgcttgtgtggcagggggcaggcagatggattatggtcctgctcttttaactataatatcctcttggactgtggcaagcagatgtacctaggtatatggcgacaaaaatatactagtttttaagtgtatatttgacgacatgtctgtgcgtcatgctatatccgtccaccattaggcccacactgaattactgttgtaccgctgtatttgtacacttctgttcattcatgacgttaaaactgttgtaccgttgtattgtattagtacactcctgttcattcatgacgttaaataggtgcacatactggctcaactgaggttgtgtgatttactaaatttacactattttatcattttctgtacagatggaagctcaatgttatatagttcaacgtttgaaagaagccttctcttatcgaatttttggagtagttcgcagaagcagtacatcatgatctgcttccttagaaggaactggtttccattgctttgatatgtagttaggattaattgttcactcttttgtatgaaggtgaattgaagggggtccttacccaggcaactggcgtagagcctgaaaggcagaggctcttcttccgtgggaaggagaagagtgacaatgagttcctgcatacagctggggtcaaggatggagcaaaacttcttctacttgagaagcctgcccctgccaatgtagagcagagggccgagccagtaattatggatgagagcatgatgaaggcttgtgaggctgttggccgtgtaagagctgaagttgacagactctctgccaaggtgaaggaataatgtttctccagcctcttccattaaacattaactcttcttatatcttgatgctgatacggtttttgtttttgttctattaccaggtatgtgatttggagaagagtgtgtttgcagggagaaagattgaggataaagattttgttgtcttgacggagcttcttatgatggagctgctgaaacttgatggcatagaggcagagggagaagcaagggcacaaaggaaggctgaggtacagtggccattatacatctcaacatgattggtcatggcttatctcatataatacaaattcaattactagtactggtgctgaaatattggtcatcctaagctttcaaaatggtttattttctgttgataaatagctatcacatactattactcaaacctgatttccttttatttactaaaatttaaccacacacacctatgctgatgatggaattttcctgatgaatcaacatacatctatgctgatgatggaatttttttgttccttaccatgtagtgtagcattgctaccctgtaatgataaatcttattaatgccctttataggaccatggcttaaaagccatgaaaagacaatacatacggcacatctagtaaagaaagcttgccatttagctattttctgctatgctgaatcaattatagtcttcatttgcatcacaagggtgtctcccaactccttccaggactaattctagtttctttgtttgactttgaccttcccccgtactccaatgattattttcttggttatgggtaatgaactagttgtgtggcttgagcagttccacattaagacggtccatttagccttaggcttgtaaccagtatagcacaaaactattttaacttggctgtgtggtttgaatccagcttctaatgcaaaacctgctggagcttatacttaataaatgcctggtctgatatgggatagacctgaggtttataaccatttattagtgttggtttcgagagaattttgccagattaggacctttgttggtcaagagtgaaatgctatttgtagcttcctcacttttttgttgccctattatattgaagaacaagaccagtgaaatggtcagcatgcgcagggtgcttcaaaaacattgttgagccaagcttaatcggtagaacatcttatatgtattgtaacatattaataaagtcaaaattcatttgtttcttcagtttaaagaatccttattttgcccttttgaattttatggagttggtttggttgcttgacggtaatatatctgaataattgttgctgctatgaccatctgaccacgggtttggtccctgttgcaaaatctttttgttgtcataaagtaatagtcactggaggcattgtatgctgtacataccctcacaataacgatgacttgcattgcaggtacgccgtgtccaaggtcttgtggagacgttggataagctgaaggcaagaaatgccaatcccttcagcgatcaaaacaaatctgtttcagtgacaacgcagtgggagacgttcgacaatggcatgggcagcttgaatgcacccccaccacgggtttcttccacacaaataaacaccgactgggagcaattcgactagcctcggattgcgttttctcattgtatcgttaacttgtgagatcaggtatctaaattcctttcacaggcacacgattgttgtgtatatgcaagaagtttgacgcctattgctaacactgcctgtgcaatgttatcgaatgatgcaagtgatgaattgcttcggtgatctgttaggctgtcatatttcagtttgcactggcctgtcttcaggcttgcttctgcagttcttcagactcagatcaggcgtccacgtgcggtcgcgtactctacagttttgagatattctcagacctgtccaagctaactaagcaaaaccaatttacagtagattccactgaaaccatggtaccgtgaggtttgcttgtgtgcaatgctggcaaaagtttgtttatctattgggactcccagggtaggacacattgcatactgactgcatcagattgcaaatatctaccactaccccaaaacgaatcttgatttactccagaaataaaataatgaagcatatgtgtttagtaatatctgctactccatcttgctagttgcaagatctacctgtacgagatgagaattatcgtatggtcaacgtccagtttagctgcagtgcggcaaagcctgcgacaaaatgcccactctaccaccactacagctgaatcgtgactcctctcgctcccattccggccagccggtgatccatcgcctcgtccacgaccgcggcgccccacgcgccgcccctcgccccctcatggcgcgtcacgtcgaacctctcgccgtctccccatagcgcgtaggcctcctccccgtgcgccgcgtcgtcgccgatcttgagctgctcgtcgggcatgcggagcgggacgacgaggccgacgccgagcaggatgacggtggtggccacgacgttccacacgacgacgaagagcgcgccggcgatctgcttccccacctgggcgatgccgccgccgtagaacgcgccgcgcgcgccagggatgtgggtgtggacggcggtgaggtccggcaaggcgaacaggcccgtgaggaagccgccgaggaggcccgcgacggcgtgggtgtggaagacggcgagggtgtcgtccaccttctggagcagcgccgatctcttgtggaggatcatcatggagaaccacggcaagctgccgccacagatgcccatcagtatggccgcccacgtgtgcaccagacctgcatgccatcacacaactagttcgttaatccaactgaattaattaacgaatggccaattcaacgacctcattaatgaaactatgtgaatggcaactggctaatcacagtgtagtagtactaaattgctaatctagttggattctagaattgatcaaagctagcaggaagcagctgatacctgcgccgggggtgatgcagacgagaccggtcatcatgccctgcacggcgccgatgacggagggcttgccgaagaagatgacgtcgaggcaggtccaggtgaggaggctcgccgcggcgctgacgttggtgttgagcacggcgatggacgcggtgatgtttggggcgtacggcgcgccgccgttgaacccggcccagcccagccacagcagcccgccgccggcgatcatgaggaggatgttgttcggcgagaaccgctccctgtcgctcttcagcctcggccccacctgtcacaaaaaaagtatttattaatcgccgtcacgtggttaacacttaacgccgtcgagattcgtgccacgtactgttctagaatctggattctgcaagctgagccagcactgttttttttttttttctttctagcaactcgtctatatatgtacttttgcaggtacgaggaaattaggctcgagcctaagctacatcgaatcgtttctttccatagtactagttcaccatcgtccatgtccaaaacacgtctcactcgatcaatacacgcaagtgactagtctaccccgggcgctgacgactccgtgctcccgcgaccgcgtgccccgaacgtttcaccacaaagtccacacgtcacatgtactgctaatgtacgggtgcaagtactcgtgtaagtcctgacccgtgagcgcgcaccggaaaagtaaaccccggcgggtcgtgacaaaccgaacaaccaaaagttgtgaagaaaatccgaccaggcaatgaccagaattaaccaaccgaccgtacgttgcaaatggtagaggaagcgagagcttatcttacccagtaggcggcggtgaagccggcgatgccggaggagaggtggatgacgtatccgccggagtagtcgatgacgccccactggtagaggaagccgccgccccagaggctgaaggcgcagacggtgtaggagaagaggagccagagcggagtgaacgccatccacgccttgatgttcatcctcccgaggagcgacccggcgagcagcaccagcgtgatggcggcgagctcgaactggaacagcaccatggacgcctccgggtagaacggctcggtgcgcggcgactccagggcgccgtccttcccgtagtgcgccgtggccgggaccgacgcgcgcgccacgaggaacccctccgtcagcgccgcgccggccttcccccagaacgggagcagccggtcgccgaacgccatgcggaagccgaccagcacccacacgatgagcgtggacgcgtacgcgtacagcgccatgaaggccgagttgacggcccacttattcttcacgatgctgccgtacagcaccaccagcccaggcatcgactggagcccgacgaacgtcgccgccgcgagctgccacccgttgtccccggtgttcagccactccggcaccgccggtgggcgcggcatgtacggccccggccgggtcggcgacgccatcactcacttcttctcgtcgaccgacgtgattgtttggatcgattgcaataatccgtgcaacgcgacgcggctcactggcgacgcgggacgcgcttaaaaatagtttggagcccagcggcagcagcgaagggcgaagcggcggttggtggacgtggaatttgagtgggaagatgagatagtacgtgatcggcatgaaccaatggcgcgcgagcctgccagccggtgagaacggtggcctaaggcaggtcaacgtgagccgaggcacaagtggcctatagtatttgagcgttccgtgtgcgttttttcttctatttgtttttctccacctgattttcctccgcattttgtcgacgacgccgttgttgatagcatgttgtttctcgcgttggtatgttgggggctggtttgcgtacatcatttgtgtttgataatttggaagcctatggcgtcatcatttctgtattaaaaacgagaagtgcaaatcttgtcgtgtgtacatgcatgtttccggccttcccacggttataaagactttctcccagtcatgaggagcagaggcggcattgaacagtgcacccgcgccaccaattgatgcattgaaagcttattaatattttttcccattgcaattggctgttgagtttgcagaaatcatctactagtacatgcctaatgcgttgtttttagtcttgacccttaggaacgcataatttttaacggatttttacacgaactaatttaattcgtggaaaagtccttcgaaaattctgttccaaaagagttataacagtataagcatctcatagccttgcggtaaccttaactttcatctaagggccactttttttttttactttcaccgaaggctacacaaaaagagtgatccaagaaaaggaaattgcttatgtggcttttcccaataccacttatgtaaatcaaatggtaacgtgcgactacacccaattcatcggatttagagacagccagactcgaaagatgatcggaacatggtgttataatccggactatctaggtggactattgctgtcacacccgtatccagtttctccccctccccaccctccacctcacaaccacaggagcacgccacccaaagggcatgccagccaaagataacggcgatggagtctcctccccatagtcttccctgatcatggtagcaagccatgttggggtcctgacggtggcgctaactggctcttgttgtaagtggtagctggatctattggcattttggtcgtgagacgactctagtgctcatgtctcttgatttggtgccttgggagtggatctgtacacggctgagtaggagctcaacaccatggaggatgcattgtggctgtcttgcgcaacagtattatggcacgggcgaggatggtggctgtaggaggtcgttagcgtgggcgtcggcgatgagtgcgcttaggggtgggcaaaattagaccgaaccgaaaagaccgagacccaaaaatccgggtagctgttcggtccctaacatcaaaagaccgaatttatttcgggcatttcggttattgggctcggttaactgaaatacccgaaataaccgaactggcccaataggcctaggaggctaggaggcccggtactaaaaaaaccctagatcaccaaccgtccaaccctactcccgtctcccactcggctccacacaggcgccgagaaaattgcatatctaccatcccataagaatggcttcgctagaataccattatgaaaacgggcttcgctggaataccatcctcaatcagagtgtcttcgctaaaatgccatcccggacggaaatgcccctggctcttcttcttcctccatcccgcgcgtgaaaagctcgccgg

SEQ ID NO: 31264 - DNA, 10670 bp, Oryza sativa
  unsure (1)..(10670): unsure at all n locations
tcatgaccgagaccaaaccgaactaactgaaaaccgaagtgctcggtcctcagttttttttttgaccgatcggtcttaagttttttatgaccgaaattttaaaaagaccgagaaacagaatcgaatttctcggttagaccgaatgcttatccctaagtgcgcttagagattggacaaaggctaaaggcgccaccaatcccgccgccattgtcaaccgcatcatcaccattaactacaccatcatcatctcactgccattttgccgctaatcctactcccctagcatccatctccatgtgtcctcctctcctctccatcgtcaccattaaaaaatatgcatttcgacatccaaaaaattgttacgtcaagcgcattttggcatccaaaaaattaaattcttaggacaagcgtgacacccaagacctgaaaatggtattaggcccaactcattcagtcgaaccacacatatactacgatacactacttttttgtcaacgcttcatgcaaaaagaattcgtaccctgtgttgaaggttccggcctttcgggcaagccagtctcctactccctccgtcccaaaatataaacatttttagaatagtaccaaatcaaactttttaaattctgagtattaatagcaaagaaataaaaaagattaataatgtaaatttgatgttactagatttatcattaaacaaactatcataatatgcaattttttatttaaacattttaaaattttgtaaatattgttggtcaaagtagcatctcgaaaaccgggtcgaagtctaaaagtacttatattttggaacggagaaagtatttaagctgctccctctctttcaaattggcgagatggtattaatattaaggcttgttcactttgctaccatttttaaacttaactttttggcaaagttaaaaaaaaagtgactacatttagtttgttgccaaattttagtttagtacatacgaaatcttgccaaaatttgacaaccttaccaaaattttgacaatcttactaaaatttagcaatgccaaaacttaataaggttgaaaatggtagcaaagtgaacaagcccttaatattggctcctcttgcttgccggttagcttgctgctgctgctaaacactgcttgctgctgttgcttgcggctatatggcccaaggccagctactgctgctcgctgtaggaaaaagtgcaccgaaggtccccaacttgtcatcgagataaaaaacgtcctccgaccacaaaaccagatatgcggggtccctcaactatacaaaaccggtcatccgaggtccctaggtggttttcaacccggttttgtctgacgtggcggctgagtcagcatgggacccacatgggccccacatgtcagctggccacgtcagcctcatccctctccccctcttctctcccttcctcctctctctctcactcactcttgtctctgtggctctctgggcaggggagcaaggcggcagcggcggcgggagcaggggagaaaggcggcggcggcggcggcggcctccggtctcccccgccctcttcgctttgggctgaggccgccgtgctcgccccgtcctcttcactctgcccaaggtggcggaaacccaaattgatggagcgatggagatggagatggagttgttggtggggatgtggaacttgtcggcgacccacgacatctccggcgcgcgctgccgcgtccttggccacgcaccggaggcggttgtggaggtggacggtgtcggcctggaggtggacgtagtggagcacgtcggtgacgtcggcggcaaccttgaggcgagactgccacgacgcgagcagggtgaaggacgggttgttcgggttgcggtggagcgcgaagagcggcgacgcgtcgaggaggagctcgtaggcgaggaagagcgagccgttgggcgacgcggagacgccgaggaggcgcgcgatggcggcgtggtggcagtggccgaggacggcgaggcgggcggtgacgtgcgcctggtcgcgcgcggagcgggcggcggtgtaggatcgaatcacaagaactaagccaaccagagggggggtgaatggttggtatacccaaaaaccgaaaacttttagcggaaataaaagttaccctcaaaatcgacggagatcggtctgaccgaagttgccttgccagtctgaccgctcggatgtcgtcggtctgaccggtatagatcaaccggtctgaccgctgaagctgcttgccgcgcctgtcgtcacctccggtctgaccgccgtgcacccgccggtctgaccgccgcttgccgccggtctgaccgccggtagatcgccggttagaccgccgaaacccggtgaaacacaaattgaagaactcttaaagtagatgacgactttattgattctctctgtgtttacaaagtgcaccaacagcactccttacaaaaatttcgactaaactcgaaaccctaactctaaactcaactcaattgctctctaaagcgataccgggaagcctcacgctccccctctatttatacatgaggtaggcagcctaaagccacgaaccaaactcatactaagagtcctaaacaccttaggaaaccctctagtacaagaaagaaactttacataaccaatcgtaccaaatttggactccttccaaattcgactccgcatcccatacgcacacaacacctccatcgtatgccatataaaatctccatcaaccacgtgcatcaactctagcctaagtatcccgcatgatctctgaccatcacggacgtcgtcttatccccaagccgactcccggtccatcaccgcaaatactctcccaagacatcgagtcacctacacatgaaacaaacaaagaaaccatattccgataccaagctatctccaacttgactcattagcagcaaacaatagtattacatacgtatagtatccatctagaagccataatcatgaaataaactcggatatccaaataaacaacccgaaaccgaaaccgacacagtgtcggccagtcagaccgcgggctgcgccagtctgaccgcgcattacacaccagtctgaccggcacacactgcccggtctgaccggtcacatgaaataacgatcctgcgattcacctgtaaatccaatcatctccaaaaccacttcgtgaataaattccaaataacaaaaccaataatctccaatgtccaattgttcgtcacagaataataaccaaaaacacctttaattttacaggcggaagaccgcggcggagtggccgcggagggagcagcgaaacgacgaggaagaactcaccgcggcggcggcggtgaggcagtgggaggagaagtcggcggtggcggcggcgacgtggaccacgcacttgtgcacgcttgccatggcaaatggcaatgatgccatctccgttgctttatatgcttgcagcgcgcgagcccacgagagaaaccggaagtctcttttgagcttgcaacgcacgcacagtttgcacatgcagcttagctagtgagtgacgagatcatagggtatgatgagtcctggtgtttcggccaagaagcgccacgccggcgtgaggttcacgctcggctgcggctgcaaggacgcgaagagcgtgtccgtctcggcgccggtggtggggacgccgtcgacaacggcgacgcggcgcaggagcgctgggatgaacccgtcggggtcgacgacgaccgacactcttaccataacgtccgcgttgtcgtccttcctgtgggagcgctccgtggtggagttcgacgatgacggcggcgactacgggccggagagcttctccggccttctgcgcgagctcagcgagctggagcagagcgtcgcgtcgtggggccggaagagccaccaccagaaccacgacaagaagcactcgccgccgtcgtcatcgccgttgccatcacaggaggacaggaaggagaagaacggcagcaacggcgatgccacggacaaaccaggagactgccgtgacggcgacgatggcgtcggtgtggggctcgacggcagcgtggcggtggtgaagcagtccgacgacccgctgggcgagttccggcagtctgagcgagccaggcgccgacgtggtcctagcactcctcggcgggttccccttcgtcgccacaccgacgctgctacaagatcgtggttgggccctcggcgacgacggcgagagctcccctgctcccacgccgtcaccgccgccgccgccttgctcccctgctcccgcgtcgtcgtcgccgtcgccgccaccgccgcgacgtcgccggccgccggacctcctctcccgcatcaccctgtcggccggcggcgccggtctacccagagcaccaaacgagaagagtgagagagagaggagaaagggagaggaggagagagggtgatgatgtggccagctgacatgtggggcccatgtgggtcccacgctgactcagccgccacgtcggacaaaaccaggttgaaaaccaccaagagaccttggatgaccggatttgtatagttgagggatcccgcatatctggttttatggttggaggacgttttttatctcgataacaagttgagggaccttcggtgtactttttccctcgctgtactactactgctgcagctagtcgccatgggctaggcccaagaacagcagagctgttgctgcatgcacggttagcgaattttttttatttatacatttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgatcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaagtataaataaaaaaaattccacggttagctccctgcttgcttttatttttcttttcttatctaattattacggggcgttacataagtcatgcagaaaaatatttgagtttgaggatcgacttgaaagcatattgtaaaagatagtcctaaatgtaaaatccttatctttgtcagtgcccaagctacgtcatttgtaccatgaacttaaatatgatacattatattaaaccaagtttataaatctagatatacttcaatctaagtttatgacatgcaatctattttaataaaaatcttaatgctggaatggcaagtaatctgaaaggaagggagtacgtaagttcacctcataaactttttgttaaccagataattctcatgttttcgatgaactaattcagttaacaataacagaaactacaccagcattacatcaccgaattaacactaaacgttgaaagtaacatacatcagtgccatacatcatcagaatcactggaacgagcaagcacacccttcccgtcttctacaactgaatggtgacacccctggctcccatgttggtcagcctctgctccatggtgtcctccctgcccgcgccgcctgcacctcccgtcctcgtcgtctccggccgcgtcacgtcgaacttctcaccgtccccccacagagcgtaggcctcctccccgtgcgccgcgtcgtcgccgatcatgagctggtcgtcggacatgcggagcgggatgaagaggccgatgcagaggagaatggcgctggtgacgatgaggttccagacggtgacgaacagcgcgccgccgagctgcttcccgagctggccgatgccgctgccgtagaagacgccgcgcatgttcgggatcgggcaatcgagagcgcagagctccggcgtggcgaggaggcccgtgaggacgccgcccaggatgccggcgacggcgtgggtgtggaagacggcgagggtgtcgtcgaccttcatgaggaaggtggatttcttgtgcaggatcatcatcgtgaaccacgggacgctgccggcgaacatgcccatcagcatcgctgaccacgtgtgcaccagccctgcgtccatgcaaaacgtacgtgaggatttggacccatgaactgtgtgtgtgctgtggttttgatcggacgaaagatttgttaccggcgccgggcgtgatgcagacgagccccgtcatcataccctgcacggcgccgatgacggagggcttgccgaagaagatgacgtcgaggcaggtccaggtgaggaggctcgtcgcggcgctgacgttggtgttgagcacggcgaccgtggcggtgacgttgggggcgtacggcgcgccgccgttgaacccggcccagcccaaccacagcagcccgccgccggcgatcatgagcaggatgttgttcggcgagaaccgctccctgtcgctcttcagcctcgggcccacctgtcagagtcacgttgtaacatggaggcgtgtgaatagtgcaacaaacagtcgaacacgatgcatgcaatgcacggttgcacgtgtgtttacccagtaggcggcggtgaagccggcgacgccggaggagaggtggatgacgtatccgccggagtagtcgatgacgccccactggtagaggaagccgccgccccagaggctgaacgcgccgacggtgtaggagaagaggagccagagcggggtgaacgccatccacgccttgatgttcatccgccccaggagcgacccggcgagccagcaccagcgtgatggccgcgaactcgaactcgaacagcaccagcgccgcctccgcgtagaacggctcggtgcgcggcgtctcgagcgtgccgtcgctgccgtagtgcgccgtcgccgggaacaccgcgcgttgcaccaggaagtcctgcgtcagcgccggcccggccttggcccagaacgggagcagccggtcgccgaacgccatgcggaagccgacgagcacccacacgataagcgtggacgcgtaggcgtacagcgccatgaaggcggagttgacggcccacttcttcttcacgatgctgccgtagatcaccaccagcccaggcatcgactggatgccgacgaacgtcgccgccaccagctgccacgcggtgtcgcccttgttcagccacgccggcaccgccggcaggtccggcatgtacggcccgggctgcggcggcgacgccatccttaggtgcattctcagctcgaagcaaagcgagagagcgagcgagcgatggaacgcgaagtggccggctagctacgttgtgatgggcgtttaatagccgcgccgagatggcgatttgtgagtttaattattggtttgagacgagctctcgcgagtcgtgatgacgcgcgcttgaaccgatgcgaggtggggacgaaatgtggggagccgtagccggtttccgggtcaaccagggcaactctggcccatggttagactatggagggatacatacagtttgttcttccttaacctcttgttaagtctttcattgatttcttaaacttctttgcgattttttgtgcaaacgaactgcttgtcaaccgaggtccgatgcacgggaggatacaggagagaacgtaggatatgctgacagtacatgtgagtggtccactccagcatgtatgcttgtgggggcagccatgcggatgcccgctagatagcctttcagctgagaatctccaattttggaatgtgttaggggcttcgatttaagatacataacagtaaagtcgccagctttagttgggaaattcatctatttatcggtactgtgtccaattccaagttgtttagatgcatcaaaattagtcttcggtattgagtatgtacattttacaaaggtacattcaaatgatgggactaacctattaatctttcgtcagatttatagcttcaaatattatagaatttttaaccaatgaatagggcccgtattaaatgaaataaacaaataaaaaaacaaacatgtaactataaatttttcggtgtgagtgtaacaaatcttgatgcaagatcctgtggatgaaaaaatgaaagataggagccaaaaaaagctatcgcaagtgaaacagaaaaaccatttgattaaactattgtaaatttataaattcaagacagtgtataacataactataaatttaacaccaaatttattacgaaactacctgtttcgtctctaaaaaagtgtattttcagctatgaacttggacagtggccatagctaaaaggttattgttttagagatggatggagtacacattaatataaagtatcacaaaactacatatttaagacataagacatagtttcgagaatccaattccactacgaaataaagataaaaaaaaaaagagagaccgtcaccattgataagaactctcttgtatacataggtcaatgtaggcatttttttccctagcaaaaataaaagcaggcaattgtttgattaatcatgtggctgaatcatgtcatgtacgctgtagctaagaaaaccatgctattcagatataaatttccatggcatcctgcttttcttatctgaaaaatgatctgtacaacggaggtacagtttgcatctgaatactggagattggtcccatgggatcgctcttcagtatattccccctccaaaggtcctcgaaatggagaaccatctcttttatcgtaaagtgaccgtgtaaggttgactgtgatggggtaacagctggggattggatctcaacgggacattctaagtcacagtcatgtcatcctgtcatatttgtaaccacaacttggatcatgcgagttgtatagtgcacacgaatgcatgctgtggcgaaggccgaagcataaatataggctagatggtttagggttaatgatttgcttgcaggatccaacacaaatatgaaggtgaatcccaacaaggagttcagagtaatcgattaggtatgctcaatgcttgccaggattactgaaatgctgggaggcttgtctacctccgctgtagcatagccgaattatcaacttaccaacttgagagaaacttctataggttatcggaataagggaaccgtaaagttacactgtttcataacctgcaatagaaaaaaagccttacaaggagggacatgaacctaccgtcctggatactgaaaatcgatgctagttgaacagatccagtgcatcacttaagcgtttgggataagccagtaattcaatggggatcattttagaatgcttattcgcacatcaacctagggagcaaatggaagaaataaaaagcaggttgtttttttgacatacttcaaatatctagctaaatctgtacaaagtatataatgttttctttttcacaaggaagtacataatgctagttggtaaaagtaccagtgggcaattttgttcataccattggaaccaaagttccttattgaaatattccttacatgtcagaagatctcccagtaattttccttcaaaggtaaacatcagaaaacaaggctaccaactaggaatgatgttaaaggaacagtcaagttgtcatccaaatgtgtgctgatgggatgggactctacaagtgctgcagttacagaaacaacaaggaagccaaaagccaaggaccagctttcttcaatgaaaccgaatgactggaagtaatgcatatacctgaacaatatgcgaatgaatgacttaaaaacacatatgcaacagaaaacttcagtaaaagcctctcaaataattacccaattgaagccatgaaaccagctagtgccattgctatgctgcctgcatatgacttgttggggttgtatggaagcttttcttggccaagacgtctccccactatgtctgctattcctgaaagtgtattnnnnnncntgggggggggggagggaatgtcagcaaggaaagtatgcatagcttgtttacgctaagctaaggactggagatatacgcacataccgtccccagcacataagttgcaaataagggctatagcgattggagaggttctccagaatatagaagtggcaaaagttatagtggtagcataatacagtggacccttgagaagttccctgtgttcatgagaaaatgaagtctaaaggatcatgacctgaagcagcagcagcagcaactatagatattcaacagaaacaaagaataagcaaatctgtgccaaaaagaaggcatagaataggaaaaaggaaaatcagagtgaaaaatgcaaagaataaaaggcannnnnnnnnnnnnnnnnnnnnnnnnnnnnnnnnnnnnnnnnnnnnnnnnnnnnnnnnnnnnn

SEQ ID NO: 31265 - DNA, 726 bp, Oryza sativa
  unsure (1)..(726): unsure at all n locations
cggctcggtgcgcggcgtctcgagcgtgccgtcgctgccgtagtgcgccgtcgccgggaacaccgcgcgttgcaccaggaagtcctgcgtcagcgccggcccggccttggcccagaacgggagcagccggtcgccgaacgccatgcggaagccgacgagcacccacacgataagcgtggacgcgtaggcgtacagcgccatgaaggcggagttgacggcccacttcttcttcacgatgctgccgtagatcaccaccagcccaggcatcgactggatgccgacgaacgtcgccgccaccagctgccacgcggtgtcgcccttgttcagccacgccggcaccgccggcaggtccggcatgtacggcccgggctgcggcggcgacgccatccttaggtgcattctcagctcgaagcaaagcgagagagcgagcgagcgatggaacgcgaagtggccggctagctacgttgtgatgggcgtttaatagccgcgccgagatggcgatttgtgagtttaattattggtttgagacgagctctcgcgagtcgtgatgacgcgcgcttgaaccgatgcgaggtggggacgaaatgtggggagccgtagccggtttccgggtcaaccagggcaactctggcccatggttagactatggagggatacatacagtttgttcttcctnnnnnnnnnnnnnnnnnnnnnnnnnnnnnnnnnnnnnnnnnnnnnnnnnnn

SEQ ID NO: 31266 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnaaaattttcgttctttgtgtgagagtctaagtcgtgccaagatctcatctcaaatgacattgttccctctcatcgaaatcaaaatcctccacctcaaattcctcttccgattcaagtctccaaatcaaattccgaaattcagtcgcatcctttgaatcctcgctaaacactcgctcccaattgcgaaaaataccaaaccctatcttgagctttccttgattcctccctgaaccctcgagttcgaatatcgaatctgaatccaaatccaaactccaattctctccaaatcagccttctctgtgaaagtctattttacctccctctggctcagtgggccgactcttcttccccagcccatctcctctcagcccgcttcacctnctgcccgcacgtgcgctgcatgcgccgagagagagagagaggcatcgcctctcttcttactctctctttcctcgctctctctctctgcttcctttctccctctcctcagcgccgatttcccgccgacgccgttcgaaatccggctgcacccccgcgtagcgcgcgctcgctcgagaggtggccgaccggccgaacgccgncgccatcagcccttgcgccgncgacgccacgagctgccgtcttgccccgcttcatgacaaacgaccgccgccgt

SEQ ID NO: 31267 - DNA, 726 bp, Oryza sativa
  unsure (1)..(726): unsure at all n locations
cnnnnnnnnnnnnnnnnnnnnnnnnnnnnnnnnnnnnnnnnnnnnnnnnnnnnnnntgcacatttagtaatggggaatttaactatttgccacttttataaatggctactctccgtttgccattcttacatttctctacggatttgccaccagagagaaggtttcttaatcatttgccactttcacctattaagcatgctagtgaggacagccaatgtggacaagaagacacaaaaagtccattttacccatggcccttcccttgtgttcccccctctctccctttccttttcagatttgagctcacctccgccgctgtttctcgtccatcttctgcactgctgtgtagtgacaagccattaggtagcagtaacacttaggtgcgtgcatggatgttctttggctgctattgattgcggatgtaccttctccttgtggctgtcgatgacaaccttcaaccttgcggatgtaccttctccttgtacctcaacgtgctcctcacttgccggccttgccatcaatgaaccgcatgacgacctgcaccggggtgctccgccatcctcccagtgagtttgagggcctcgcggttatctggcctgccgaaagagatgatgcagatgcagtgcacaaccttcttgccgctgacacatgattgacgaggcttgatgagacagcgtggctggtgtggcccgcgatggtctcaatgaggaggtgaccccgcaagca

SEQ ID NO: 31268 - DNA, 613 bp, Oryza sativa
  unsure (1)..(613): unsure at all n locations
nnnnnnnnnnnnnnnnnnnnnnnnnnnnnnnnnnnnnnnnnnnnnnnnnnnnnnnnnnnnnnnttcctccctcaccatctcccctctctctcctctcctctctccagcggcctgcaggggccgggggttatggccgcatggtgaggttactatggggcgcgggacgacgcgaaattggacttggacggcgcgccctagcccacgtttaacggtggagccgccagcttaagtgaccttgcctgcaccgtagggattgcttcagtggcgacctgcatctgcagaacccgttcaggtctgcggcggctgctgtaggaacggcgaaaggagaggaaagggggaggagactcgctaaccttgtaggtgctatcaggtcaagcggttatgctcggtgcacggtgcgcgacgggcgcccttgatcgacgccgatcagaacaaggcgagtgacccgaggatggaaatgtaactgtatatgcgactggaggaatgggtgtggccgggtggctccgatctatgcctgggccaagttaagtgggcttggtcagcccgcgtggacgacctgagtggatgtttgcgtataagctcaatttggggccccttaattgtcgcactgtcc

SEQ ID NO: 31269 - DNA, 647 bp, Oryza sativa
  unsure (1)..(647): unsure at all n locations
ggttgttcggtttgtcccgacccgccggggttactttttccggtgcgcgctcacgggtcaggacttacacgagtacttgcacccgtacattagcagtacatgtgacgtgtggactttgtggtgaaacgttcggggcacccggtcgcgggagcacggagtcgtcagcgcccggggtagactagtcacttgcgtgtattgatcgagtgagacgtgttttggacatggacgatggtgaactagtactatggaaagaaacgattcgatgtagcttaggctcgagcctaatttcctcgtacctgcaaaagtacatatatagacgagttgctagaaagaaaaaaaaaaaaaacagtgctggctcagcttgcagaatccagattctagaacagtacgtggcacgaatctcgacggcgttaagtgttaaccacgtgacggcgattaataaatactttttttgtgacaggtggggccgaggctgaagagcgacagggagcggttctcgccgaacaacatcctcctcatgatcgccggcggcgggctgctgtggctgggctgggccgggttcaacggcggcgcgccgtacgccccaaacatcannnnnnnnnnnnnnnnnnnnnnnnnnnnnnnnnnnnnnnnnnnnnnnnnnnnnn

SEQ ID NO: 31270 - DNA, 703 bp, Oryza sativa
  unsure (1)..(703): unsure at all n locations
nnnnnnnnnnnnnnnnnnnnnnnnnnnnnnnnnnnnnnnnnnnnnnnnnnnnnnnnnaaatggcaagctttctttactagatgtgccgtatgtattgtcttttcatggcttttaagccatggtcctataaagggcattaataagatttatcattacagggtagcaatgctacactacatggtaaggaacaaaaaaattccatcatcagcatagatgtatgttgattcatcaggaaaattccatcatcagcataggtgtgtgtggttaaattttagtaaataaaaggaaatcaggtttgagtaatagtatgtgatagctatttatcaacagaaaataaaccattttgaaagcttaggatgaccaatatttcagcaccagtactagtaattgaatttgtattatatgagataagccatgaccaatcatgttgagatgtataatggccactgtacctcagccttcctttgtgcccttgcttctccctctgcctctatgccatcaagtttcagcagctccatcataagaagctccgtcaagacaacaaaatctttatcctcaatctttctccctgcaaacacactcttctgcaaatcacatacctggtaatagaacaaaaacaaaaaccgtatcagcatcaagatataagaagagttaatgtttaatggaagaggcttgagaaacattattccctcacctttgcaga

SEQ ID NO: 31271 - DNA, 985 bp, Oryza sativa
gatcaaatttgaagcggcaagtcaaaatatcttataacctgaaacgaagggagtagcattttaccatggcatctctgtctcaatcaacaaaggtggtgtttagatcgaggggtgtaaagttttggcgtgccacatcggatattatatagggtgtcgtatagggcattcgggcactaataaaaaaactaattacagaatctgccagtaagcagcgggacgaatttattaagcctaattaatccatcattagtaaatgtttactgtagcaacacattgttaaatcatggagcaattaggcttaaaagattcgtctcgtaaattagtcgcaatctgtgcaattagttatttttaagcctatatttaatattttatacatgtgttcaaacattcgatgtgatgcggtgtaaaatttttgtgtgcgaactaaagcgggccaaagtagaaatgatgcattgtttcaggagaacccgatgttacagttcttctgcatggtttgtcttagcaagctttatattggcacgggattgttgttcttaaatgtaaatcatcatcgtgaatttgttttgtttccctcagcgtatgtaatcatgactattaccttttcagcttttttagctgtaaaattgtttgagctgactgctgaaaggcaacagcaacagcacatgacacatgagccactgcaactgggtccacctcatttgcttcttttaggctattaagagagagatgggtttataacgtgcaagataataacacaggtaaaaagtatttctttctacggctaatggctttccaaatcccaaattaacccacgttcacctgacgctagcacgtttcagcaacttgcaagccgcaaacctattcttctctgctgcggtaaccaaacccaataaaaagggcacctctttttggcaccacattgctgctactctctctccccttctcttctccggttctccctctcctcctcccacctcagccgccg

SEQ ID NO: 31272 - DNA, 666 bp, Oryza sativa
  unsure (1)..(666): unsure at all n locations
nnnnnnnnnnnnnnnnnnnnnnnnnnnnnnnnnnnnnnaattctcaagcacagaagctaattgaggctattccgtttccatttcttcatgctagtgcagagataatgaaccaccgaaaagaatacaaattgtctcgtagaagtaaaaagtacgagctgctacattttgagagaaaaacaaggtacaactgaaaatttggaggatttttatttgcaaattcacaaaaagcaagctaactaagcagaactgagaagagggatttgtgggagtagttgaggtcaggaataaagccctgttccggcccatcccctgcttcgccggtccaggtcggctcaatctcctaaggtggcccaccactctcgcgtaagatgggcccacactgacagaccaactagacccgaataaatcgccttctctcccacgccacgccgncaaggcgccaacgccttccaccagccacgattcccagtttcctaccaaaaacttgtttctcctccacgtcggtcgagtccgagtccaccgctccggccgccgtcttcatgggccgcttctcctccaccgncgnagcgtcatccatgtccggcgccaacggaggangaggaggagggagcgtgtttccaagcccttccccgccgacgccgtngaaccaccaacacgcgcttccgt

SEQ ID NO: 31273 - DNA, 614 bp, Oryza sativa
  unsure (1)..(614): unsure at all n locations
nnnnnnnnnnnnnnnnnnnnnnnnnnnnnnnnnnnnnnattcgtattaggatacgtctcatccacctaaaatcccttatattttaggacgtagtgagaagaatatacgtactatcatacatgccgcatatggaaaggaaaagaaattaacacagaatggagctgaacgataaacatcagactaaccgaaatggtgagatagcaattaagcgatcgagcaaacaagttcagatttcagaatgatatctaggaagcatgcacgcatgcatgtaaaacaaagctctgttatgcattgctccaacagaaccccatgcatgcatatatgcattcttacagaaatcaagagtctatctaatttaagggaccatgaccaaccggtaatatattggttgacgacctaggtaagctaagtagagctagacagcttgtgggtagagccaatattcgagcatacttaatgaaaataactacctaagcaagccactgtctcactagctagcttataagattcttgcgcaccagactccttaccgtggacattgcacaccgagtagcacgaggggtcagtctcctggacgaaaacacagtagggctaagaggcagctgatgagcgcc

SEQ ID NO: 31274 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnntctcgttaaacgaactgcgtttttgctagaaagtcgccgcgtgtggagaaaatgttgggtgacccgacgacctcacgctccgtccgatccgagaggctgagatctggacggcgaggggctcccccaccgtcggatcgcgggtgaacgggcaccgttgaaggtctaaagcccccagccagaggcggtttcgtcgtcgcgtgtgcggtggaattttttgcggtggcggagtggcgaggccaagaaacggggagaaatcgcacaaaaccacggcgttttccgcatggaccggcacgcggtgcgaaccacatgcactgccgcgccacgcctttcggacgacacacgaccgtgcccccatcgcgccgggctttccgtggaccgcgcccacccgtgccggccttacgcgcgggtgaggctcacgtagcacgggttcacaccaccgaacaacaacccaccccttctgcgctcttcattccatacgcattcctaatttcggcttggnctcggcacgcccacggaccatgggcgcaaacggcgcgttgttcacgccccttttatcgccctggtgtgccaacgcgaccgccaagctcgggcggcgtgcccgttgtcgtaccgattcccgcagaggccgagcacgcgccgtggacacctctccgtgg

SEQ ID NO: 31275 - DNA, 622 bp, Oryza sativa
cccgaagctgttgctcccatcaagccggcggagaaggtgggcacgaacaccgggtagccgaacgcggcgtccgccggcacgcaccgcgcacaccccgtcagccccctcacgtacatgtcccacgccctccccactccccagtgccctcgccggcgccctccacatccagctcagcctgctccccctgctcatagatggttgcttggtttgggttgggttgaagacgatggattttggttggagacatggagctctcaccggtgaagggtatggctgcctcttatacaaaacaatggggggagcagccaaagcaagtggatgggctggtcggctggagatcgttgaggtggccaccggcgagcggttgtcccgctggcctcgcgcgccgccgctccgaccaccgtcgccccactccacccgccgtcccagtccacctgctttgccttgcctctgctctgctccctccaaactccaaattaacagagagaggctctccgctttggaaattttggaggggatggagctccatcaccatggaagcagcaacgtctgaggttaggtacctaccttcgtctccccccttccctccatgttaatctctagtattagtcaatgcgcataa

SEQ ID NO: 31276 - DNA, 1404 bp, Oryza sativa
gagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgcatgcctacttgtcgactcagattatcccaagcaatcaagataaatattatgaaaaatatgatataacatctgtagcccccgactcactactcaatggaagaccaattggtatagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcggcagcggtgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaaggccagccggtcggtgaagacatggacgcccatgaacggtggtgtgaccgaccaaccgtataggcgatgacaccagtcggcggcgacggaggcaggccggcggtgaagacgtagacgcccaacagcggcggcataataggccagccgtgcaggcgtggacaccagtcggcggcgacgaaggcaagccggtcggtgaagacgtagacgcccaacaacggcggcataataggccagccgtgcaggcggaaacaccagtcggcggcgacgaaggcaagccggtcggtgaagacgtagacgcccaacagcggcggcataataggccagccgtgcaggcgtggacaccagtcggcggcgacgaaggcaagccggtcggtgaagacgtagacgcccaacaacggcggcataataggccagccgtgcaggcgaaggcaccagtcggcggcgacgaaggcgagccggtcggtgaagacgtagacgcccaacaacggcggcataataggccagccgtgcaggcgaggacaccagtcggcggcggtgaaggcgagccggtcggtgaagacgtaagcgcccaacaacggcggcataataggccaaccgtgcaggcgaggacaccagtcggcggcggccaatgcgagccggtcggtgaaaacgtaggcgcccaa

SEQ ID NO: 31277 - DNA, 1292 bp, Oryza sativa
aatagccagccgtgtagcggaggcaccactcggcggcgacgaaggcaggccggcggtgaagtcgtagacgcccaacagcaggggcataataggccagccgtgtaggcggaggcaccagtcggcggtgacggaggcaggccggtggtgaagacgtagacgcccaacaacgggtggtgtgaccaaccaaccatataggcggagacaccagtcggcggcgacggaggcaggccggcggtgaagtcgttgttgttatcagcagtggtggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgagtgtgtattgatctgacgatcaggttgtctcatgcccctagaggggctccctgccctccttatataggttggggggcagggttacaagatagaaaccataaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaactacactgtctgcgacggaaattacctacctggcgtgcggcggcgcgtcgaggcaggaacagaaggcgtcgacgtcggcgggggacgcggcgtcgtagaggccgaacgcctcgtacagcgggttggcggcgctcggcgccatgtatccgctgccgtggatgacgtcggcgttgcggcgcttggcgtcgcccgggaggtcgaacagggcgcgcacggcggccctcatgcc

SEQ ID NO: 31278 - DNA, 1106 bp, Oryza sativa
atgctaaaaagtcttataacctgaaacggagggagtatgaagaaaagagatgtctgaaaagtttgagatagatatagacagcataccagcaattgtaccaaacaacaacagagcaagacggtgccacactagccatggaagctctgtttcgagagcgcaatgccgttggtacgaatgcccttgttttgtaatggcatgtgcttttgatggatccagttcagatataggaaactccacaccaccaacagagtttccctctacatctcttagttcgagtttaatctggggaggcactgcattccaatctatttcgattgctccaaagtttggttgacctgataaatgcaacagcaaaacaccaattgataaagtaatacacgtgagatcaaatacagaagaaataaattagatggacacattattatgctcatgggtaaatctgccctcttgatacttattcagttatttgtttcgaagaaaggaaagcttaccatatgtgcatgatttgtaacgacagttagggctaaagactcgcaaggtagttggtgtcaacaaagccacaagtctcataagtggttgaaatactgatggcacggaattctcaacagattgggtaagaccacttgaggtaatatcatacaatggatattgagctccacagtcataacgagaaatttctccaaaatgaacatcaccgctgataaaaaacactccatttctctgcacaaagtcaacatatgttccatagaaataacaaatgcataagataagtatccattttagatgatactccctctgtcccaaattacaaggcctatttttttacacggtcttcaatgacatacttcgaccattaatttatgccatgttattttcctaacgaatatgaaataatatgaaattagcatcacatgaaagtactttaaaatataaatctagtgatataacatgcataatacttagcatatatatggttagtatgattgttagtcaaaatttaccgattttgattttccttgaaaagaggccgtcctataatctgggacggagggagtattgtctattgatagatcgcaaaaagaaaaaaatttaacacagctatatag

SEQ ID NO: 31279 - DNA, 3072 bp, Oryza sativa
ttctgtgaaccataaataattgagatttgatgctctagtacacatatgggctttatgctcagtaccagtgcttattactgtaacacaatgtagtgctctcgaatgggtgctgatgacagtgataattaaaaaactagtcgtacggcatcatacatatagacatatagtactatagaagtactaatatttgcacggagactttggatttttttttagaagatctgagccatttatttttcgtgatttggtgtcaatgtgcgcaggagatgggccctgcaagaggtggggtgtgaggtagcgctctgcgaaagaggagaaaataaaaaaaaacgatatggttttggtttggccattgctttcgccaatgtagaaagagaccagcgaactgcctgtagacttcgcagtagagtagccgtgtaggaaagatatgtgtatttggggggcgttccgtatatatcatcaagaccgtgcttaggctgtactagcacatttaattcatgcacgtatcaatccaggaaaataaattgttgcaagtatgcgtagctattgccttcatggctttcatgcatgtttgttgcagtctactagacaggggcctttcctctgccagtgtgttaatatgtctggttctgaatgatggtgatatgcaattttgctgtgttgggctcgagctatagccaatgcaatgaaaaggcctagttaccagttaccacacctgattggatcagatcagatcagccaaaatctcgtttcagcaagaaaaggttaattagttaaaactagctgtatataaattatatacacacacccaaggttggtctgcattctaaagtgacatacacaatgtatattgctacacagcttacagattttagacctattagctcgatcgaacgacccctgggattaggatgcatggggaatgatttgatcctacattatcaagaatgagtagtctgggttcggatgccagcgtgcgacaatgaaaaaacgggtggcccttgttacgattactttgaacataactcgtccgctatggagcagttattaataatggttacatagagatgaatagggctatgtggaaattgcagacgctgcttaaaatcatgatttttgatgcagtatttacataaaggcgttgtttttactaaagataatctagctagagacggaactggaacccgagtaaacgtcgttgcataattttcttattgaaattatgctaaatttttgtggagagtggtccaaattgtaatagtatttctcatatgtttaaagattggttggttggagtggattctaagctaaaaagctttttctattcctttgttttttcactcctatgattcaaagaggccttgtgtgtagacctgaaggactaaactgtccatgccgctacctggctctttgtaacaatacaaatgatttggtgtttgacaattctccgattaattaaaggggctacttcaaatcgtacatattttttaaccaatgggatatagcccgttttaaatcaaataacaaaaagaagataagcatgtaaaaaatcgtaagtctaaagaaaaaatgttctaaattctaattttaatgcactacaactaaatgcaagtgctacataactatgtgtaagtgctatgtaactgagtataagtgctatgtaattaattataactataagttaaatatacgagaatacgaatcctgatgcaagatcctacggataaaaagtgaaagataggagacaaaagtatatcacaagtgaaatagcaaaaaccattaatttaatcttacatataggtactccctccgtcccacaatataagggattttgagttttttgtttgtaacgttttaccactcattttattcaaatttttttttgcaaatataaaaaaataaaaaattgtacttaaagtattgtagataataaagtaagtcacaaataaaataaataataattttaaaaaattttgaataagacgagtggtcaaacgttacaagcaaaaattcaaaatcccttatattataaaaacagagggagtactttatagaggaacatactgcattaagtttcggagccattttgtgaggacaagaacaactttcaattggcatgccgaaatctagaggcgatagtcctgaaaatctttattaattatggatagagatttagtaaataggattacgtcctaaacaatatcttttcatccacgattttctttttatatgttcttgtcttttgttttgacattgcctttttaacgccgggtttacaccattattaaaaaaaaaaaactatccctgctaattgtgtacacaatgttcctttatgcacgtgcagtcaatacagagctctttggtctgcctgcgtgtgcgccggacgtctgggctgaataatgataagcattgtgttgtgctgggctcaagccagtgaaacaaagaggcccagttaccacatgggcttagattaaccagatcagctgcattatgttcagctacaccaaggtttcgctcgattaattcattactactccctccttttcagattataagttattttaattttagttaaaattaaattactttaaatctaactaaatttatacgtaaacatagtatatttataataccagattagttctattaaatcgataattgaatatatttgtcttggattgagaatgttattattttttttatggatcaaacttgaacactttgatttcgatcaaagttaaaatgacttataatctgaaaggatagagtagctccgtggacatgcacatagtatataaatgaggaataagttcatctaaggtcccttaacttgtcaacgaattcgattttggtccctcaaccgctagacacaacgggtcccttaactattaaaaccggtgcagatgaggtccctcggcggttttgaggacagttttggctgacgtggcgcctatgtggctaatttgactcggtcttcatctgacatggcactgacgtggcgcttaagtggcaattcgacccaaaaaataataaacccgtgggacccacatgccagttccacacataaaataa

SEQ ID NO: 31280 - DNA, 7488 bp, Oryza sativa
ttatatgtgaaactgacatgtgggtcccatggggtttattattttttcggatgaaatttccacgtaagcgccacgtcaataccacatcagtcaaattagccacatatgcaccacgtcagtcaaaactgccatctaaaccgctgagggatcttatctacaccggttttaatagttaagagatatattgtatttggttttgggctttaaagacaaaaatcggattcgtttgatgaacttattcctataaatgactgcctatgccaagctccccaaccccaaggactgtgcgtgcatgacactgcagcctgcactctgaactctgaactctgcagtagtccaaatatgcacactacatgtgccacatagcttaattacacctaattagagctcgcttgatcaaactaggtctagtagacaaaaggaatgcagttgatcggatacaatggttactaacaacgacagtactgggacaaaccttgattaattgccacagctttcaatatcactcacccttgtggcctatacctgctcttaatttgatcctctcctcccatcccgaatatataagaaaccaagcaaaccagacatgtagtccatgcgatccaacaaaattctagtacaccagcctgaaaggagaagaggggaaaaataaggcaaaaaaaaaacactgatcatgtactacatttgtacacacacatgtgcatatatagcactcaaatcttttgtcgatgatcaatggggattaggagtcactgggaatcgaagcaccaccaaaaccaaaccaatcggctgctagtaagatgcttgttgtgcccaagggaatggctcatctaggctgtatttgtcagctggttgggtggcaatgcatgacatcccagaagagccgcgctggacgctggaagggaagcgtacgcgcactactcctctgccctctcttccatggcgtggatcgatggatggctagtctattcaagcttggtcgttgttcggggaaatggcatgcatccactacgatgaccgggtacacatggcttctccccctgctaagcaatgatttaaatagcggggtaaggcatttagcgattggcttctcaaacagctatatcggtagctatagcgaactaaatggagctatagcggctaaaatgtatatgagaacaaatagctagaacccttctcaaacagctatagcggaagatagcggcagctatagcgggacatttaaaaccctgttgctaagaggttgttcggttcatcctcaaaagagtgaaagtgaaggggattgagagattaattctacacctgaatagatgtgaaattattccccttcgaatcttccgcaatttccttgtaggacggattaaacgagcaagaacaaggcctaacatggtgtgtagcctcggctgcggtagtacttgtgccatcaagttgagcgctctgctctccgctgtcctgtatggctgtatgtatgtgtgtgtatgctcgacgacagtgaacacaactctgcaagttacatttggtgctgagcactgcatatcctgatcgaccaggagggacatacatttggtgccttggctgttgtagagatttttagtttactctaccctcaaatggttatgagccatccatttctttgaatctaatggatcaaattctattagatcgactacattgactgtatcactgtagtacgggcagtagaaattttgtaagggtaaaatcagaaataaaatatatgttaatataataaatttgtttctcatatatcatattaaaataataaaatagatgacaaacttgtacagctcatgattgtttccagaagttaaggctcagttctttgagatacataggctctaatttgatttacattattaattaaacagattgttaccacatattatctgtttaattatagaaacagattggatattttaagaaataaactaacaagtctaatcaatgctgtacaagaaaatttcttacgaaacatattcttaaagcatgtagcaaatcatgattttaataatccgatgaatgatctgaaaagaccaggccgccatgtgctcgcaacttttttttttaatcaggaagaagattacattttagtctctgaatgcctaccataatgtcagcaatgtacatgaaaaaaagtccagcataatgtttggggataaaccctattcgtagggtgttgtcttaactagtctaatatatattagatatcttaaaggtgctggattagctggtctccgggcgatttaggcaaccggcatccaatataatcttgccacgttgtttggttacagtggatcagctaccaggctagcttatccttccatgggccaactgatttcttagcccagtggtcgacggccttttagtggtcatcgcagcatcggtgccgtggtcttccaccgtcctggatttcctgtgcgctgatccatctgcgagtcgcctctatcctctcgacgcgtgtcgtccttatccagccatcagggacgcctccaacgcccagcggcccagccccacatggtggcccctctctcaatctccacggtagtgctctgccatggagtacagtggcgatggggttggctgctgctctgccatagtgtacggcggcaacgggttggctgctgctcgctgctccactacgcagagaaccccatgaggaccaagggaggtaatctgcatcgctcccttctttcttccatatatgacgccggttctattccttgctcctcccgcttaggccctgtttttcccatccattaaaagatatctttaaatcctagctattcattctccctctttcatttaatcctaacccttcattcatttcccaatcccaatcccaacccccatttcccattatccaaacacaccctaagttcttggggattttcaaccggtagtttccctaatcgcatcgtctctactgctctgatctttcttgctgcgtctcgctctcgatttcccccattgcgatgccaatgttgttccagccatgcgtgtgctcactgttttttttgggtgttttttcccttccaggctgtgctcttggattggtgtctcttccacatcgcatcttgtttggggggagggaggggggcatctttgcctccctcagctactgctcactgaggtatataagatcagctggttttatcacggggatggacgttgagttcattacacgtgtggtgctatggtatatagataaactgagatggttatgtcactggatgtctgttcgcttgatttcctatatatggtgttcctctgtttttttttcgagacagtactttccctaatcgcatcatcccgtacgctctgatcttttcccgttgtgccttgctctaggttttcccattgtgatgtcgacgttcttccgaccatgtctatgctaactgaatttgtttttttgttttctaccttctaagttgcgcggccaacccttaccgagacgtggttttgctgcccgccgagccatccacattgctccttccacttctccgcatccgctcgtcgtcctcgtcctctccgcatccgcatctcttcccaatatttttgttcttcactgtagctgcacgtacagcgagcttgaatggcatcacatactccccatcccgtcctcagcatcggcgtcccacatggcatcgcaacgtcgccttcttcttcggcatcaggtcaactcggtggctcactgctagcacagatggcgggcggggagtggatctttcagttcttcctcagcgacttgcccgacggtgttgctagctgacgcagccatttccgcaatggcagaaatcggtgtacgatctacctattctcctccggtacagtctcccttctcttatctctcatctaacatagattcaagtggttctgaatttaggctaaatttatcagatgtttgtttgcgaagttcgtttcaagattcggatagaacccaatacatttccgaatattggtgcctcgagatttctctctatttttttaattttgccttctgataatttgaactctgagccaattcctctaccctctgatggaaagagagttgatgtgatgaggcaagacaggaactggtgagcttccctgaaacctgttgattccctggcaacatagatgttttattaggatgagttctcacattaataggttccttccattagggcttttaatgttctaaacttttgattggtgacagaagttacaattactctcatcctctcctgcgaatgagattctattcatttttctgttcctgtattttaagcatgtcagtatgccactactttgttgtccaaaactgaactccaaataaaggtcaaggtggccagcttaggattgaaacaagtttagcagaatctttttaaacaaattatttggtgtttttcagcatacaggtaaacagacggctagacttcatgataattcatgctaatgttgggaggggcaatccactatgctcagctcatggatcttcaggaatggagctgccagcatataaatgacaaacaaatacaaggtaaataggcagaagagatccttcatgtgctttgctctctgatgttctccttagagaaaagaaaagttaatccttccaattatttatttttattcattgattatatgtaattagtaaattgttgtgttgtatatgtattaccattttgacaaaaaaaaagaaagagcactccaattgataattttctgaaccatacaggaaaaatactccatgtgcagcaacgattaatgcttttgtatgagctgatcttagtctctgaagactgtgctgtggtcttcatctctgaaggctaagctgtgttaggttggagcactccgattcaactcttttgcccaccaaactaactaagccaattgagtgctgcaaagcgcaaacagtatggtctccatagcctgtgcagatatagctcttacattggtgttctgccaccataacactgccaaagctgtttccaagctaaaaatcatgctgcagtgatgattcaatcccacacttgaataattgttgtttcctgcactgatgtagtagttactgctttttctcacttgcataattgatgtacttcactcacttttttatatttcataatatcatatagattctcctcaaggactgtaacaagattgaagctcatgcttagctggaaaaccatttgaaatacctatggaattatccctacacatgtgttaaccatgatgatcttttcttttcgaaatactgtaaggcaggtagatccatcatctttgtcaacaacaactgccttagctatactagaatacgaggggcatctaagagaaaaatacaaatattcaagactctcatactagtttggtaggtgatgtatatttgtttcttacatttacatcgtccattgattcacagtggatacattacttgttgcatttagatgtctcttttcaggaacctttatatttaagttcctttacatggctgttttaagagtccactgctttgattagtaacataacattgactgaaatgaggatttgttcattaatttgacgtttcttctactgtctcggtaacatctctccatgtgctgacttaattctccaaactttgagttctactgacttagtaacatctttcaatatgctgagttaattctccaaactattaacttaagaatgatttaacttggcacatatttttcttagtgttcaagaaatgattttagcagatgattgccattgcatttggtgatctaaattgactaaattgctgaggcagatatgtttcttgcacagaaagctctcatagtgaagagtcaagtctcttcgtaaaactaatgaatctgaaatgtagtcgttttttcataccataattgataaatgcactactgttgtctcatctgactgggtttttggcccgttctagagtttacaggtattatcttaatactgcagttctcgcaaacaaaattacgagaaatttaaccatgtacctttttcagttagttgacagaacgaattgcatcttgtgcccatagatattggatgaatcatagtatgcttgtcatccctgctatgtattgtgaaattattgtgaaattattttttaaattattaactatctagaactgtttctgggaacttaagttattaaaaaaactattcaggttaaataatgttcttggtaggtacactaggaattgagtattgttagtaggtaatccacttagacaaacctttgcattaatcgtatatttctttctatgtgttacagtcttacatgctacaataccgcgcagcgtagcgcgcgagctcactctagtatatataacggactaaaatgtttctagaacaatgccactctaatgtacagaatagagttaagggcaattatgtaatttctcgttacatatgaataaaaagaaccccgagaggtaaaggtggagatctccattcattctatactcaatccactgtcatcttcagtttccccctctcctccctactctacactagcaatgactccctctcacaaagaggagggtccttatctcgttgggataatttgtttcaacacataggatacaagaaaatccatagtagatgacatgaagagaagaaagatgagagtgtacacacaatgttattctaatattaatgggactaggaggcgctgggaatcaaagtatcagctcaaccagactaaaaggcttcagccagacgtctcgccgtgccaaactgatgggattctttgagcacagaacgggaccccgtagagtggcctagtgcttatcatccttgcgacatctcactcgacgctagagcagataaagaagcgcacacgtcggtcttctgccatggcatcaatcgttggacagcttcccagagctttggccgtcgctccggtcttctgccatgacatcaatctttggaccgccggcgactggccttgttctgggatgaacttgaacagatgtgggatgtggcttggcacgcataggattgctaggcgaagacgtcggccagaaaacacggggacaaattcgtggttgtatttcggtgatgagcgccaagctattcaattcttcctccaatttggctgatgcacgttgtccagtgatgcagttaatcttgtggaattgaaaaattaatttgggagaaaattaaatatgaagcatataacatgctctatctaaggaacaattgtgcatgtgaactttggaagttgaggggggtgatctgtctatatgtttcggtaaatgttgctcattggattgaagtgcaatgaagcagaatgtgaggatagctagactgcacatggtggaattgaaaaagatcaggaacaacacaattttttttgaggggaaagggcatgagctctgccaatttcatttaaggagagaaagcaagagtacaaacaacccctaacaagttaatgggtctagatcccgttgacatttggcggggaagacaggcaat

SEQ ID NO: 31281 - DNA, 991 bp, Oryza sativa
  unsure (1)..(991): unsure at all n locations
ttttttcctacaagaatcccaccatgccaagatatctccattgaagaggcttgtggtcggcatttgtaggcccagcttggaccaaattgagctccaaacctgctttgcgaaagcacattccatgataaggtgcctagccgtctcgagttcaatgccgcatagggagcatatcgggctgttatcccatccccttagctggagtttgtcagaggttaggatttttttttatgtaccataagccaagcgaaaaacctacatttgttttctgtctttgccttccagaagaaatttgctctgttgtcctgtatgctacctaggaattggattttgtatgccgagctagctgagtatgccccattcggcgtccatttccaggtgatggagtctgttgcgctttcatccaggtggacttgttggattaaaccccaaaggagaatgaactctcttacttgggtagtcgagttcatcctcctcataggtctaagccatctgttatcctgtaactcctgtgctactgttctgttttttctagtcaccaactagtagagggaaggcgttaattcctttggtgaggatccctgtagccacctgtcatgccagaatttggcttttcctccgttccctaaggatatgatcgttgaggccctgaagagttgcttatcggtctcatcacatggtagatttgagcccttccatggtttatcttcatccatccattcctgccggagccatcgaaggcgaagtgagcgaccaaagatgtactgttctgaacaggatgtactgttctgaagattctgaactaaacttgctgcaccaagaatccaagattgtgtgacctgtgagtggtgctcgtatgaaattgccttgagcagaacagcttcttgttttcgatgaaaatctggaaccagggttttgccgttttggttctggaaatcagggaataagtgaagagnnnnnnnnnnnnnnnnnnnnnnnnnnnnnnnnnnnnnnn

SEQ ID NO: 31282 - DNA, 2036 bp, Oryza sativa
atatatagcttttgctctatagataaccatcgtaaattccaaattcttccacatcaaagcaaacacaagaagaaggaaaaactacattcattcgcttcaaaccccgtcaggagtggctgtttcggcacaagacaaggaagaagaactttttagatttttcaaggagagattggggaccaatttccaaagaactttaagtctaaattggtctctattacatttattacatttaccttcgttggaccttaatgagctagaagaagatattacggaggaagaattaaaatccataatttttgatttgccccctgaaaaggcgcctggtcccgacggcttcattggggcatttttcaaaaccgcttggaccacggtgaaagatgatctcctcacaacaattttatcctttatgcatctcaacacttctcaacttgcagaactgaacccagcctttatttgccttatccctaaaaaagatgatgctacaggcgctgatcacttccgtcccattagtctcatgcatagcttcgtcaagattatcaccaaaattttggcaaatagacttgctcctcgactaaatgaaatgatctcacaaaatcaaagtgcttttgttcataaaagggcaattcatgacaattttctgtacgtccaaaacatggtgcagatgcttcatagatcaaaaaaacagagtctattcattaagatagacatagcaaaggcattcgacactgtgaattggccatatctcctggaggtccttcgtcatttcggctttggacatcattggttaaattggatctctaatctgttttccacctcctcgtcccaggtgctcctaaatggttccccagggatgagaattaatcatgctaagggactccgtcagggagatcccctgtccccgatgttgtttattgtagctatggagccttttcaccggatcattaaagcagcggagagtgccaatgtgttagccctgattggtgtgagaagtggcatattcagatgttctctctacgtggatgatgtggcagtttttgctctcccaaatcccgatgacctgaatgctctttctcgcatcctttcgtgttttgcacaaatttctggtttacattctaacatcaacaaaactgagattttccccatcagttgcaatggaatcgacatgcaacagcttcttgccggttggccagggcagatcaagaatttcccttgccgctacataggcctcccgctccacttcaagaaaataaggaaaattgatttccttcctcttatagacaagatcggggccagactaccagcttggaaaggtcgcttctttacctctgcaggtcaccaaaccctagttaactcggttcttagtgctatgccgatgcatcatcttacagtccttcatgcgccaaaatgggtcttcaaaagaatcgaccgtttcagaagatcttttctgtggaagggcgaagaccctgatcattcaaatccaagtgatagtctagtcaattggcaaactgtttgcaaaccgaaaagcttaggagggttaggccttccggatctggacaggttctctagagcactccgactccgctggctctggttcaagtggaaagaagttgataaaccctgggtaggcatgaatgtgccttgtgatgagatggacacaagactctttcaagcggcaacgacaataacgattggtgacggagcaaaaactagcttctggcatgataattggatccaaaaccgttgtttaaaagatattgtgcccagttgttttagcctggcaaagagaaagcaaagatcagttcagatggaaatgcgagataatagatggctcacttccttcagacaattcacttccgtggaacaaatccatgatttggtacagcttggtggattactccaactggtttcgctttcccaggatcctgacaacatcaccttgaattggaccgagtctggcgtctacacaacaaagagtgcttacctttttcagttcgaaggctcatttgccaccaatgagtttgattctctatggaaat

SEQ ID NO: 31283 - DNA, 2103 bp, Oryza sativa
  unsure (1)..(2103): unsure at all n locations
nnnnnnnnnnnnnnnnnnnnnnnnnnnnnnnnnnnnnnnnnnntctcgggagtatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttggatttttaagcaattgattagatacaatatcattgcttttcgccacgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcattcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacatgtcgggggctacacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagtagtgtagtgcgcgctcgctggtccatcactctgatcgatcgttcgatctgttgcagggaggccatcaggagctacgccgagaaggcgcacgagctggtcgtggacgtcgcggcgaagctggccacgagcctcggcctggactgctcgttcggcgactggccgtgccaattccgtatcaacaggtacaactacacgccggacaccgtggggaagaccggcgtgcaggtccacacggactccggcttcctcaccgtgctccaggaggacgaccgcgttggcggcctcgaggtcgccgacccggacaccggcgagttcgcgcccgtcgaccccctccccggcacgttcctcgtcaacctcggcgacgtcgccacggtatgtatgacaaattccgatgccgctgtgccgaactctacttgtatagtactacctccatcccagaatatagcaacgtatctggacatgactaatgtctaaatacgttgttttaggatgggtctcatctcatcctagattgatatattctgtgacggagggagtatatgatctttgtctggtttcgcgtacgtgttgtgagtttggcgcgcgggtgcaggcgtgnnnnnnnnnnnnnnnnnnnnnnnnnnnnnnnnnnnnnn

SEQ ID NO: 31284 - DNA, 3048 bp, Oryza sativa
tgtgagtttggcgcgcgggtgcaggcgtggagcaacggggagctgcacaacgtgaggcaccgcgttcggtgcgtggcgggggtgcagcgcgtctccatcgcgctcttcctgctggcgcccaaggacgacgtggtgcgcgcgccggaggcgttcgtgagcgccgagcggccgcgccggttcagggatttcggctacgacgactaccggcggctcaggcagtccaccggggagcacgccggcgaagccctcgcgcgattagccgcatgatgcagtaataatcacctttaccacggtgtgtaccatcatgcagtcacatacgggagtactacaattgagaggtttacttacagtatatgttcaaacgggagcgggtgtttactttgtttgatgcactgcatcaattaaaatattaaaatatacttgcattacaaaagttaatttgttgattaataatacatgaacaatacttaaagttaatcataatttggctctgtttttgtccatttgagcctctgacttactcaattgatgagtagtagtgagcgaagtaactcatctgagcaaacagaatccagttaaacggttgatcatggaaaattttgcttagtaactagaagtaagaaaaaaaagagagttggcgaggagggtaggttacattgggacctcctctatatgaaaagacctagccgaccataggctcgaccggagaccgtggtatacgtcgaggacaagagcgcaaacgaacttaatcgccgacgacctgaacagacatcacggtgtgtaccatcacggtgggcgcgcaccatgcctaaacactgtcactcgccaactctcctgccctccaattcaaccgtcgttggacaagcctgcgctaccgggggatggccgcggctttatcgggcgcgcattccgcgccggaaaccgatgtggggactaaactctggcagtggcgcactccgagatgacggtgggcggatcgatgataatcagcagcttgcctactccctccgtccaaaaaaaaaagacaaatcctggatttccgtgccaacgtttgactgtccgtcttatataattttttttataattagtattttcattgttgttagatgataaaacatgattaatactttatacgtgacttatctttttaatttttttcataatttttctaaataagatggacgttaaaacgttggacacggaaactagtgtttatctttttttttttttgaacggagagagtacttgcgatcgagtcgtcttctattccgaactgagatgtctcccactgcccccacacattgtgattgatgtgtcgtggtgtggtacggtgtggctgctactacagtggagatcaatttgcttttcatctttttaatcgaatggattatttgaattttcaaattttgcatatgctgtcttagctcttaacgcctgacaatttctaagttgacagggatccggaattttacatttgatgcattattggtctaatatactactccggagtatatgctgtgtcgtcacatacgaacgacaaactgtgatacgcgcatgcatcgaagtgatgaagcactgcaagctgcatgcggcttagtacacacacgaatgcttagcaacatgcatgcttgctctgttcctccgaatgtcgtttcatggtgaggcatagtgcttaactgaagcactgcgaaccgcatgcctgttagcacaattcataatcatcacgaaacttgtggatgtgggtatgtttaattaggaactacttgcttcgttttaatcattttagcattgccaaaaacggaaagacaatatatagaaacagaggaagtagctggtatcaaaaacaatatatagaggttcagaagaacaaatgaagaaaagagttggcatcttgggccatactccagtgcaacagcacccaattcaactgtcgttgggttagatttgtccagctggcacctatagagaaacaaaataacaaaagaggcaaggtgtggtttagagaaataacaaaaagagttggtagtgggggtttaagtgggcgaacccatgcaccacgaagaaggctttgcagcagggtggcgaagcgtaggctcatctcgtgcatcggacagagactctgtcctttgccatgagtcccgggggggaaccccggctccgtggaaatccaaagctgcacaactatcgggcctgggcttgaggtagagagccccaacccaattaacccgccagcctatacaggccgaccagcctggaccaaatacgccaagtcccctactccgaaagccccaatctcctctaccggctcgacgcaccgacctaacaccgacccaactccagctggctggtaaatttctctcgcggggggccttctctcttggcccgcgaccccatcagtgagtgagtacccattttctcttatgggcctctttttcaacgaccggcctgcaacacagcaggtgacctcggtccaacaagagcgcgagcgcccccacgccttttcttcccatgcaactatctgacggcggcggcctggcgacttccccccttccagggcacgccggcgcgcgtccgatttagggagggagagtttcgtttcggcgacctcgaccccggcgatttgccatgggctcgagcccacaaaccccaacaaccaactctttagccctccgaaagctggagtaacaggcacgcgcgaccgagcccggctggtggagatggtgggaagcgcgtatttaagctggtcttggcgtcgttcggcaagcggtatggtactaatcgagggaatagtgcttgtagaggacatcggtagtgagaagtgggtgcttgagctgacttgaaagcccatcttacatgggcctcttccttctctgtttttgtctcagggaaacatccgagatctgcagctgggcaggccggcacggagcccgcctctgggggtccacgaatccgctgaatccccctggtgttggaacagcgaagcttctcgttagcctcacggcctcacctcaccatcgtcaacttcaccgagaagcttatgcaaacagg

SEQ ID NO: 31285 - DNA, 4745 bp, Oryza sativa
tccccctggtgtgggaaaagcgaagcttctggttagcctcagggcctcacctcaccatggttagcttcaccgagaagcttatgcaaacagccaaacagtcttttgcttccctgaccagtgaaagtcttgtgtgactgacaatcatgttccatttgatcatttgatgcattcttctcataactctgattaagttaattggtgtggtttctcatggtactggagttgcacaaggtaagcacttgagtaggcgtaatgatgggcggaaaactgatcgtactaaaaattgtgcgctctcccgggctaaatactacaaataccctcatcttttcgtttatatttatacttataagtcaaaatttaaatatttcacattaaatttgaagctaattttgagggtttttttatcaaagtttatttttcagcctttacttttattactaagaacacataaattattatcgatgggcgcgtaagttgattaattgaagtagaaatctctagcctgtctccgaggtagcagtcacccagtagctccgtcacgctgcctgttagcttgcggttcaatatgcgttgtgattacaacaggcaaaacattgagcaatccatttgtatacatcttacaaagacggtgagattagcacggcattaccctgcggataaggattgaatatggagtaccgaggtagcatgtaaatggcatggctgttgtgcgttgtgccagggctcattgccatcacgtgttcatgcttcacacgtaaagtacatacagacgttgtaattagatttgaagatgtgtttattgacaaggtattggcaaaacggccgcagaacaccaatgtctaggtcggcttgaccaactatgaacaatgttgaaaataaccaatcatggcaccctacgccagggcaagaaccatagccacactcatcaatcttcaactcgcaattgcagcatagggcagctagtagttcggaatgagaatggacaattgccgaatggccacgagaagttagaatccggcccaccctgatggttgctccactttcttcgctgctcctgagctgaatctctgggaggaactcccctgagcagtgggcctgttgatctgagcggcagtactccctggtgatgtcctgaaactatctggcccgaaaccccaaccatctggtgattgtcttgagtttgcgttccttgccaggttttgcgctccattggtagaatgatcaacctttggtctgacctgagcaggttgagatttggggtcagggaatgcctgccatgttttggcttcagagctaggtaatgagtttgcgagcattccttgctcaagctcccacaccgttccttcaatcttctccttacgctacatatgaatgcaagtctcaggtaagattctaacagaattaagaaataggttaaatacgttgtaccagatatacaaacggagcacgaacctgtggcccggagtctggtaatcttgagctgactttgcttgatggaggtgtagtctcggcaagagtgcgcttgagctcttgaatctcctggcgctgggagcggcatattgcagacaacttttcaaacttggctgtcatctcggccttctctgatgatgttttcttcaactgctccttcagattggacacttctgcttcaagctcagattccttactagcaacattggtcccagaatggagattgtttgcttcaaaatcagcgacaaagctgttgaagggatccttctctgattttggttgtgattctttagttttcaaagaactttgtgactccatgaacagatttgtgttagcaccacttgcaagcccattgtttgatacagagttacttggtgtaccccggacagcctggccagaacgaccatgtctatctccaggggcactgatgctgatatcccctctgctttggttatgctttgatgaaggtgatggttttattggttcctcatcaaacaaagagttcctattatctgcaacttgagaaccctgtgcatgctgtgttgcccaaaatgcacctagaggtgcatctcctgcctttgagcttccatgagataacgaactattggattgttctattggaggaggaggcgggttccttctaggcatcacatgtgttcttttataagcacctatacaagaaaaaaacaagacaaggctccaattatgcaaacaaattattgcaatcttacatgatttggtggcttctgtctgaattgacaatagcaaaataatgcagtaagcctacctcagccaacaatcacactatcttttagaaaatatttagaactaacaatcagactagaacagtaaatgtttattctagcatgcagtgcacatcatgatggcatggcacaaaggctgtatatcctagaggacaagaaggtaggtcatgacagaaaggttgcttagcctataggacaagaaaataggtcaatgacaaatgcagtgaagcaatgcccataatcataacatccaaacaaatcatagaggatgccaaaagctccctgatgagaaaaagatatacgagtgcataagaaataccaaaaaatatgtttatttgaagatggcccacatacatttgaagcaaccccacatgaataatgaagtgcattctagtgccaatagcatgtctttcagcataccttcatcttgcaaactcatggaaatgcctgacgaagctccatcgggtagatttttctgtaactcgagaggtagtagttcatttacacgaaaccagacctgtcaaatgtacaaagtctaacatcagatttagaaaaatatgcttatgtggttcctaaggctacatgcaacagtctatgactaacctagtatcatggagatgaatggccaatcaatcaaagctcttgcctgcgtgacatcaggtctgtcatttggagaggcttccagcatatctttgatcaactttgtgacagcggcactatacttgggttgctctggaatacgataattgccattaagtatctgcaacttggactctccatcaaatgcagacttgaagtagcatattctatatagaaggcaccccaaggcctgccaaatgtcaattcaaaaaaattttataaacaaattcaccttggtttgaatataatgcattgcaggatgaatatatagatttcaaaaattaagaacagtgtgattcaccaagatgtatctaaatgctaagtagatatgccagcataataattaaagtggatatagcatataatagtacttgctgtgaatataattacacttacccagatatcgactttctcactaataacttctcttctgtaaagatcccacatctggaaaatgcatccatggggtcactgggggttacacaggttttaaaaactataaattactccatgggcaattgtttctttacctcaggggccctatatgctggggttgtatgcttccggatgatatcttcctcaatccccatctcttctggcctatcaaagcatttatggtttgttgatgtgcttccaaaatcgcacaatttccatgcaccgtctaatccaagaagaacattttcagctttcagatccctaaagaatcagaaaagaggcagaatgtaagatgcatgtaggtgataaacaataaagcgattgctataaaaccaggtccctcatttacacctaatctggaataaccctaactgattatttgtttgcatatgcccagccttgagaaaatagacaagctacaaggtgcaggagttccgcactttcacaacaagaacataaatttagtacatacacagtttgctaatataccagcaattgcttagtgaattcaagtaatctaatcaaacagtaaaacagaacagcataactcctgcaggaacgtactttcaaatacttgataaaagcacataaaacgttctagcaacgatgagatataactatctttgatactttaattttttttttcaacatacctatgtgcaattggtggtgactgaccatgcatagcaaaaactgcattgcatacatctctgagaatcaaaagtgccttcttctcctcataataaccagtacctctgctctccattgcgctaaccaaggacttctcacagaactccataacaagtagtgcctcctttgtgcggcccatatcaaaaacatcatgggcaactagtgtaaccacattaggatgccctttgaggaggttcatcacctggatctcctccattacaagatcaagcaattctgagtcgttgcagatgatgtgcttcattgcgtactgctttgatggatgcattgcgtcggatgccagatatacacaagagaaacctccttgtgcaatagcattgcgtactgtaatcttaatgttgccaacatcaatggtgcgaccttccaatccattttgtactttccccccgaagggattgaacctccacattatttttttttccgcgtgcccctacgaatataaatgaaaatccactgtttaatttttgtcagtgcgctcttacaaatatttctgtgtagataaaaagaaagagtgaagctccaatatgcagtaagtaaaactgtaattgtaaaagtatagcactatatctgtgtactacaagattaaaagaaatactagctgctcaaacaaggttatcaagctccatcacctaggccctaatacaattaccgtttaggatttttactaatctgaagatttaacatagcaactgcacatggcacacccagcagttaaggataaccacattt

SEQ ID NO: 31286 - DNA, 5389 bp, Oryza sativa
gaacccatattctctgtaactaattaattatttaagggtaatccaagtatccaagtgaaccaaaatgggtgtgactagtcacccacaggtaaacccgattgctggcacagttctccactaagatatctgatataagcaatggcgttgctgtgaggcactaactccgcagaaatcacagaatccataagaccgtgtattctaaactggttaatcctaagcagagcggatgctatgaacacatctccagtacgatcagcctcatataagatcatctcgtcgaaaccgctgtgcatcctcgataaacaccagaagtaaagggaattcgtggtgcctttcagccagatttcaaccaagcatctaaaataaccaccaaacaaaacaaccaactaaatacgctcccgtgccacacacccccgcgcgcgcagatcgctgcgatcccattcccacgcacgatccaatccaatccaatccaaccatccctccccatgccaaatgcagatccgagcgccccgcccggtgaaaccgaacctacccacgcgggcgggccgcggcgtcgcgttccccagcgaaacgcgaatcgcgcggaagagcttggccaggccaggcgaaggcttacgcggcgcgcacctattagatcgaaggctcctccgtactcctctggggctcgcgtcctcgccgccgccgccgcccgcgggcggattcgcagcgcgatctgcggtggtggaggaggaggttgctgggggtgcgcctgcgttgtgatgcgacgcccgtggaggtggaggtggaggcaggcgagggagggagggaaaaaggaatggacgaggggcgagacgtggtgatggatggagtggtggaggtggaggtggtggaaccgtggcgtggggagctttgcagttgcagccttgcagggggtgtggccgggtgtgggggccacgcaagggggtgtgggctaaaatattttccttcttttttgcgcctttttgttttcgtttttttttttttgctcgcgtcgcccttcttattggcagcctcagcaatcaaagaaaggtgttgtaaaattccaaatcagcatcatcccaacttgacaggttattagagcaaagttaataatacagctgacttgttgtatgtaagattctttatagtcttctctcagcccacccatataatagttagctctttataattaatatttcatccgtttcacaatgtaagttacaattaatgaatctagacagatatatatgtctagattcattaacatcaatatgaatatggaaaatgttagaatgacttacattgtgaaacgaaggtagtacatggttaatttgtcttctctcctctttctctgctctacctcggtatttagttggcttacaacctcctattatactttctcttagtagttccaaaatgcatggtgcattctcttttttttattttagatgaagaaatttcagaaggattgcaagtcacaaaatcgtaattttaattcaaaacaagaaaatcaattagtataacacaagcctgaaggcagagataacacttgcattttcgaatatggatgcaagaatctataaaaccattgtgttgtctagtggcttataagttgcatatagtcattttatttctaaaactagaaagaagaatctctaaaattagcggccattcattataccagttatgtttggatcacatcaaaccgaagcggaagatccattagtgtagcatcgcctctacaatgaataaccatacatcatctatatgccattttgaagactagttgttgtttgattcatagccttagtttccataacattagcacgcaggtttaatcaacttagcccaacgtttggtttgttacacttttcatgtgtcataacattcaacttagggtcctcgcttgtgtactattcatagccaaagtttgcatagctaatagttccttagccacaaaagttgtggcgtgccgtatcttagctcaaaatatttggcaaaatactacatgcaaccaaagagctcgacacacacgatcagttctgcaggaccatcatttgccttttgacttatcaattgcatacaaaaattgaattgtgaaactaaattttagagttgatttgtaagtttttttaatcgtagttttattctggctttcaagtcgttaagaacatggatatatataagtatattcattatttttttctattaataatccattttatggcttactagctgtagacaaggtttgctaaaccgtccttatttgtgagggtatgttaagagttattggaagtagggtttggtaaattttgttcggatccaaattatgaaaaaaggataaattctcctaaaatttataggatcaatacatgatttgcaatgatatctggtgacaaaactttataaaaataaagctaattctatattttggcatgactaaaaggcaacattggtccaaaatcgatgtttgatgctcgtgaatgttatatgtgaatgctataatcatcatagttgtagacattatatatttctattgtcaaacgtggttttttcccgtgattttctttttatttaagtcaaaagagcatgtttaccacgccttatcgtgctgcgattgccacgacataaccacagtaatcgcgatattgtcataagatttaaattttgatatttaaattttagaagataaaattcacatggtctttagcggtaaccaaacggttaccgtgataaccgtcttattgtggggtaacggtaatctcccatagatcatatgagaaacttggttgtaggttaaacgattaaacttgcgttgaaaattgacgatgatcgaactctcgttaacaaccttctaaacttgattttaagtttgaaaggcttgaacacaagtgcaacattctcaatttcttatattcgaaatcctggcaatcccttttaaaatcttgggagcacttgtttctttgccactacttgcggttgaccggtactttcacgttcgaaacctcaaccaaatcatggtggtgcacggttttcgggtttggtagcatgttgttatcgggtaccacagggtgccccatcgcaaatcgagaatgaaacagagccacagacaaacacagaggtgcgaagcttcgtgaaaaaggcaacgcgtcggtgcgatgctgcagtgcagtttgcctttgtgcttgtccagatccgacaaaatttttcgctctgtcagatcaaatattaaatataaaaaaataactaattacatccgtggataaattgtgagacgaatcttttaaacctaattgctctattattatttgacaatatggtgctactgtaaacatttcctaataacgaattaatcaggcttaataaattcgtttcgcagtttacaaacataatttgtaattttatttgttattaatttatatttaatactttaaatatgtgtctgtatatatgatgtgacgtaccaaaactttacacccataaatctaaacgccccctctggtgacagatcgaaacgttggggctatatctgtcacagacaaattcggtgttactacagcggtgcatgtatcgtacatttgtacgtgtaattcaagcactttggacggatggaccaatcactgatcaatcgatcatgtgacttctccggctcaagaggtgacagcaaaacaacatgggcttaacagatttaaatatcaacctaacatgcccttacacccgcagtgagcagtgaagatcttcaactagatttaaccatttataaataagaaagcataagtatagcttaagaaatgctcaaaataaaaaatagttttcaaacaattgtaatagctattttattcaatgttagattaagggttgggaaaagaatatttatagtttaaggttacctaagagatgatttttaaggaggtaaaaaatatcaagctaacaatttttaaagaaaaagtattaactacagcaaaataaaccaattcggagagaaagtactctctccgttttactcagtgtcatattatttcttagtcaaaattctttacattcattcaatcaaatttatagaaaaactagcttacattcattcaatcaaatttatagaaaaaatagctaacatctactctattcttacacacaagattggctttatgggcatcgagaaatgcaaatatgtagattggctttatgggcatcgagaaatgcaaatatgtagaattaattattcttgatctgtagatgaaatatgactataagaaatagatgaagagagtacgtcattctagcattttctctaatattaatgaatataaacatataaatctctttaaattcattaacatcaatactctttaaattcattaacatcaatacaaatgtaatacgaatataaaaaatgctaaaataactcacattaaatcgaagtactacaatttaattttattttatattaaacatattttaatacaatatttgtttttattataaatattactataatttattacaaatcaaatttgaatttttttaaaaagagttctatttaattaactatagctaaatttagatttggtattttgtgggtagggaggcccacacaggcaagtcctgcaaaagtaagcagtgtcaatacccgcgcgagccttttcccctcgcaaaaattgccgtgcagggtttgagtcccgcaccgcgagcggctctcaccgcaacgctttgttttccttactcattagtttaaggcaagttttttcgttgcacctcacccaccttatatagcaccagccgcaccccgcatctcctccggccagcgaggtgggattattcaccacattccccctctcgttcgttgcgctgtgtcgaccatatatgggccgtggtggcccattgacctgagagggttggagcccagccgtaaaatgtgggccgcactgcgtcggcccataactagatgcgaacatgggctaggcccacttaattcaggtctctgaccttaaaccctccgctcgcctcctccgcgaagcatatacacccccattctcttcctcgcgccgccgccgccgaagcagctgcgaccgccgccgccgcgattcgagccccagccatggcgaagaagcggaagcgctcctccgatgcggcggccgcggtggagaagcccgacgagttcgcgccgcagcgcccggagcgcaccctcttcggcttcaaggagaagcccgcggacgacgaggaagccgaggccgaggccgcctctgagggagaagaggatgccgccgccgccgccgccgcggcgccgttccgcaacaaggagaaggtgctcgtgacctgctcccgccgaatcaactaccggtgagtggcgccgcaccgcgcgctcgtttttttttcgttcggtgtgatgtggcgg

SEQ ID NO: 31287 - DNA, 4016 bp, Oryza sativa
cgaattcgagctcggtacccttcttcgaggtatatatttacacatatactgctacgatctcaagttgcttcaggcctcatctttgatgcgctgatggttgcgtgcttgataggagaagcatgcaataggattatcactagctgttgaatcgttctatacttctgttcttaacatgcattaagctagtgatttgtagttctagcgctaaaacaatttcactctttagtaattctatatttcttttctgctgcggagattactgagctactacttcactatgataataaagcttggagcttcaaattctctgttcagtttagaccttagtattgcaattctgatggtggaacttcttctatatgtatactacagtgcagaaaacagaaggatctttacctttggatggttaagtcccctggaggaccatcagtgaaatttctagttaatgctggtaagtatgtcaagtatttgtgagctgtaatctgtacaagattatggacattattccatcagtgcctaaatgtccagtaatgtttacatgcagttcacaccatggaggagttgaagcttacagggaaccatctgaaagggtcacggcctcttataacattttctacaaattttgatgaacaacctcactggcagcttgtgaaagaaatgctaacccaggtgcatgactgatttgatatgttattttgctctacatgcattcttatcaatgaacaagttgatcatgcactagactaaataactaatctttatcaacttattgtgactttagtcttggttttttgcctggtaacagcgttcaaacttgagtagttgaattaaatacatgttttttgataatgtcttattgtacttgtagaacccagtttgtgaattcaattcacaagtattgagagtgttctgttgtttatggactagcctgtaggtatctgctgtactgtctacatgaaacactttacatccatttttgacatgttgataactttgattaagaaagtgtaatccttttaaaaatctggttctagacttcacaattttttagtactttccatcatacacctttttcttaatgctgtcagttttcagaattaatatttggtcatgatgccaatatgaatgttgttttagctttcacatgttatgaactttatggagaactgggggaatgcaatccgtgatgaagttatacatgcttcttttctagtaaagcagttgagaaacaaacttgccctaaaaaacataagaaactaactattatttgctctgcagatatttgctactccaaaagatcatcgaaaggcaaagccttttcatgaccatgtgtttgtcttctctatcgttgatgaccatgtttggtttagaaattatcaggtaatatattagtctgtttgttttcttaattttcattaactcctgccagttacaagcaatagaagttcctagcattgtctgaatattaccgtatgatcaactttgtcagatttctgttccccacaatgagattgacaaggttgataaaggaggtctggacaagatgacacttgttgaggtaaaggcgcatagcttctatttgtataatatttttttatgtttccaagtttagtttcagttttgagatcgaacttgctgtgtaggttggcccaaggttctgtttgaacccaatcaaaatatttggcggtagtttcggtggccctacattgtacgagaatccattctatgtgtctcccaatcaggtatcccttttttaccaccaattgattgctgtgtatgtacaatacatatttctgagcatcttaggtgagcacctgaaaatgttaaagcaatctaggtttgtttgttctggtcatgcttacgctttcttttgtgtatcattaaatggaccaacaaaagtttttgctgttgtgtttgctctgttcattgattcgtctaagcattgtgattttgattcaactataacaaatcatttaccctcatgttgcacgactgcacgtgtagttcatatgtttattttgttatcttcgtcagatccgtgcactagagaagcggaagaaggccggcaagtatgccaagaaggtcaaggctaaggtgaggaggaagatgcacgagatggagaacactctggagcctgatgaatttgctgaactttggaaaggggaggactagttcagctatagtgattgaaccatcaacccccgttaaactagttgctctcgctgtcacccgacacgagttttgtttactatatctcgtggaatttcttgtatgacaccatgagtctattatttacatgaataagattttagtgtcctatcctaactccatctcgtctcgtgcttaaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaaacgaggacccgatgtgagcaagcttataggaaggggaaaaaagagtcactttccatcgtttggcgctctgctcataagtcagttctaaagtttaaattttaaaacttaattttgaagttgattataggtttattttttatgttggtttttaaactgcaataacacaaacataaagtttaccaacaaatcttttttcttctgttgcttatatgtcgttttatgccctatcagacaagatcatgcaaccgaaagtaagtaccaaggatagccgtgaggtaatcaaaaaagatttgaaattactttttgtcaaaataacgagggggaaaacatctacccgtaaaaatctgtctagagcaaacgcttcgctcttattatgggctgtgaacttagcaaaacaaaacggacggattagtttcatgtgcgtccctgatatatgtctgagtttcatttgcatccctcaatcatataataaaaacgtttattttacattagttttacgagttggagtatactctatatctggttttgcatccctcaaccgtaaaccaaatatagattacgtccattttgtacttagttttacaagttggaggcatacccagttttgcggttaagggtcaagcaatcaatactttttgagggatgttaagtggactttttttccacggccgaaacataccgcgtgcatacgtgctgcgttaaacgagcccaagaccaaaatccaggagagcccaagaagctagggtttccgcctccacgccgccgcacgtatataaacctgcgaccaaaccctcccctccattctccttcccaccccaccggcggctccaccctctctctcgcgccgcagcgaagcgcctcccgcagcaatggcgccgacgtcgaagctgtcgcagggcatcaagcgcgcgtcgcggtcgcacacctaccaccgccgcgggctctgggccatcaaggccaagaacggcggcaccttccccaaggccggcaagcccgccgccgccgccgagcccaagttctaccccgccgacgacgtcaagccccgcgcccccagcacccgcaaggccaaccctaccaagctcaggtctcagccatgcgaccaactatcggctgctcgtgatctatggatcggtgttcctgagtgatttttatctgtttgtttgtttgtttgcgtgatgcaggtcgaccatcacgccggggacggtgctgatcctgctcgccgggaggtacatggggaagcgcgtcgtgttcctcaaccagctcaagtccggcctgctcctcatcaccggtaaaccccttcccgcctctccccgtgcctgtaatactgcgatgattgattttggcttgtggctgtgccatctggaaagcttgtagtgtgcggatctatgaattgattttgtatag

SEQ ID NO: 31288 - DNA, 1190 bp, Oryza sativa
aatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggtatgtcttgattctgtatggcattcctccatggccagttaccggtttagctccaatgctaactcacctgcctattctctgttgaatcttataggcaaccaagaatctgcccgacttcaagaaggatgaccagaaggctgtggatgctgagttgatcaaggctatcgaggttgtcccagacctgaaatcctatcttggtgcccggttctctctcagggacggcgacaagccccatgagatgacattctaagttagtcggtacaagtttcaagttctgaggaagtctttttgcctagtgtgtttctgtacttctgaattttgtacccgggtagtgaactctccatttctgttgaagtctgcctgtcaaatattatgagaagattaagagaaggattatctactttggtggttcatggttaccgtacctactcaaatgtgcaatgcataacatttgagccataattaagctattgcgttgcaagttgtgtactggtgtctatttgattttttttttgcttgtttccgcgaggttaacttatttaactttcagtgcttgatgcatgccacttaggccggtgcaatgctgacgagttgcccttaacgtttcggttgtttacaatttgtttcaacttgtttacggatatattgatttaaacaaaaaagcatgtatgagtttgatttgcagcattagtgtatagacaagatgatctgataaaagaagggcgattgctgtggttgcaaacagtaatagcagatggccgatttcgcaacaaaacaaggtaatagcggattagtaacatatcagcgtgctcggccagattttggacatccctatggagtgtgggtgtcggtaggagtacgaggtttatagattcaagtatgcaaacgatagtgaaggtatgatctaataagagtgattgctccgtctcctcccgtaaaaaaaaaacaacttataactgaatatgattgtaacataatacaacaaatcgtaacatttataatggtatatttgtttttttggg

SEQ ID NO: 31289 - DNA, 5409 bp, Oryza sativa
  unsure (1)..(5409): unsure at all n locations
nnnnnnnnnnnnnnnnnnnnnnnnnnnnnnnnnnnnnnnnnnnnnnnnnnnatgcttgtccacctcatacaagagatagcaaaaagtctacctttttaataggttgtctcatagcacattgttcaaaatgctttgggttccacaacccctctcatattttgtttaggagcttagctcttgaagaagagatagtgcactctctctccttatcttctctctcttctacatcatacaaaagctgatgtggagatttatgagctagctgactcatccttgttggaggaggccttatgtccagctctacacgtgagtctagctaggcactttgcctgccatgggcccacctgccctcacaacaaccaacggaaaaatgaatagacttaaagtaatggctggttagagattagcttcattaaaagatgaagtattcgctgctgttgtatgttgttgcagatggctggtgattgaaggacgtggcaatcggttggagtcagcagtcggcactattattaaccttgctcttatataacctgtacatttagctcgcctcgcctttacctttctagctaccataaccttagcattatttattacacacgctctctgatcgatcctctcttccgaatacaaaaaccaaccacgcagttacatgggatatatactctatatatccaacaaaaactatatacagtagatggccaaaagggtgaagtgaagtaaaatatcgatcaaaagtgtatcacagttgtgtacgtacatgctcattttccattcactgggactaggaggcactgggaatcaaagaatcacacaaaccaacctgaccgcctacaagaacttctgtgttggtgaagaactgctcagacactttgcgtgctgtccaggagccggtccagtggcgcagtgatcatgatgatcgtttggtgtggatggatcggcggatggctccggagagaggtactcgccgttggagttgtgtggcttgtgtccatggagcgagggagctcgcgatcgatcgacaggcgcttgcttcttcacttgtggttgtggacacaatgtataggccttttgtgtctcctgtacgttggccttcttcctcgtatcttctcgttatcttaagaaatatttgtcgctgatgcatatggtattgtatgctctcttcgtatggaagaattagagagtagtagtaaatctgaaacacataacatatgaatgtgtgtatctgagttttggatgtgttgagcacgttgatcagggctgatcagtctatatgtttgggtaaatatacatactgctcttcggcggacgatatgcaagtgctaagagctaggctaagaagtagagttaatatgaggatattgcacaggtggaagacgaagctttgcccagcatcatgatcagcaagccatttcgagttacattggagctcgatcgattgctctgaagaggatgcgttctaaagatggccaaatgggccgcctgatacgggcttgggctgaggtcagtcggaccggcacggcccgacctacatgctagaccatgtcgtgccagcccacgggctgcatacacggcccagtaagactcgggacgtgccgggctggcctgaaggcacaacagctatcattcttctccacagaataagtctactttttccctaaactctataggttgtgtccatatgactgaaaaataagtctattttgtatttctcatgtttttgggccttgcctcatatggttaattaagtgtattttacgtgcctctactatttttcttgatcgtgccgtgccgtgccggcccaccgtgccgagagagcagcccaagcgcggcctggctgtcgggctgggccggcacgagcatgaccccaatcgggccgtgctgtgcttgggccggaccaaattgacgtgacttgggctgggccgtgggactcgggccatatggctatctatacacgaagctgccttgaccagaacggggggcttactagtcacgttggttctgaaagtctgagaattaagtactggacagtagtacagcactagcttctcaatccttattatcttttttttttcgtagagcttttgtttaatccttttggcatgacacagctattaatctgtaatcagtaatggtacctaaaagatctcaagatcaaagtcttcacttaattaaatgcatatcgaccaacactggctcctaattcagatttcaggctctattactattagtaccacctgcttactcatgtgctctgaatatttttcccatctttacatcagtaggctagctctagtgaattaatctgtagttggtggcttggtgcaatcccccccaaccccacacacacgaactatatcaagaaccaaagcctacctcgtctcctctagttacacacacccttcactaatatgatgaaaaagattcaaaagaatagtgagagatacaagtgataaagaggagctctatcttgctgccatgctatgcctgttgtgcaagctagagttcagatagaagccaaacataatgctagctagcttcatcgttccgtataggaatggaaggcgttggaaacatagccattagaaatgcctccgtgttttggtagaatctcctagatatggtacacatgacaatataatgtcgagcacttagcaagatcctagtgctgggaccagagatgccatggcaatagcttgggatgaaggttgtagtatggatcgagcctagatgtgtcgtggatagagcaaggagagggccggccgaatagtgcacgaatcgcgcgcctgcaccaagaacaacacacattggggctgatcgtttgtgctggctacaacaccgcagctgcagccagccagctctatgcaagctgatttgatgtagcagcaacaggacgcagcttgctggctgcaagtacaaacgatcaaagccattgtttgtttgcttgtcagtacatccatactagacatgccttgtagtttgaacatgttctccatttcgagttgagtgatgtcagtaaattaggagacaacagacaagtatatttcactcatccaggcaataatccactaatccctacaggatgtgttgctccgtccttcttatcgcttgttccatgcgcccatcaccttttttctatggcagagaattacatcctagtcgttgtgtgtctagaatatggctgtgtttagttgatggcaaagtttggattttggttgaaattggggatgatgtgactgaaaagttgtgtgtatgacaggctgatgtgatggaaaaggactgaagtttggatccaaagtttggatctaaacacagcctatatatagagcccatagagaaagtctcgacaagggacaataactctcgtgagatgcaataaccacagcatgcaccaaattaatgactatatataaacatgtgctggttactgttgtttcatttcattaaggtacgagggcttcttattccacgagaaaataacaaaaacacattttcattctttcatatactaagggtttttaattaaaaaagaaaatattccatgctaaaggatttgggtccataactagaaagtgctctgcccttttttatccaatgccgatgacctatgtataaaaaaagagaaagttatttttcattttgtatttagtttttcttaatgaaattgaaaatttaaactaaagggcaaatacaaatgaaaacaactttgctgcccatgattgatttttatctagacggaagagtcctcttaatatttaccatcttttccatcctatatttgccactaaaacctcagcatacatatatgcctgatctccaatcctcttctctcatagtatatacagacaccaaacatgtgcttcatgggatcaataaaaaaaatctagtagctgtccagaaagaaaataaaaaggccaagtaatcttgtactacagttctacagacacccctgatccttcactgggactaggaggcaccaggaaccaaagtatcacccataaagaactgatcagctgcgaggcgacgtctcgataatctgtactcagcggatacgctagtactcgtccgggcttcacgagaactatgccaccggctggcatgacgtccggcctccgcggcttctgttcttgcaccgatccgtggggaagatctgctagcgccctccgccgcttgtatatgtggacgttgtgacacgactgatggttgcttgcatttcggtgacaggctcaagaaataaagaacatgaagttgctatctttgtctcggcgaagttactgctctctccgttttatattataagctgttttgatttttttcgtagttaaattttttaaaagtttgatcaagtttatagaaaaatatagcaatatttttatataaaataaacacattatcaaaatatattcgatgttacattttatgaaattaatttgatgttataggtgttactgggtttttctataaatttgattaaaccgcaagaaatttgataaagaaaaaagaataagaaagacttaattatgatatgaaacatagggagtatttctttgtggtcagttatggccattgaaaatttcaagattaaattttttccctaattaaatccatatcaatcatcactagcttgttcttcagatttcaggctcagttaattttaaggagaaaacacgccaatcaacagagcataagatttagggtcattaaaataaatactccatattaggcattattggtagagacctaactgttgtatgagttgtttagatggttggctcttgatgatgtggaaattaggcttagtactttgtgatgggcatgctcttatggttatccataagttaattagcataaagatatagttggtgcaatccttcttgtcagtgctttttctatcactttaagaggttctgaagctagccgaaccaccaaatattaagaggcaccacttatgtatctcctctcctccttgtccggccgcctttcactatacccaacacccagtgaaaaatatccaaaatagcaattaggagatatacaagtgatataaggagaaagagctagctactctatcactccatgcacataccttgtctcaagcttgagttcagatacactactcgacgtatagtaattgtttcatcccaatatcgttcgatataggaatggtaagcatcagaaatccagctgttagcccagctagaaaacagaggagaacccctcttcgtatggcacccgtaatggttttatgtctcgctcagcgagggccctaagcagagtgttacgagggactggagtagcagcggtcgcagggtgtgactataatcgatcgaattgctgatcctcctgcatcgaggacaaggtgacaatagtggaccgtcctccaacgccttgatttcatttggggccttgggg

SEQ ID NO: 31290 - DNA, 6995 bp, Oryza sativa
  unsure (1)..(6995): unsure at all n locations
nnnnnnnnnnnnnnnnnnnnnnnnnnnnnnnnnnnnnnnnnnnnnnnnnnnnncgttcgatataggaatggtaagcatcagaaatccagctgttagcccagctagaaaacagtggagaacccctcttcgtatggcacccgtaatggttttatgtctcgctcagcgagggccctaagcagagtgttacgagggactggagtagcagcggtcgcagggtgtgactataatcgatcgaattgctgatcctcctgcatcgaggacaaggtgacaatagtggaccgtcctccaacgccttgatttcatttggggccttgggggctctccgctcaagatgatcataaccggcgcatacgtttgtctagtagagcaggcacaaaaataccacgtctgattctttggtgtgttgaaagaaagagagggtaagagcaggtataataaacggtttaagcaggcgatagcgcatccaacctggccaaagtgatgagctggatggaaaaaaccaggagagtgggtggtagcggacgactatatcgccgactacacacaaactccaagaagaaagaaactatagaaaaagcttatcccatagttccatgtgggtctatgtgaggcaatgcgtgggtacggattaggcgtaaaaaaataataatcaatttattggtgcttgtgcgtataaccaacagctgtacatacacccatcttctagttatctctatcgctgatgtggtgttttttaccgccggcagtcgcctgtttaattaaacctgctctaagagagagaaggaatgcgggcgacaaaataagcgctagctgcagcacattcctccacacctggtgagccccatttcatgttcagttcttaatttgtgattggtgaaaccatgttagcctgcgcacaagacaggagggcaaagagaaaaggtaggagggagagaggagggtaggacccactgtatagtcaagtgtatagtgaagagattagagatatctattgtagaaattatctctaaaactatctatagatgacatgtataaaattatagcttgtaactaattgtactattaaacttgctcgtagtacgccataaaccaaaaattgtaactcgagactcccgtagtcccgtatgtgtctagcttttcagcaaaattattgattagtgagttctaacatgtgcaaacctgcagcaagttcaggttgtgtttagatacagaggtgtaaagttttggcgtgtcatatcggatatacggacacacatttaaggtattaaatgtagtctaataacaaaataaattacagaatccgcatgtaaaccacgagacgaatttattaagtctaattaatccgtcattagtaaatatttattgtagcaccatattgtcaaattatgacgcaattaggtttaaaagattcgtctcgtaatttacatgcaatctgtgtaattagttattttttcgtcaaactattgatcgacggcttgtgatgtgttttttcctttgtccaaaagcttctatttttttagtaaaaaaaaaagcttctcttttttaccaatactggcatacataaattctcttgcaaacttgttacgaacactgacatggagccacatcgtggctgtgtcttaatttttcattaaatcaaaatcttgatatttttgttcgtatgagcactgctctgcagtagccagtcaatcaatgctatgttattattcatattattggattttcaatcagccgatagcgttgtcctgcagtatgctagttttgcatctgtgatttgaagtcgtgcacccacttctcatagctctactgatagtagaattaatttggaatcttcgatctcatgtgaacaattttgtgagatgtgtgattgttgttcctaccgcgcaagtttttctatggaaaaagtacgaattacctcccgaactatcgcggtcgttcgaattatcccctgaaatacaaaaccggacatccttcaccaccaactatacaaaccggacgaattacccccctcgactcaatccgcggtggttttgatcctacgtggcagtccagtcagcaatttatttataaaaaaaataggtgatcccacctgtaagtttcttactctttttctctcccaatctctcactctctctctctctcttcagctgggcgagggaagggcgccgaggcgaggctgcggcggcgaggcgaggcggccgccgcagcacaggcagaggaggcttcatcggctaggtaaggcgaggcgaggtgaccgcggcgcaggaggctgtggcagcggaggaggcgagcactggcggaggaggctgcggcggtgaggtgaggcgaggggaggctgcggcggcagaggaggctgcggcggcgaagtgaggccaggagagccggccgcagcagaggagtctccggccttggaggggagacgagcacttcggcggctagggcggagtaggctaggtggaggactccgactccaccgcgctcttccgccgcccccttgcctcctccgtcgccgcgctcgcctccttcgagacgcgacggcggcatcacgcgggcacactggcgcggggtgacggcgacagacggcgcgcgagcggggctcgaggcgacggcgacgacggacgacggcgcgcggcgcaggcggggctcgaggggagatggcgacggcgcgcggcgcgagtgatggcgatggcgaccgcccctcctcgagttccttcgcgggatcgacgagccgccgagcaagctcgagctcctgcacgcgggatatacgagccaccgntgcgtnctccccgcgcttcgccaccgnccgcacaccgtcgncaccacgttcttccccaccggcgncgacccgtttgagagagagaggaagagtgagagagagaagagagaatgaggagatgacaggtgggtcccacattttttttttataatagagtggtgactggactgccacgcgtacgctacgtagaccaaaaccaccgtagattgggtcgaggagggtaattcatccggtttgcatagttgggggtaaaggatgttcggttttatggtttagaggggtaattcggacgaccataatagttcgaggggtaattcgtcttttttttctttttctatctgctccacattactcctttgcttgtctttaacctctcttaaattgaaacctactccacttgattttgcgaaacaaaaaaggcaagatatttgcctcactagtcctctttctcacctacttcaacttcaaagtcatcagcagctatccatctgcctcttcttcctacacatacacctagttctgcatcttttctaaacggaaaccatttctgcatccttggtacaatcttgagccgaaataatcttcagttctcacagaccacacgagctggattgaggttgggaggcaccgagaatgcacctatcagctaagcacatcatgggagcgcttacttctaatctgtccccataggccatgccaatccaaacacaccaggcataagtccttccttcgcatcaactagtgttccttgagatggggacatgccatgctactaaaccagtagcatcttcctgcttggatcgaccgttgcagtttctggcgatggatgttgttgtgttcgaagcgagacaagctgggggtactgtacgcgttgttgctctttgctagggtgtttgacaacgatggaatgatttctatgccttgcctcgtagctttcggcatgtggtgttgggaactaatttcatactcacgtaaaacggagtagttaattttaaatatgattttctaaaacaactttcgtatagaattttttttagaaaacgtatagtttagtactcaaacatatagattagtacatttgggaagcgtacagaaagaaaacgagcgagcttgagtttggaagatagagcaaagaacagggatccttaacctccgccttcgttctcaagatatggataatgtctagaggtttataacgagtacgtctatgctcaagtaatgttgttgcagttgaactcgtaaaaacaagatcgagttgccgtgtaactagatatgagagaatctcatatgccactgaaaattgtcctaatttcttatatgccattggtctaaatttctacaccctcttatatcactcctatatgttgactgtgtattgaccgttaactcctaagtaaaaaagacatatttgttcttctgagtatatgaagctggaaatgcatagtcacaactctctaggaactctatagtccacaaaatcacatatcggtccatattctgtaacattgatttttttttcataagcagtaagctccgccaccaccatccacaacagcaagagcactagcaagctctggcacaaacgtaattcgatcatcaatggcttggaatcaactcctcttacagagttacgggtagtggcgcgagtccctaactggtggggccacccttacggtcccacatgtcggaggcacatgtccctacgatacgccaaaggtgcctaatcacaatggcatacatgatattatatgaattaaaaacaagagcagtaatacacaaactatagacaaagtcccacatgtcgaagtatgtttgtcatgttctctcaacaacttgaaatcagttttctagggaacactttgttgtaaatatatactccatattttaatagagatgaataaaaatcgatgctcccatttgaggctcaaaaaataatcatcatgtgccaattttcggagcaatttttaccgtccaaattccaaaaaataaattaataataataataaagaacaccttgatgcagagttctcacttctcagccgagagagcagagcaaagcaaccaacggtcaagaactccaaatccccaaaccgcatacacgtggtccatacaccggaacaatccccgccgtccatccctcctacggacggcgagatgctgctctcggtccacggatcacgccgtgcaccggccatttcaaaacgcgataagaatccccccgcccacgcgccgcctttcctggtctccccccctcccgttagttagagcccatagccatagccatagccacctccaagctccaaaccctagggatctattccaccatagttaggtgattctatcgtaggggagttagtagtcgccgcggggcccggatcggaaggaatcggagaagagccgagcaaatcgtaggttgttttcgcgttttttttttttttggttgggtggggtggtgtttgttttcttgggtttctttgggcgattattttcttttcctgatgcgttgtggtgtgattctgatcttttgcagatctgcgggaggggataggattcgcgtgcggggggttgcagcggcaggaatctgaaggtgagatggctgaattttgggagatttggttggtttttttgtggggattcgttggttcgtgttcgtttcccccaaacccttctgtgttttttttctgggtcatttagttgcaaatcgatggggattagaggatttcaggacgaatctgagttgaaaaaaccggagcttagatgttttctggtgtttcttgggggcaatttcttgtcttggtggtttttttttctttttacttggaagaggcaggagccaaatctgagccgcgcagaatttgtgcgaaaaatcttcattccattagttgctcatgagttcttctcgcagatctccaggatgcctgaagtgagaaattccggcggtagggcggcgctcgccgacccctcgggtggtgggttctttatcaggaggacgacgtccccgccgggagccgtggcggtcaagccgctggctcggcgggccctgccgccgacgagcaacaaggagaacgtgccgccgtcctgggctgtgaccgtgagggctacacccaagaggaggagccccctgcccgagtggtacccgaggagcccactccgcgacatcacgtcagtcgtcaaggtgatgaaccattcccgtaggctgtgtggtgggttgaatgtgctctgaatcctgtgaaattggtgtggtcgttttttgtgtgctgatatcatgtgtaggacttcaggtttttattattttgatgcatggtgtgttcttgaggatttgtgtcagttatcatgtttaggtagggtataattggtgaatggtatgttcttgaagatatgatagtgctaagattggtgtgctcgtgattctggaattgtggtggtcttgtgttcgaggttgaattctttacagatagtgaatatcactagcaagagtagcagtctaggaaattaaggtgtccttcgactactactgatgataaatatgcatttctttctgcttatcgcaacaaagtccctgaattttgttagtaagcatttcaatcactaaaatgaggaacacaattgcttgatactataatcaattagtacctttttatacttgcaaaatcatatcagactataaatgaattagcaatgagggacttcaccaaccgatgcttcttcgctcttttttgtatcttcttcgatctgtctatcttattttaggtgatcagtaattagatgacatactatgcaaaatttcagggaagttcagtgaaataacaggcttaaactttgaatgctcttctgatgtgagtaatcaactatgacatgtctaatttgttgtacttgtttggttgtacacacttggggaattcggtctgttataacatgaatcatcataattcatgacaaatttgcattatatgtcgtgtagcccactccatgatatcacatcagtcgtcaaggtgatgaacagttcccatgggctttgtggtggatgttctctgaatcctgtaaaattgtgtggtcattttgtgctaatatcatgttttaatactttaggtttttatgcatggtatgttcttgaggatttgtgtcaatatattgttgtgttcaggttaggttatatttgatgcatgatatgttcacggtgatatggtaatgctaaatgttgtgcacatgattctgaaat

SEQ ID NO: 31291 - DNA, 4722 bp, Oryza sativa
atgaacagttcccatgggctttgtggtggatgttctctgaatcctgtaaaattgtgtggtcattttgtgctaatatcatgttttaatactttaggtttttatgcatggtatgttcttgaggatttgtgtcaatatattgttgtgttcaggttaggttatatttgatgcatgatatgttcacggtgatatggtaatgctaaatgttgtgcacatgattctgaaattgtgattaggcttgagttgaggatgtcttggttacctattgtgaatattactagcaatagttgcagtctagcaaattaagtgtcttctggctactgctggttataattgggcatcttttctgtcactgcaacaaaatcgctgaattttgttagtaagaagcaacgagggactttcttctgaacaaatggtgttttttttgtttttttctttatctgttttgatatgcctatccgtcattttaagtgaccagtaatcagataaaatactgattaattttctgagaagttcagtgaaataacaggcttaaaacatgtaaatgtgccattcatccatttcatgtctgttgcatttcttaatgatcttctgatcatgtgaggaatcaactatgatatgtgtgattcgttggacttgttggttgtacactttatggactaaaactaaagagccaccaatttgggggattgggtctgttttatcatgaatcataattcatggctgctttgcattatagaggtaggtgcattttttagttatatacatttttttcaatggtgtgcaccgaaggtaatagaggatgaggaaatacctcaatgttggaatttgtgctatatagaaccttggcaacagcctaacttgcttgccttgccagtagtcatatcttttgagattcacttaacctgaaaaaattgaactaaatgtattcatcaagctgtagtttaccgggtgcgatttcagtttggctttgctacagtgctttcttctgttcttctcctgttaaattttactcagtgttcgatagtttaacagatactttcctgttaaactttaaggataactttttgaagtactttgattggtacatattcagtacttcggcttgttgtgtatatagctgcttaaatacaaaacagctcctttttggccttgatgaaattcttgctagctgatatattagtccttatcttcatagcaaaaataagtgtattttccgcagtgtcaaacaaccagagttatatatctcattttattataataccagttaatccagatttcacattttgcttcaatgctgtcgttgggggaaagagaaaaggggttttgttgttcattttgttgtacatagttctctgtcatttttatagttattcatgcctttttttccctgtagttgtatttatgctcatatgttgaacatatgcttgtgcagtactgagtcgtagcaggataacaatgctgatacatccttcaagttaatggatataatcacgcatccatgacaatatgcttataattttacctaccatttgcaggcagttgagaggaaaagtcccctcggaaatgctgcggttcggcagcagatccagttgagtgaagattcttcacgatctgtggatccagcaactccagtacaaaaagaagaaggtgtccctcaaagcacaccaacaccaccaactcaaaaggccctggatgctgctgccccttgtcctggctcaacccaagctgttgcaagcacatcaacagcttacttggccgagggcaagccgaaggcatcatcttcttctccatctgactgctcctttcagacaccatccagaccaaatgatccagctcttgctgatctcatggagaaggaactgtccagctccatagagcagatagagaagatggtaaggaagaacctcaagagagctccgaaggctgctcagccttccaaggtgaccatccagaagcgcaccctgttgtccatgagatgagatgagatgagatgagctgatcacactgtccagaggagagagtgaggcctgctcaggcctgcaactgcgaggttttcccacttgtctgctgctttcttagccgctagtcctagccaaaccctttgcatcagctgctcttcttccatccctgctgtgatcctgggcttgttgaggcatggtgctcagttttgtgtaccattgagggggatctctgcttgaggaccctgggatatgggggggtagcctagctctcttcttgagggcatagataggattagctgttgataataccattcgtcgtactggtacatgcttactgcagcagaccttcaactgtgtatagcttctgtatatttttactgcacgctccattgagacatcgacaactgttagtagctaacaagacaagattttctgtgactctgttattgtattaactacagtatggcacttctgtcgtagaacataacttctctttggtgtgaacattgtgactcgtcgcataacgtcctgatttacttgattatacagtattgagcagtagaaatcatcagaactttgcacgttgttggtgatttcccaatggaaattatactgctttactagaaaatcatagaggcctatctcagttttgcatgcttccaagctggtagcaagattcagtctttaagattgtcttggtgatcaactgtcatttttccctttttttggttgaaaaggtacgacgatctaaataaagatggggattttatttgggagaaaaggcggcattgaaatatttttttccgtaaccccaattttctgtttcaaccaatgatttttcattgaaatatatctcactcgaaacgatttttcttagctatcactcgatttttttttaccgtatgatacacgctgagatgtgtgctaggtctgttatttattgcgtcatggcatggcaagcatgggtatatttagcacagctccaattccaggaatcaacaattccaatggaaaagatgatcaaaatgactcgaacacctcaatatatgattttaattcaggtaggaggaacaccagtctgatttatctaagttgaaacaagcatacactgatcgtatcagttttttccatatgttaaataagcaaacacaaaagatactgaaaatgaacaaacacaaaagaagtggtctaatgtgcacatgggaatcacttcttccttctcagcctcctggatggcaggcttctcgtttctcagcatttccacctgttcagcttcatacaccttcctagcttgcctcctctatcaaggaccccaatgtcctttgcttctcaatcctctgtgttccctagttggagttgggaacatttccaacgatttggcatgattaattaagtattttctatagatttttttttgcaaaaaaacacatcgtttagcaatttaggaagcgtgcgcgcgaaaaaatgagagaaagcagactaaagaacacagccacatgcaaacaccatttctttgtagaattctagattctcgaagaagtgccctgaaggatccgatcttcatatttatgtgcatcagcttttataactcctctgttgaaaacatctgaaacaaacatgctttgacccattgctgatttgcactttcggaaggggaaaagaaaatttggggcacccatattctgaattttgggaggtttcaggatttttatcacgattgttgaacgaaattttcaaacaatatttaaatctgggcaaaaaaaaaagggaaattttgtccagatttagcagcagatcacatcatcctttttgctagacaagagaagggaagagcaaccgaagcagaaaatagtgactggcagttgctgttagctaacactacgatgatttcaagcaactttctcatgctctctaataaaagaggaattattcgcatgggcgaacaaaaacaaggcgaatactttttgaaggcggaggccacctggacactggcggtgctacaagatgcacctgatagtgtagtgacaagtggtctataatttcaaccctaaagtctcatgttcaattgacacactcataatttttctttaaaaaagtatttagaggggtgtctctccctccaaatctcgtttttcccttttcaccagcggtgagccggtgataccatgcgcccggccgcgcaagagacggttgccgccgtgccggtgccggcgccagagacgaccgcatgcagcgtgtgctctccacacgattacactggcgctccatgtcaggcctccacggagaagggcgcacgctgcggcagaaactgatgcagggaaggagccgctcgcttctgatcagagcacggaaacggaagcctgcgcactatactgactgatgcctgctcggctcaacctgtcgaaatctctgtgccatctctgccgcctccggtgagagctgtccagggcctcctggctcggtgagcatgcatcccccacaccgccttctttgctgaccgccaccccaacggcgccgccggccaggagcccaggacaaccacggtctggatcagcagcggcatcaaccgcacaggatacatgttggcactaggttatgtataatctagtaccagtatgttatattttggaacggatgaagcagttcattatacagtattacatccaggagatacaccgacattgcgagaaactgggaaacacaacttatgtacgatctacagagatagggagttcagggaaccggggaaatcatgtacagg

SEQ ID NO: 31292 - DNA, 3182 bp, Oryza sativa
  unsure (1)..(3182): unsure at all n locations
ggttgcaacacagaaatctgtcgcccatcttggaggcaatgcactggcagaagatcgaatcatgtaacgccaagagatttagttctttttgaccggtcgatcaggttgggagcctctgtggtgggaccaatagattgtgctcccatgcggctgatcattctccgatgcaggacggcccacgagctaatgtagagcactgtgactgcatttggagatattgtcttggaggcaaatcaagattgttccatgacaccgctactccgagtttttgatagactcttgcttttgcgataacacgagcaaagatgaaaactgaagaggataacaagaagttaacttttgccaacagactcagatctgcaactgatgcgtaatgcatatagctttcccaattatacgccgagatggaggtcattctagtaactgaagatggaagggaactaacctgagtaccggcaagtatagtatgacagaagggatgtgctgcacaggaaacaactctctgagatgaaggaataaacttgtttgctgcaggtttcttttcatcggagcctcttatttcctcactgaaacatggaatgccaagtgagaataaagaccaaagaagattgttgacaaaatgtatgattgtgtaaattaagaagaaaaggaaagcaaatatcagctcacttgtagtcgacatggcatgctgaacttgtatctggatgaaaatccagtagatgcatgccaacagtattggaggcagatccaactgcataaatctggataatgtaaagtgtatgttatgcatctagctccaatgtatttcaatgccagatgagatatttattattatgactacagtgataaatgaaagtgccttattcagcattattgaaatccttttcaccttgcaacaagatatgcaggtttcaaatttaataaaaagaattgcatgtgatctataatattcttactgaagatgtcggcaaccaggtcggttttctatgtagcttttgccacatgaagttcatgtgctccctagtaaaacaaacagaagagaacaacaaaacaataggtccaattagcaaaggttactttgactaagaagatttgtgaaggcagaagtaatctacttacaaccaatcaggaggagggcagtgcaggtgactcacactgagggtgttaatgttcaaggctccagacctaacatgcatatggaaaagattgtcactgagatctagaccatagcacagaacacttaaacaagtagaagagtaattaaatatgtcacccgaaaggatggtggatggaaaattccaataagtcaacaaagtaaccttgctttacagtcagataattaataacagtgcaacacactacttaccagccattgtcaagatggaaggctaactgatatgagcaactagggttgaagtctattgaaagaatttcactcgacacaatgttcgtttggtcctgaagacagtgatcaaatatgttaaaagaaaataatatatatagtagcaaggaaacccccattagatgatataccatctatctcacatttaatgaaggtgccaattggaggatgagttataatagcttcaaacaagcccgtaaaaccatgcccttcatttcattacttgagatgtgtcattttgttgttttcccccatactaattttaatcccaatggcaagaaatgaacttattttaggacaacagaagtatgtccagggtttaggtacttcctgatatggcaaaaactaagcaaactgccagttcgcagcaagaatacataatctgactggtttaaagcactaaataaatccccagtgacctcccttttcagctagatgtgcataatgactgttaggtttgttccaaatatcaagatttcaaaattttcaaaagaaaaaacttgacccaagagaattgacaagttaacatacatatagttttttttttctggtaaacagttttcagaagagtaaacaagctcaagagggatatatcattgccgtttggcgttctatattctactgagttaccgcaagtcaatatcatcaaacttaatagttgcatgcaaaacaatagctagcattaattctaaatttgggtatttaataagtactctatatgaatttgataattcacatctcaccgatactgtgactacatgaaacatctaaatgctcacaagaatggaaacttgcaaaaggagaaattaatttccttatgcgcaatcataagtttgtttttgtttttcatacctttagcgatggaattttgcccaacaaagttgatatcttcactgatgataattgttgaacctagacccaaaagaaaaaatcatgaacagaagtttgctattctgaatatatgatcataaaaattatcaaaatgaagatcaagtaggatggtgcgataccgcataaaaatgaggaagagctagcagagtacctcattatggctttgaaaagcagctgatgccctccctccacggagatcccaggcatgaacggtgccctctttaggtgcagcaaacacgggctaaaaaataaactgtcagcctccatctatgaatggcccaaactttaacacaaataaccaaacttctttttacatctctaaaattctgtaacactaagttcaatttacaagccaagttggaaactcagaatcttaaacagagataggtcgatatgagaacataattcagaaagctaaagaggcaaagagcttgacactgctaaattagcgtacccggttatctatatttagcttgacactgctaaattgagattctggatgtcctatgagctcaagacagtgttttttacttagccgcatgtcccacatgaagaccgctccatcaaggccagatgcaaataacctaaggaaggagcacaaataagcatagcatattagtaacaacattgtttcatttaaaaaacaagaagagggacgctgttggcaatctctgtagtagcttgcttttacaaaccaacaaccaccataagcagaatccagtcaatccacataccctggctataatcctattttctatattaacataccccatgcccacccaaacaacaaaagaaatatcattgcaatgtgcaaaatttgtagaattcctgggtttnnnnnnnnnnnnnnnnnnnnnnnnnnnnnnnnnnnnnnnnnnnnnnnnnnnnn

SEQ ID NO: 31293 - DNA, 7232 bp, Oryza sativa
  unsure (1)..(7232): unsure at all n locations
tgtgtactagagcatcaaatctcaattatttatggttcacagaaacacggaaaatttcagtcgtcgttgatctgatctgatctccatgtgaaactcaagactcgtagctgacgacctcgacgcgacgagaagccaaaatcgcagtcggttttgacagcgacaccaacagaaacttccaagtctgaaacgtagtgactgtaccacagtacagttcagtactactcctaatactgcaacttttcttgcaagcgtagaaggcaagaactatacgtgtgatggtactctccgaaatgccaaaatgtcaagcacgttgccatcgcccaagcactgacctcccaccacgtactacagccacaattaagcgaattaagcatacgtacgcccaattccctgctcgatagggcaacagatttaacgcaaagatagagcgtcacatccggcatcatatcggcactcactcttgtagtgtacttctccaatcaaattttccaggaaaaaaatatttccttgatattctttttaacccaaatcctatcaaaagccatacctagctagctagtagtactgtttggcagaattatttgggcagatgtggtggtgtaacgaggaaggaaggataattaagggcataacaacaaggtggtttgtcgaattgtttgattagtcatgagtgatttgattggctcaccaacaaacacgtaccagtgggagtagggcatgcataatcatcggtggataacctcgagccatggccaccagctaccagacgagaaatcaaaccctgtttgtttctaggtagaggtagcggcatggacagttgagtcctccaggcctacacgcacagttgagtttccagtcaaaaagctacagcccagacaagcagaggcaaccatgcaacaaaccaatcatcaggcaatctgcaaaaaaaaaacctgcctgataattgagggtttcaggtcgtgtttcatgtcagcatccgaaatcctcaaagcaaaaaaagaaacaggggagaactgcattatctgattttagcataaactatgatggaatcgaattattcggttggaagaaaataatatgcatcgaattctggtgaccaaattattctactactagtggattagcgtagcagctggagctagcacggaaatggacatgagcttggcatcaccagctagccaatcatactttcagtatgctagtatacaaaatccacctttctttaatatttttgcaaattttttcttctccttttttagtgcatggtggtgttcacacttggcagaggccaaaaccgcagcatctgcaactcgccatgcgcagcaacagtggcccaaaatctcgacattgacttctaccacagatccactgagcgcatcccgaggaaaaaagcacatgcgatagcagtagtaacagcatgcaacagcagctccgccactactattactgcgaccgctaataataacaagcggtgcaggagtaaaactactcacaatttactactactcctactcccgtgggatcagttaccgcactgtgcactcgcaatagtataaactgcataggccattctatgcttgggctactcgccgccgttgtcactgcatcgatcacttgctacactagtgacctactacagtgtatgcatatgcatgacactagtgtgacagtgtgaagcaagaagggtcgtctttttctggccaagagagagagagagagacccatgttttgcaattaacatatgtacaatgacacactatggggatagctgtgggtgccaaaacctcaaaagaatgagaaaactacagcaggcagtgagtgaggtgcagtgcagtgcagtgcaactcatgtcatgtgggcaccatatgcgtatgatgcgtgcagcagccttccttttcagcgagaaaggcacgccgcagcagcagcagcagcagccaaccccacaagagagcaagttatttaagaacctgagttagatagactgatagatacatgcaatgcagccaaagcggagcaaaaaaggggcagaggggacgagaaaaaagagcagaggtagaacaagaaggaagggagagtgtgccctacgtgagaaaccganacaaaggtnnngccccnnccaccnnncccnnnnnnnccaccgcgcgncatggnnnnnnnncnnnnaagnnnngnnnnggngtnntacacgaggcagacgatcactgtctccttctaaagaaagannnannanattntttttnnnnntcctnnnnnntanncccatacaaaacacgccttaatccttaaccaccacccctcccctcccgttaacaaaaagctaaaacgcgcaacagcgacgcacacgcaaaagcccagaggcaagtagcagcagcagtggttgcgcggtgctgcgttcgtctcggtctccgtctccgtcgtctccgtccactggacagggcagaggctgcctaccagacacacgccctcaacctcgcgcccgccattattgcgaccctcccgcacgcgtgcgcgcgcgcgtattatcacgaggtccgcgagcgaggcgcagagcagagagcagaagcatcatttctagtcccccagcccaagcaacagtagccagcaagaacagagtagggaggaggaggaggaaggaggacgcacctgggagcagagccagagccagagccagagccatggagcagtacgaggtggtggagcagatcggccggggcgcctacggctccgcatacctcgtcgtccacaagggcgagcgcaagaggttctcctccttcctctgctcccctttcctcttcttccttcgtcttcttcaggcttccctgatgcttctgttctttcttggctcgatgatggtgcaggtacgtgatgaagaagatccggctgtccaagcagaacgacaagttccagcgcacggcgtaccaggaggtaaaccagatcgaaaccctcgttagttcttgttcattccccacacttgagcaaacatgttgcacccatgagttgtttgctgttgcgtctgcaaaacccttttgagattaccagaaattactgcgcgatggattaaagaaaatagcttttttttttcttttcgagttcatacctgattgaatgtttgggaggacgggacagatggtttggtttgatgatttgattttgatgctttgcttgctgtttgctgcacagatgtccctgatggcgagcctcagcaacccgtacatcgtcgagtacaaggacggttgggttgatgaagtacaaattccacgcattaattcagttctgggagtaatttgcattccttcgaatcaagggttctaaagttttgtccttttttctcttcttcgatgatggttgcaggggacctcggcatgcattgtgacaagttactgtgaaggaggtgacatgtaagaacctctcacatttttcactcttcactgcctcctaaaatttttaccttccattggtgctccaacctccaaagtcactgacatcggaatcacagggcagagaggatcaagaaggcaaggggtgtccttttctctgaagaggtaagaacaccgtaagtagatgaaatggtgattttaccacctatatcaatgagcagtacaaactgttcatggattggaaacttaccgctgatttggtacttgtatgatcaaagagggtgtgccgatggttcacacaattgctcttggcccttgactatctgcactgcaaccgtgtgctccaccgtgacctcaaggtaaatgaacattgtccctatccacacaagtcgattcatcaggtatcagcatcacctaacatgcccttggctcctgtgctgttacagtgttccaacattttgttaacaaaggataataacatccgtcttggtaagaaatatatatttcaccataaatataaattactgcatctttcctttttcttggatgatagtgtagtgacctgaatattcattgtttcttgaaaacagctgattttgggctagcaaaattgctcatggaggaccttgcatcgacggtatggcttaaacctgtgctatcatgttgtgtaaatataactcgcaaaacacatttccaggtagcaaagaatacataactatgcagttacctacataaagtcacactaaatcataacatgtataaacaccattcatgtaaacccttttgattttgaatagtggttcataactaaattctttatggcttatgatcttcaatcgtactagcagaatgcccgtactttgttacggaattcaaaagaaaaattgtatggtattacatattcatgtgggaaaaattaatgtctgcatcacgaaatacaatagctttgaactttgatttttaactgtatataatttttttttcacttgtcttattaataatcatgaaaagagattgaacaacaaaaattggcaaaaaaaaatatgccccttaattttattctaaaattaaatatgtaagtacccacttctctctttagttgaaaaaaaagatgcttttatgctcccttctactttgaccttgagtacatatgaaggcccgctcgtcattgatggccaccaccattgccttcttttatgatggtatagataatggaattttgttctagaaatatgtgatgccatttcagtatagttccggcagtgttatttcatttgtatatatttatttatagaattatatatgaacagtaggacactttcctaccttcttcattcaaaatattgtgacatgtgaatgaactgataggttccattgccactcaatgaattcaacatctatgtttttcagattgtgggaaccccaaactacatgtgcccagaaatactagcagacataccttatggttacaaatctgatatatggtcacttggtgagttcccagtacaacagcttttggagtaattttcacggtttctgttatgatgctaatcctttcccatcttttaccatcaggatgctgtatgtttgagatcttagcacaccgccctgcattcaaagctgcagtaagtcctactacacaattcaaacgataaattactgtttacgtataacatggttcatgaaatatcccctcttgttttttaaggacatggcatcattaattaacaaaataaacagatcttcaatatctccaatgccaccgatatattcatcatcactgtgagtgccaatattattaactttttaatgattttcccataatatatatcagaatttatgctaaacatgatgctttgtttggcaggaagcagatagtgaagagcatgctaaggaaaaacccagaacatagacccactgtaagtaccacaaactcagtttcactgtttcaatcaaaggcaccgacagaacacttcacattcaaagttaaactgaaaaatttacaggctggagaactattgaggcacccatatttgcagccttatctagctgaatcatgcagctgctccccaatctaccttccagtgaagccaaccaaaagtaccttggagacaagcagcagtcaagaaaaccaggcagtggcagaaagcgaatcatcaaaaccaatggatccagtgaagcattagaaaccgctgcagagcaagctgtggatacaagagacaactccacatatatttcagatgtttcaacagttggtacccaggacgcctgcatttcacaagtatctgtggatcctcaagctagaaacaaagcatatcaaaacatcgatgatttgacgctttttcaacagatagaggaaaatttgatgacaataaccgatcgacagattgatgaggccatctttcttaaagctgtaagaaccagcagcacagtagatgtcgtgccagtctctggtgcaattcagaagcctaatgaggcaccaataccaaaggaggaactgaccattggagtagtgcaagagcagagaaaggaagtgaaagcacacactcaccaaggatcaaaaccaggcacaggagacgttcccatcgttacagaagaatcatcaccgaagagcgcggtgaaattggcacattcagatagcactcctgccgagtgggaccatctgaacatagtgcagcagagagctgacgcactggagtcgctactcgagctttgcgccaagctgctgaagcaggagaggcttgaggagcttgctggcgttctcagaccgtttggggaaggtgctgtgtcgtccagagagacggcgatatggctgacaaaaagcctcatgaccccaccaaaattggaagggtcaccaaaacttacgtaggggagcgaatttcatggctttgtttgcaagtgtgctgttctggttctgagagtgtatatagctttgctacagttcatgattctgtatcactgaggctcgagtttctatttatcttgatgtatatggtttgagtgagcgagggcattgtgtgagctaactatttatcagatatttactgtacaatggcatgtgctgtttggctgattcaagtaataatggaaatcataccatgttcattcctattttcttccagccttccttactggagaactgtttatcaatgtgcagatttgttattaccgacaggaactgaatgggaagaggcaatattaaggggatgttcagattgtagccaaaataaaatgctggcaatattaccaaaattttggcaggatttcttatgtatttaccatagtttgattaaaaaaactaaatgtatgcatatctttgacaactttaccaaaaattgtatggtttgaaatggcatcaatctgaacagcccctcagttcaagcatactatatccgggaacaattttttgactaatcacttggttccgatgattctagaaacaaaacgatcactccatcctgatcaagaaataggagcaaaaatatagcctagtagtgagtagtgagcactgagcaatacttgatgatgacagaacagagaatatgtaacactacacagcactggaaaggctgacctgtactgctgtagccctctgctcactgaatgattttgtcaccttatgtttgggcattgttaccactgtcaaaggaagaacctttgccgtgcttccaagcaagaagccttgcgctttctgcagaactcaatctgctacaaatcaacaagatatggttgtttcttttctgcgagaatcatgctctgcgcactttcagttcctggggctctggcttataccctgctactgtacggtgtaccatgtccaggaattgatccctgaacactcactggaaaagaagg

SEQ ID NO: 31294 - DNA, 3185 bp, Oryza sativa
ggaattgatccctgaacactcactggaaaaaaaggtgtggaaaacagcagatagaacatgcatcactgtaacacacagtacatggcaggattcagtcagcctaaccgtagacagttgctgaattgtaaggatccgtctccagtattattgccgaattgggttatttgagagctaagttctcaatttaaaaatgatgcatatatttggttggatatagaggccgggtaaaaattacccttatctaaaaaaaagtattattccagatgccaacaatgatgaaatttaacacatagtataacaagaaggaccatgtgttgtccactttggcacgtcagatctttatatgaaaatctggtgtgtaaattatactagtttgaagtgtaagcccgatagcccatgtaccacaaacagtcagtagagactagagaggcattcactacatatgaacgatggatacgtgcttggtgaagaaagaagtacatgatgcgaaatcagtacaaaccttcctgattcgatgatagtcaagagatcctaaaccagacatttctcctcacgatcgaacattgttgtagtgacttcctctgaaacaaaaaaaaaaacatcagaaagttcatctccctaatttgcaattagttaccaatactgcaaggaacagaaagcaaacgatgttcttgcatcaaggtagcacgatgcagtatcgtccttttcctattcggcgaggacgcgcgcgttcgatgaaccaaagggatcgagctcccccaaggaagtgtatttgcggatgcaatggtccaaattccgcccacgcgcaagtaggcgcatggatctctagaatctccgatagggttggaaagtgggaagcgatatcgtcggtggcgcttacctcggcggcggcggtagtgaggaacaaaaagccgaagcagtcgcggcggcagacgcgcgcggaggtcggtgcgtagtagccgttgcactgcgggagaagaggatctagggtttatggctgggagagagattagagagaggatacggtttgaaggaagacgcagagcaaggaaccacctggagccatttggaggaagaatcccaacttggggggtcgtcggatgcggcgccggcgccggcggtagccacggtgttcggcgaaatgcgcgagcggagtggacgggagcaggaggagagaattgtgcactaagacccctgatttcggttagattttttccttttgttgaatatggtcgctaaagtttcgcttcggactaaatttagtagttgaggttttaaattgttcaacaagttctccaagttaatcatttgggttaatatagtttttgaaaaaaaaacgtttcgtgagtatgccaagtcatcctcacatgcatcggataatacgaatgaaatgataattatacccttatatgccatatagaaaagaaagaagataaatgtttctcacgcgtatgatcgttttagaattgtcacttattattgatgcgtccaagcactgatcgtatcgtatgaattcctttgtcggccaccctccgtaacaatgttgggcctggactagcctgttattttttttttgtctgtgtccttttctttcttttctatatggtatataagatagaatggttatttcattcatactgctgcatgcgaggatgacttggcatgctcacgtggctttttttttatccaaagactatattaacccaaataattaatttggaggatttgtttgagcggaaacaacgaaaactaaattaagcccgaagcgaaactttaaggactgtattggctattcaccctttttttaattaggccccccggttggtggtttgtaatggtcggagtttcctcactagaatttccctctattcgacctatcactatctctactactttaaaaaataaaatatatttccgccctccgtatataaaaaaaagggcgagaaaaaaattctgtcgtaaaaaaaaggaaaaaaaatgtccgactcccctaataaaaaaaagtcagactccggaaaaaaaacttctagtccgttaaaaaaagaaaaaaaagtccaactcaaagtgcgtaaaaaaaacgttcgccccaaattctataaataataaataataaagtgtctatccatatattttctcctctaattaattaaaaaattgattctctattctttccattccagggaaaaactaagggacgctatcccgtcacagcgggacagttaacgaatatatcctactaaggatgtcgtcggccctacgtgatccatctcacattaattcccacgtggctggatctcatcccaggctcccactcagcatggtgtccctattctattagttgcatggtgccttttgaatgatgagaggacacgttgtctagtgagtggtgagaaagaaacaaaagaagtccaattcgtgttaaagtctatgcatctactcttagatactgccacggttctagttaccttggtagtggtgtttcttttatttttttattcttggtttatttcttgatcttttttgtattttcagttgaagcacatttggaggtattgattttgtgaagtattttccctataatatactatgataagttctaatgctcaagtttgacctatctcattccgtgttttctatcccgacacatcttcaatttgtaacccatactatttcgtaatagtaatataagtatcaactcaaatacgtaccatcttaaattccatgggataccaaatttgatacaagttttcgctagctttgaaacctactagctctgaaacctgtgcataccagatttgatacacaaggtatcatgcctgatatttatgggtaccaagtttgatacccaggtaccatacctgatatatatatgcactagccatgatacatgcggatatcagatgacaaatattaggtctaatacttacggataccatgtttgatacctaggtaccaagcctgatacctatatgtatcagatacatataggtattagatgagtttgatacccaggtaccatgcctgatacctacaggcactagccatgatacatgtggatatcagatgacaaatatcaggtctaatacttacggataccaagtttgatacctaggtactaggtttgatgcctataggtactaggcctgatacctatatgtatcatccatgatatatgtggatattag

SEQ ID NO: 31295 - DNA, 1788 bp, Oryza sativa
ccgacaatcttttttcttttttatcccaagtattgcagattcgctctgattttgggaaaaataaaaagaggagatcaagtggatcaaaagactacagtaaattctcaaaggttgagtatatttaatggggatgatcggctctgttatcatacggacacaaaactgtattccagaagttaggagaggcagactgggtgaagtgaggtaggatgcaaagctttttcaatttattcctcaaatcctaatagttattgtattactgacaaaaaaaagcctttacccgttgcaatgcacatgtaagtttccatcatctataaaaaaaaggagaaaaaaatagacccaaaagcgagaaaaaacaccatttataagaaaatcagttcggaaaaatcacttgattcaacacgagaaaaaacatcgattataaaaacaccggtccgagaaaacatccgactcaacacgagataaaaatcgttttatacaaaaaaaaaagataaaaagagtccgaatccacacgagaaaaggtggatcgaaaaaacatctgactccacgtaaggaaaaaaacgtcgtttataaaaaaaccgctctgaaaaactgtctgacccaactcgaaaaaaaccatgcgcatataaaaaaaacccggttcggcactgtgcaatgcaaaaaaaactgtctcattcgaggaaaagaaaacatccgactccatgaaaaataatcatatcgtttatattgttttacgtccatcttgatagctaatatctgttttgtctagagttgaccatccgagacagcgtaagatttgattaatcctattattagttacaagaatgagattgaaatagtatttcacattatatgtgtacaacgacataaataatccaattcttttgggtaaatgaggcataggtaatgttgcctcatcgccgaggttttgctatttacattgaagatgtttcaatttttcttatcatatgtcttagttacaacgatcgatacaaacattatcattgatatggctatacatgtgaaacgtatattgtcattaattttttttttacccgttgcaactcacgggcaattttgctagttaaataccgatgatgatctcgttgtatttgatgatttctgaagagtgactaaagcctgaacctttacaacgagggccaacatgaactgtttacatcactcgttcacactggcatgtctaagggcatgtttgggggagcttcgcaccttctcctataatctttcatgctgctaaaagttctccaaaaagtagaaattaccccctaaagtattgggtgactacaaattaccccctaaacctgaaaataagttatttttcaccctcaactatcgatactggatgaaaaaacaccctgagtagctttgcaagctgttttggtctacgtggcagcccaatcaccaattcttttatttttaaatcagtgggccccacatgtcagtctctcaccctctcttttatccctcacctctctatcactctccaaaatactctctcttctccctccctcaccaaataacctcgaggatggtggcgggcagaactcggggcgacgaagggggcggcggagctcaggacgatggtgatcggagtgggtggtggtgaagagggcgcccacagccaccggcgctcgggacagcgtgtgtagggctccaacccgtttgttagcgcactatccaaccccgcccgcgacgcccccttccccggcggcgatggcgtggtggtggaagcgagctcttcattaacagccagatccgggcaatgtg

SEQ ID NO: 31296 - DNA, 1854 bp, Oryza sativa
  unsure (1)..(1854): unsure at all n locations
gttgccctattgccgaggttgggctattacattgaagatgttccaatttttcttatgatgtcttagttacaacgatcgataccaacattattattgtcatggttatacatgtgaaacgtatattgtcattaaatttttttcacccattgcaatgcacggccaattttgctagttaaacatgatgatctccttgcatttgatgatttctaaagagtgactaaagcctgaacctttacaaccagggccaacatgaactttttctgtcactcttccacactggcgtgtctaagggcatgtttggaggagtttcgcaccttctcctagaatctttcagctgccagaagttctccaaacagtttagaattggaaaaagtacgaattacccccctgaagtattgggtgagtacaaattacccccataaaccagaaaaccagttatttttcaccctcaaccatcgataccggatgaaaaaacccccgagcagctttgcaagctattttggtctacgtggcagcccaatcagcaattcttttctttttaaatcagcgggcccctctcttctacccctcacctctctatctttctccaaaatactctctcttctccctccctcaccaactaacctcgaggacggtggcgggcagaacttgaggcgacaaagggggagggcagagctcggaacgagtggtcagtcaagaagttggggcggcgggcnaaagaggggcgcgggcaaagccaccaggtgctcgggnacaagcgggtaaggtcaaaagtggnngggnggggngggngggatgcgataggggcatgaagagntccancccgtttggnaangnnntgtnaagnnttggcaaggaggcccttttcncngnnnnnnaaggnncggcgggnnagnnnngnnnnnnntnnnngnncagnctcagtccatgtggctnnnggnacacggnnnngcgccttnnnnnnnnnnnnnnannnnggagcatgaggcgggggtggaggacgagcgcggcgaacgcctccctactgcgcatatggctgtctccgccgcaacaccttcatcttcgaccgcgtcgtcgtcgccctcgctgccggtcgtgccgacagtcacgccactctcacctccgtgtccatgccaggcgcgctggccaccctcgccgccggtcgcgccgctctctcatcagtctccatgccgggcgcactcaccgccctcgccgaggtcgcgtcgctctcgcctccgccttcatgccaggcgcgctcaccgaccttttcgacgggtggtttgccagtcacaccgctctcgacttcggctacatgcctcgcgcgctcgccggcctattcggtggtcgggccactctcgtgttccgcttcatgcctggggtgctcgcgcccctccttcatggctagcatgtgcgggagagcgggccggcctgttctgccgcgcggttcacaaggggagggagaagagagaggggggcgaggatttgacaagtaggccctaactttgttaaaaaaaatgtttgttgactggactaccacgtgtgctattcgaaccctaaaccgctctcaacagtaccatgggagggggggggtttgtcctgtatgaaaaattcaagatgaacgatgtctgattttcgaatttagggggggtaattcggtcgactgttatagttcagggggtaattcatactttttcctttaggatttactcagaatttgataatctatagttgtggaatccagaaaataaactaaaagccagaaactggaaaagccaacttttctagattttcacctgctagattctctccggctgcttctcagaatattaaacttcccccaaacatgacctaaat

SEQ ID NO: 31297 - DNA, 5801 bp, Oryza sativa
  unsure (1)..(5801): unsure at all n locations
nnnnnnnnnnnnnnnnnnnnnnnnnnnnnnnnnnnnncgtgaaaaaaaaagataggccttcttaatattacctctaagaatgagactttgattaaccatttgaaattcaaccaccaatctattatagtatttaaacagtcttagaagcatcgcatttattgtgtaggctaaaaatagaaatacaatttaaaaataactaaaattcagaataaaataagaaatattaaaagaataatccatgttgcgaagatgttacggttttttctggctgtgaacttaatacaccatcagcgaagatggcagatcttcactggcggtcgtctattttacaagcggtctacttacacaaccgcttctaaaaataacttttcactacctacacagctgcccggaaaaaaattacttcgcgctataaaaaaaccctctccaccccttatctttatcccttcactcctcaccactcatcccttcctcccatcttctctcgagtgctgcagaggggcacgagtcgcgccgtgggctacggatccgtcctccggaggggcgcggccgatggttccggcggcgggaggcaccttgggcaatgacaacgagtgggtggcgaggctcccggcggctgaccagcggccgaacttgggagccgcagcaggtcgatggcgaagctaggtcggtggccgctgtgaggagacgaggtggatccagttctgctcccgtccaccctacctcctggcgatgtatttttttttcatattctttgtgatttgtgaatggatatgagtttaattagtgatttgtgatggattacaatgtttgtgaatgaatttgttgaatggattatgagatttgtgttgaatttgggatttgtaaatgaattagggtggtagagaattttggatttggggtaggggattttgaacctgtgggggattttcacttgcggttctctttacatacctgctagcgaaattatattttcgcaagcagctctccttacatacccgccagcaaaattacattttcacaagcggctaattttcgcttgtgaaaattctctattttcactggcctttgattactggcggatgggttggccttaccaaaaatataaaatggacgccagtaaaaatcattttgtagaggtgactaaacggatgttttctacttttctataaattatataattatgttgtgccttcgtgatatcttgatttaaagttataaatttaaatgagaactttgatgccaattatcccgcatgcacgagtatctctattggatgtgattttcttaaatttggaacataaataaatattcttgtttgtaatgaagaatattttaatgaaaacaattaattcaacatgatcacggtagatttgtactccctctgttttatgatataagtcattctagcatttctcacattcatattaatgtcaatgaatttagacatatatatctatctagattcattaacatcaatatgaatgtggaaaatattaaaatgacttacatggtgaaacggaggaagtagatgttttcgtaaactttattttcctgtgataaacttaatctgcatatattatatatgcatggggtattattatatgataataagcgaaacataactcaattttgtttttgaaattatgattttaatatctctagcatacatgataaggtagataataatttgattagttactaccgtcaaacctggtgggacaaattcgttgtgctgtaagtgtcacgttgagtttttttttcaagggaatacgcctctacgtgctgttttttttttctgacagcccttcctttttcttttattcgtgacagtcccccacagcaatacgcatccagatgcctccgttcccctcgtgtttgttcaggtttaggatgctttgtttttttttttttagggatcaggatgctttgtttggaagccaggccacgttcagaacttttttacttctgtgaccaggaccgattctatatccaacggttgcttttgttaccgttgctctatctgacggctatgattcgtcctaagatttatctcatgattctctcacttggagagagattggggtaacttttagtcctttaaagtggatataatagtgtttttctcgagctattcttgtaaataataaatagaatagcacaaatttgtgacagctagcagaggtccttcgacgtgcatcgccaaaggtgctaggtggtgtacactcatgatacacgatggtgtaactttatttgccattagtttacgggcaagtttaatagtacttagtataaaaaactattagccataaaattcaacacatcatttataggtaatttaatagtctatttatataataaatatatcatcaattaatacttgacacacctctgtaacacatacttcttccggtttttaaaatatggcgccgttctttttttatgcatattttaccattcgtcttatttaaaaattttatataaatatatgaaaatgtaattcatgtttaaaatatcttagtggataaacaagtcccaacaaaaataaataataacaatatttttctactaagacaaatagttaaatatggggttacaaatctattaaaaacttgttgaaacccgtacaactactctgcaacgtacatactacaaatttgtaatctattttttttctttttcttattatttaagcacaaatttgatagggacaactctggtatactctgggaaaaagataaaacaacttatgtagtataaatcagagggagcaagagtgctctaaaagaaaccacctcgcatctaagttttataaaactagtgggggtgtgcgaaggtaggctcaagcgttgattctgctcgtttagctagcccgcctctgacgctgcattatggagggagtaggcttgtagctagcccgcctctgcacgctatatttcaaggaatcagagatccatacagacagagacgttcagccatcagacctgcagaggcaatccatccatggcatctatcgttcctgtactcctgcgcctgctgctcctgctgctcccgcttcccctgatccgagaccacctctggccgagccaccgccggccaacgccgcaggacgatgcgggtgagctccacccgatcttcctggtgcccggggcgagctgcagcgacctggaggcgcggctcaccgaggcgtaccggccgtcgacggcgcactgcggcgcgatgaaggggaagggatggtttgggctgtgggagaacaacacggagctgctggtccacgactacgcggactgctcactggagcagatgaccctggtctacgaccccgccgccaacgagtaccggaacctgcccggcgtcgagacccgggtgcccaacttcggctccgcatggtcgttcggctacaagaaccctgttaaccggtaagtttcgctcctaccaaccacgagtccacgaatcacctgattaaaatggcaatatactctctcggtcccttattcccagaaaaaaaccaacctagctatagctagagcctgtttagatcaatttactatgccaattttttttggtaaatgttttgatggcaaaagatttggcattgaagttttggtagttggtgtttagatgcatggtaaaattttaccagtttattagtaatgacagagagagcacggctcccaacacactttttggcaaaatgtgttactctaggctcccaaatgataaataccaaattgctaactttttaccactagtgtttagatccatttcggtaaaaattgttccaaaacaatcaaacttttgccattttggaggaactaaacagggccctagtttgtgggacagatgagcacatggagagtggattttaaaccatccactcgttgtttacatgtcactagttataaaaatatttagaaaactatgagaagatatactctcccttttttttatccgctgaactaggcctaaccctagtactgccaccatgtggatctgccttccatgcatttccacctccaattgatgcaaaaatcgatttctcactactcccccatcatttttcatttccattttaattcaacttttaattcatcgaacctgcattgtgggttgagttgagccgaagagagacaagccgagcagagaaagatatcagactgggttggggctgaaaaagatagtttaaaatagtttcccatacacatgcatagctgactcttgaaaagagaaagaatcattagtacttcttccttcaatttcagaaataaattatgttttagataagattgtagtgaaagtcttaaagctttaactattaatattcttttaaaaaatagtgtgtgtgtgtgtatatatatatatatatatatcatacaaagaactataataaaaatacagttgtatttatttatgtatatattataaaaaagtagtaaaaagatatattatgaagaccattttgttgttcaaaacgttaacaattatacaaaccggtgaaattacgtgattcaatgctggagtaattgcttgattacatatatatatattttagtctacagagagcacaatgccttggaaagctcagagactggctggaagaattgggataccgtgatggggacaccatgttcggagctccctatgattttcgctacgccccgccggtacccggccaaacatccgaggtgtactctcgctacttcagcgagttcatggcgctcgtcgaggcagcgaccaagaagaagcagaagaaggccgtcatcctggggcacagctacggagggatggtcgcgctcgagttcgtcaggagcaccccgcgggcgtggcgggacgcgcacatcgagcgcctcgtcctggtcgcgcctacgctccaagatgggttcgtaggctcggtgatgaagttcatcacggggacgggcataattttcgtcccgacagccacgtccacgaggcccatgtggaggagcttcgagtccgccatggcgagcttcccgtccccggccgtgttcggccgcgagccgctcgtggtcaccaagaggagggactactccgcgtgcgacatggaggatctcctagccgccctcggcttcggcgagggcgtcgagcctttccggcgacgggccgtccccaggatgtacagcctcgaggcgccgatggtgcccatgacgtgcatcaacgcggtgggcaacaagacgccgctgcaactggtgttgtgggacgacgacgacgatgacttattagacgcgtcaccggaggtggcagcgtatggtgacggagacggcgagatcaacctgatcagcatgttggcgtttgacacggagatgggtcggcagccaggacaggagaagcgattcaaatccgtcaagatagctaatgctaaccattccacgattgccatttatgattttgcactaaagaggatcattcaagaaattattgaggtgaatcaggtacgttagtagacactccgtacgttgggtttcacgtatatatgttgggtttcactgtgcgcggtaatcatatatatcacgtgtggaattctgtgtaataaatgaatcccatgcagctttgtgtataccgatgggttggttggtaaataaaaaccaaaaattactgctcccaccatcccaaatcagaaggtatatatcattaatttatttcacgttatattccaaacgaatataaaatcagtatcatataaaaatacttaaaaatataaatctaatgatatacatatataatacttaacataaaaataattattacaatcattttaacgttatcgagtttgattatccttc

SEQ ID NO: 31298 - DNA, 1895 bp, Oryza sativa
  unsure (1)..(1895): unsure at all n locations
gaagcgactcaaatccgtctagatagctaatgctaaccattccacgattgccatttatgattttgcactaaagaggatcattcaagaaattattgaggtgaatcaggtacgttagtagacactccgtacgttgggtttcacgtatatatgttgggtttcactgtgcgcggtaatcatatatatcacgtgtggaattctgtgtaataaatgaatcccatgcagctttgtgtataccgatgggttggttggtaaataaaaaccaaaaattactgctcccaccatcccaaatcagaaggtatatatcattaatttatttcacgttatattccaaacgaatataaaatcagtatcatataaaaatacttaaaaatataaatctaatgatatacatatataatacttaacataaaaataattattacaatcattttaacgttatcgagtttgattatccttcaaaagatgacgccctataatttggaatgatgctaatatattagctcaatttaaggtaatggaaatatattgcatcctcggcctttgttatactacgtacaatcaataagctttttagctaaaaagatagtagttgaaaggccaaacccttactaccataacaaacaaaattagacagtagttgaaaggccaaaccctaactaccataacaaacaaaattaattgataataaacttaaaaaaccatatacattctaacatattacgtcactcatagtagaatacaaatacaaagatacttgactatcaactctaagaaagtaacactattgcgcgtaatataatgctccttccaccataacatcaacacggggattgaagctagcttaatgacatgaagataacctgcgtggaattaaacaactttttgttattaaaaactttatcatttcattaacatcaaaattgaccaacgaagtacactaaccctgaataaaaccattttcaagcgtctagctagacactcctcggagtaactcgtctagctagggactcctcggtgccagttaccaaaaatatttctggtggttcgaggaggagggatatcctatatatctataaagtgatcatctccactaagtatagttaatgatatttctctattctctcattaagtcaaatcacctcaactgtttctaactattggatggttgatctatggtctaaattatctccctcccttttcttctaatataaaatcataccaccatagttttatttttttatgattagtttatattaccttgttaatttctttttcttctctcattgagtcacattatcttagttttccttttacatgattaattcatatatgatttaaattgttataaaccacattatcatatgttttatatataccttttttttcaatagtcgggcatagatgaaaattatacaaaatgtagatattttacatgttatttgtactaatattatacaaaactcccataaacgcgggatatcatctagacaccatcatgcaaaacgagccatgtggcaatcaaagaataggtgctgaattgttttctacacattgcagaaaccatcactaccacaaaacaaccaatacaagtcggcactataggtatcggaagtgctaaaatcgacacctatagaccttttcctacctccatgtaatgaaaacacaaacaacgacacccttaagtgattataggtgccagttctgtaaaaaaccaacacctatactattggtgtcgctttttcaaaaaaaaaacaacacctataataaattaaaggtgtcgtttttaacaccttttaaaaactgagccgtgagccgaaccatcgaggagtggataattgaggagagtgcgtggtgaggagacaagtctntntctctctctctctctctctctctct

SEQ ID NO: 31299 - DNA, 2583 bp, Oryza sativa
cagtagaccgcgagaagaatttattaagcctaattaatccgccattaccaaatgtttactgtagcaccacattgtcaaatcatggagcgattaggtttaaaagattcgtcttgcaaattagttgcaatctgtgcaattagttattttttagcctatatttaatactttatgcatgtgttcaaacgtttgatgtgacggcgtataaaatttttgctagctgacgcactaccagacttcaggtctaccctgtaggccgaaaaccgtcagaataatatgaattaccatcagaaaatgcttttctgtgggtgcaccgtcaaaaattgccgacagaaaaaagactacggagaaattaaatttttctgtcggtttcctgacagaaatatcatttttgaaagcttatttttgatagaaaaaagaccacggaggaattcctgtcggttggctcacagaaaaaatcaactggcgtcaggtttctgaaagcttatttttgacgtggacccgtcaggaaaaaccatcatccaccgtcagaaaaaatgagttccacgcccaaaaaaaaaatacacatggcgatttggataaatatatgaacatcaatcacaatccatacatcaaaattcaagtttgcaaagcttacataaatagtccatctaagttcagtacatacaaattcattcaaaccggatttagtaatatacaaagggtccatagaaaagttaaatggttcagttacaattcatcaaacacatgtaaaagaaaattgtcttccagcagcagtccgtgttccgtggtgcttcaaccttgggcaaaggaagctaaaaggtttaaaaaaagaggttcaatttcataattttcttcattacaaaataaataacaatgattatgaataccccagttatagagaaacaaatagattagtacagggaaaaactgaagtgagcaacataaatttctcaactacaagcatgaaaatgaaatatggcaactgaaatgaaaagtgaccatgaaaatacttcctgtagtactctgccaattcagataagacataaatgctaggataataggatcagactcattttctatggatgcttaaatgacaagtttcatggtgcaaatgctaggacatcttagactaagaaaagatttcatccactgaatgagaagcataccttgattttcatcatgtgcaacgttctgtagatatttaactgcagcacttaaatattcaagctatggcatgttaagaaaaatacaaagtgacatgaacaaggtaaattataaagggtttgtacataagaaaattctaaaaacaagagactgaaactaatttattgttctgatggcatgtatctatccaacacatgtagcagtatgtgacttgccaaaagatatacaaggacttagacttgtgaagtatgtatatgcactactagagactagaaagcactaatgatttcatgcatacaacctgagctaaaaatatgttttcttagctactgaaacagagaaaataaaacactataatactcattattcacacaatccttaccatgaattgcaaggtaaaaatagcataagaaaagcatctgcattctaactaaatgtgaccaagaaagcatagtgcatgatattccactgatagattaatttcatgtcaaacaactcactaccagacacatacaaagttttatgaatagcagggactctagtgtgggagtacctgtcaatctgtcatgccacaatattaggtcttcacaaaatggctagagaaaaattagttggtccagacataattacaaggctgaaacaagaaacaaatcatttagatgtaaaataaatattatactctaggagtaatccaaaaaaaattaaatttctattatagaaactaaatcacataatgtagacaatatgggaaccaacttgtcttgcttaatattggaaaaaataataattagcaacaacagtaatggatcaactaatccaatctagattagttgatgaatgcagcaacgcaggttttgacacaagaacccaaccaatctagatctactgacattccactgacaatcattaaacttgttgtaaagggccaataacccaatccctagcaactaattgtgttgaaactatatctactactgggcagtcatgttagaataggtgtcaaatatactagtcctatttggttacagttggacttggagttgtaataggtgttagggggtggagttagagtcggactctgtaacccggcatctctcttaaatagagaggggggcaccacaatgtaaccatggcgactacaatgtagcgtagacacgcagggagatgatggcggcgtggccatggactcgtagtggctaggagctatattggttggggaggagcgcccataatcagagccccggggatgtaggcttcagctgaacctcgttaacaaatatcgtgtgttcctgtgttgtcatctggcatgtcttgggtgatcgatgactgaagcgatcaggaaggttagtcgtctttccgctatatcgactaacttttataacaagtcacgtaatacagatgaaagcccaaataatccac

SEQ ID NO: 31300 - DNA, 2732 bp, Oryza sativa
gtctttccgctatatcgactaccttttataacaagtggtatcagagcataaggtttcagcattggatcaagaagacatgtggaggaggaaacacgaggtggggatcgcgcatcgacaggagatcgtcacccgtggcgatgagatcgatgtcgacaacgagaacgttggggaggccgcgacctcgctcgcgatcagaccggcgatggcggaacgtgaccggaagacggggccgggcgtggccgaaggcgaccggagagatcggaggggtagcgccatggacggcgcgcccgacgaatgcggtgatcgcggatccgcggcggcaggaggccagtgacggaagggcgaaaccggcgagcgtggtacggcgtggcgaacgtgaagggccggggcgacggggtcgtggatggtgaacatgagggctgcgactgcggtgcgtgcataggcacggacagatagcacaggtgctgtcttatacgtacggcgtgcaaagactaaggagcaaaggcaagaagcaaaaccaaatcgagcaattgcatgcaaacaaggacagggaagctgcagctttggaactcgtgcatggctttagcgtattcacgtgaacatgagcatgcagggcatgcatatcgtgcgtgcacaagggatcaaggggcagcagtaccaatgcttcatacatatgaaaacttttgtgccgtggaagtctgacagattgatgagccaaaaaagaaatcgagtggagaagttgaatgataaaacgacttgtcggagtcggacaaggctgactcgaccgcaattgctatggagtcggattcagagttatgtatggatacggactcatgatcgcatcagactcgtattgcttgccctttaaataggcagccgaaaagagagagccgaaccaaagcaacaaagcggcagcgattttttgggcggctcggcaggacattggtcagacgtggtacaaggggctcaataggcttgttgtgcagaggcttgtgacaaagtgcgcgcgtatgggtggaccaagccaggccgacgagatcgtgcagagcagaggcacatcgagggcggaagattggtcacatcggattatagcgaacgcggtttgctgttgaatatctgagattggatcacaagacgggattgtgaagacgaatacagacggttctgagcagggcgagtattctggtggcgacagaccagtcaggtcgcgggttggcaagatggcgccgacaggtatgaaatttgatttggtgaatccggaaattttggcttgtggcagactagggtcaaagatttgttagctcaacaaggagtttcaaaggctttgaagggtgtcaaaccggccaagatagaggatgacgattgggaggagatgcagttgcaggcggctgcgacaataaggctatgtctctcagatcgggtcatgtaccatgtgatggaggagacctcaccaaagataatttggaaaaagttggaagctcagtttatgtccaagactctgaccaataaactgtatctgaagcagaagttgtatgggttaaaaatgcaggaaggggcggatctgacagcacatgtgaacgttttcaatcaactagtcactgatcttgtgaagatggatgtggaagttgacgatgaagacaaggccatagttcttttgtgttcgttacctaaatcgtatgagcatgtggtgactactttgacgtacggcaaggagaccatcaaaactaaagatatcacttctgcgttgctggctcgtgatcagatgagaaagaataaagagggtgaaacatctcaagcggagggtttgctagtcaaagaagatcatgctgggcataaggtaaagaagaacaaaaagaagaagatggtgcaatgcttcagatgtgatgagtgggggcatataagcagggagtgtccaacactgaagggaaaagcaaaggctaatacagtgacttcttcaaatgactcggatagcgatggttgtgattttctcacgatgtcaagtgcacagtctaaggatgcagaagcgtggatattagattcagctagcttgtttcatatgacgccaaggaaggagtggttctcttcatacaagtctggtgagtttggttttgtctacttaggcgatgacacaagttatccggccatgggagtaggtgaagtcaaaatcaagctagaagatggaggtgaacatgttcttcagggagtcaggcatgtaccagggctaaagaggaatctgatttcgcttggaaccttgcatgaagaagggttaatattccgcggtaatcggaataggaagaccattgagatcatgaatggcaagatggctgtgatgactggagagaaggtggagtcgcatctttataagctgcgtgggtgcactgttgcaggtggagtccaggaggaagcggttgctgggatagcaattgcttttggtggcggcgggtctggcgcagactcgtcgggcggcttgcagtgaagctgcaaagaagacaacccaagtctggaggaccggtggatcggcatggtgatctactacttctaggtggcgtatattcgccaaagtggagtttgttagaataggtgttaaatatactagtcctatttcgttacaagttggacttggagttgtaataagtgttagggggtggagttagagtcggactctgtaacctggcattcttttttaaatagagaggggggcaccacactgtaaccatggcgactaccatgta

SEQ ID NO: 31301 - DNA, 2276 bp, Oryza sativa
ggtggaaactcgtcaccggcaagagatggtggtgatggtcggctgcatcttgccgatggcgctggcgagaggctcggtagccgacccgccgttcgtcgaaggtatcgcacaggcgctcgccatgcggatctagagagaatagaggggcggcggcggctcgagggtttgggaagaggggtggggaattaggttttgggacttggctgcctgagttttatttgatggttcttgaggcccacttgtcagcgctttttttctgtgggtctgtgtgaaaacctataaaaataacacaatttttctgtgggtataagtaaccccgtcaagaaaattaatattcctgtgagttggccgcggaacctacaggaaatctagcggcccacagggtagctctcaagtctggtagtgacgggatgatcttgatgtttcatggtgcccgtatcaagcaactacttcgtactgttgtgcatcttaggaatccaagcaattaatcctccaacatctacagttctacgccatcgtcgttggctcgttgtgtgcgtgggcagcatagtacgtgtccagttgtaaaccactcatataaagtgacagactacctaagtaaagtgacaggctacctaagtttagtatagtgaacaccatagttggaaaaagtgtttcgtcccttaaaaatatttattttcacaattttattattttttaaatttatatatgtattaaatttgtggagtgatatatcccatatgatatctattgatattttttttataaaaaagttatgtcaccattccggtggcatgagtccgataagagcagtggagatgtatttttatctcttattaggtcttgttttcccgtaaaggagggatttgaaggagatttgttccatatctattagtagatattcaagtacgttgtgtttcactgtgcgcggtaatcattagtggaggatggataccgccacacttgttgtactcttgtacttgtaacatcattttctcgtaacagagatgcagatcgctcatgctccaccaaccataattccgtgcaaagaaaaaaaaagataggctagtcctaacttctgaatattacgtctaagaatgagactttgattaattaatcttttgaaatttcgaccaccaatctattataatattaaaacagtcttagaggcaccacgtttattgtgtaggctaaaaatagaaatacaatttaaaaataattgaaattcagaatataataaagaatattaaaagaataatctatgttgtgaagatgttgcggttttcgctggcggcgtaattaatacaccgtcaacgaagatggcagatcttcactggctcgtctattttacatgcggtccacttactcgaccgcttctaaaaataacttttcactacctatacagctgcccggaaaaaaattacttcgcgctataaaaaaaaatcctctccacccttatccttatcccttcactcctcaccacccactcatccattcctcccatcttctctcgagcgctgcagaggggcacgagccgtgccgtgggttatggatccgtcctccggaggggcgcggccgacggttctggcggcaggaggcatcttggacaatgacagcgagtgggtggcgaggctcctggcggctgactggcggctgaactcgggcgaggcagcaggtcgacggcgaagctaggtcggcggccactgtgaggagacgaggtggatctagctctgctcctgtcctccctacctcctggcgatggattttttttttcatattctctgtgatttgtgaatggatatgagtttaattaatggcttgtgatggattacaatgtttgtggatgaatttcttgaatggattatgagatttgtggtgaatttgggatttgtgaatgaattagggtggtagagaattttggatttggggtaggggattttggacctgtgggggattttagatctggtgggggattttcacttgcggttctctttacgtacccgccatcaaaattacattttcacaagcgggtcttcttacattcccgccagtgaaattatattttcataagcggctaattttcgcttgtgaaaatactctattttcacaggcctttgattacttgcggatgggttggccttaccaaaaatataaaatggccgccagtaaaaagcattttgtagtagtgactaaacggatgttttctacttttctataaaatatataattatgttatgccttagtgttaccttgacttaaagttataaatttaaatg

SEQ ID NO: 31302 - DNA, 702 bp, Oryza sativa
cgaccaatcgcgcgcgcccttccgcacgtgactggacacgtgtcgcgcacggaaaggagcggcggatcgcgcgtgtacgtacagttttcctttttttttttctgttttcttctgcggacggagcgcgtgtacggtttccttttttttcgttttttctgttgtcttccgtattttcggtttcttttttccttttttttcttttttatcttttccaggttttaatacatgcgtatgcaaactttatatacgtgtatttttttttagatttttttacgtatgtatacaaagtttatatacgcgtatacaaactttgtatatgttttttgttttttcttggctttcggttttttaaatatctatgtatttatatatacaaagtttgtatacacgtacacaaagtttgtatacaacagtgtaacagtagtagcaacagtgtagtagtactactagtagtagtatagtagtagcagtagaggtagcagatagtttactgtagcaccatattgtcaaatcataaactaattaggtttaaaaagtttgtctcgcaatttacacgcaaactgtacaattagttttttttgtctatgtttaatactatacacgggaactaaactaggcctaaaagttttttacctaaaaagacagtagttgaaaggcctaactaccgtagcaaacaaaattgacagataaacttaaaaaaac

SEQ ID NO: 31303 - DNA, 2547 bp, Oryza sativa
  unsure (1)..(2547): unsure at all n locations
caattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcaggatccaaatccagatatgcataaaagggattcatggctttaagcttatctcttacgctccaggaatggatcagtcagaacatcaccaccggctcgccgtcgtcgccgccgactggtgtcttcgcctatacggttggttggtcacaacaccgttgtcaggcgtctacattttcaccgaccggccgccacgtccgccaccgactggtgtttccgcctgcacgctggcctattatgccaccggtgttgggcgtctacgactccaccaccggcctgcctccatcgccgccgactggtgtttccgcctgcacgctggcctattatgccaccgttgatgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtgtcttcgcctgcacggctggcctattatgccgccgctgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggctcgccttcgccgccgccgactggtgtcctcgcctgcacggctggcctattatgctgccgttgttgggcgtctacgtcttcaccgaccggccgccgcatccgccgctgactggtgtcaccgcctgaacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgacggtcgtctcgtctgctgctgactagtgccctcacctctacgtctggtttatacagctaccactactgatggacatcatcgtcttccgttgccgactggttatgccgacgccgactagtgcttttatcttcacaactgcgcgtcttcgctaccagtttgcttctgttgccgccgactcgtgttcacttcatcacggcgaatgcaactttgtcataatggtggagcgacttcatctttattatcttcggcactggcaaactctattgctgctacttcgcaagttttactacttcaccaaccacgacgtctttgtgaacctcgacatctcggcatgcaatgccatgatattttactacaaccagtgactcttcaatattcaggatttctacttggacaccttcagcacatatcttcaatcaagcaatgactactcgacgacaagaagctataattctggactatatgttcagttgtttcccaactaaccaaagagtcgggggttacacaaatataaggctcaaaatttgacaattttagtgtcaagctgaagagatcaattaatcagccaatgagtcaactccaggagtcattatcttcatctttgctaagaaacagaaaaaatacttccacaacttcaaannnnnnnnnnnnnnnnnnnnnnnnnnnnnnnnnnnnnnncagactcaatgtgcaaggaaaggttcccactcaccctaataggttcgctgcaaattcaatttcatccctgtactgcttaagacagcgtgtagcattctcactttgtgtgcgagcacctacccaacgaaagccaactgggagcacatcctgtggaatgtctgtctctgggcacacgggagaccggaccaacggtctgccaacatgggagcgctcccagctccaaagctgcaagagaannnnnnnnnnnnnnnnnnnnnnnnnnnnnnnnnnnnn

SEQ ID NO: 31304 - DNA, 912 bp, Oryza sativa
caaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccaactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatact

SEQ ID NO: 31305 - DNA, 253 bp, Oryza sativa
cgtccgaattacccctctaaaccataaaaccgaacatcctttacccccaactatgcaaaccggatgaattaccctcctcgacccaatctacggtggttttggtctacgtagcgtacgcgtggcagtccagtcaccactctattataaaaaaaaaatgtgggacccacctgtcatctcctcattctctcttctctctctcactcttcctctctctctcaaacgggtcggcggcggtgggggaggacgtggtggc

SEQ ID NO: 31306 - DNA, 713 bp, Oryza sativa
  unsure (1)..(713): unsure at all n locations
atatgttgaacatatgcttgtgcagtactgagtcgtagcaggataacaatgctgatacatccttcaagttaatggatataatcacgcatccatgacaatatgcttataattttacctaccatttgcaggcagttgagaggaaaagtcgcctcgaaaatgctgcggttcggcagcagatccagttgagtgaagattcttcacgatctgtggatccagcaactccagtacaaaaagaagaaggtgtccctcaaagcacaccaacaccaccaactcaaaaggccctggatgctgctgccccttgtcctggctcaacccaagctgttgcaagcacatcaacagcttacttggccgagggcaagccgaaggcatcatcttcttctccatctgactgctcctttcagacaccatccagaccaaatgatccagctcttgctgatctcatggagaaggaactgtccagctccatagagcagatagagaagatggtaaggaagaacctcaagagagctccgaaggctgctcagccttccaaggtgaccatccagaagcgcaccctgttgtccatgagatgagatgagatgagatgagctgatcacactgtccagaggagagagtgaggcctgctcaggcctgcaactgcgaggtattcccacttgtctgctgctttcttagnnnnnnnnnnnnnnnnnnnnnnnnnnnnnnnnnnnnnnnnn

SEQ ID NO: 31307 - DNA, 731 bp, Oryza sativa
  unsure (1)..(731): unsure at all n locations
nnnnnnnnnnnnnnnnnnnnnnnnnnnnnnnnnnnnnncaatccattaacattagttgtttcatatgtgatagtgatatgtctcaacgtgtattttcaccatgtttcataaactttttaaatgtttcagttgatgattttttgtttcaacctatataacttgatgtttcactcgttagttaactggaacatttgactgactgatttcttttttgcatgctgtatacataggtggtgtgatgacgcgtaaacagtcgggtgtccgatatttggtggaatatcggacgtccgacgcggagtcgtctcccaacattacctatgcatcctttacaatatatttttcagttacatattaaattaatgaattttcttatacacggtatattacaggataacgtgatggctatattcgcaggaatacacgacctcgtatactagtattaatggaaaatctctaagccgtatggtcatggaactagattgataacagtaacatgtatacaaagtacaacagtatctataaataaaaaaaataaagaagttgtatattaaatccattagaacttctaatatctatggcatatatatacatatgaaaataggagctaataagttgttgtttaacaaatcccatttaactagcccgtgcaatattacatcagtactcccgtagttccttaaaatgcgacggtggatctgtagtacactctctacagatataagccttttaaa

SEQ ID NO: 31308 - DNA, 363 bp, Oryza sativa
aaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaacgaggacccgatgtgagcaagcttataggaaggggaaaaaagagtcactttccatcgtttggcgctctgctcataagtcagttctaaagtttaaat

SEQ ID NO: 31309 - DNA, 764 bp, Oryza sativa
  unsure (1)..(764): unsure at all n locations
atgataggtgatccaattgacaaaaactgagataagaagggtacccacagatcaaattgttttttaaggataatttttgaagtaaattagctttcaatgaagtaacctccaaatgagctcctataaaagaagtgcaaaccttgtatggtttctgtctattcagaaatttaatgtcatgatttagttgtgatcagtgctcactactccctagaaacaattattcctttatatttaagaacctaactcaatgaagccctcttgcatttgcactccagatacttaagaatctaactcgatggagcatttttcttttgcacttcagatacttaagaatttgacaggattgaggtccccttggaattgccctcatgggaggccaacaatgcgccatctagcagatctccatgctataaaaactgaaggtaagagattgtcggccaacactcatattctctagtttacatgcttgtatatgtctcatctatatctgaagaaaaagagtgaagttttcttgtttcattgcaactccaagtagttcgagtcattatcatctgcaaatgtattgttctaagttctaaacattgtagacaaggttgtatcagatcatcactgttgtaatttcttgaataaacaaaccactcttctattttttcactgaaacaacaagattgaaatgtgttgccaagttcattgtgttacaaaaaccttctagtgtaaaaaaaannnnnnnnnnnnnnnnnnnnnnnnnnnnnnnnnnnnnnnnn

SEQ ID NO: 31310 - DNA, 1848 bp, Oryza sativa
  unsure (1)..(1848): unsure at all n locations
nnnnnnnnnnnnnnnnnnnnnnnnnnnnnnnnnnnnnnnnnnnnnnnnnnnnnnnatttatatcaattgaaaaaaaaaaacatcagttgcgtatttgatcctattttaaaagctaaaaaaaactaccattcgattaattttttagattaaaaatttactttatatttgtctaaattcacacaatcactaaagtaataggtaaggaatcaacatgatgcatattttaaaacattcaaactcacttttgacaatagcatatatccaaatttctccaaagcagacgaggcgtggtagggaggtccgggtccctacagcctactcatatctctgtgtcgctcaggtgggcctcccgctgcgaccagcccattaacttgtccaggaccagcaacgcggcccatgccggtcggaactgcccgaatcgcaacgctagatcgaacggctgtggtggctcgggagatgcggcacggttggcttgttgactttttccggcccggattgacgccgcaagccgaatccacgagtagtgggctgcggaattttgttttgttttttttttctccccatcccatcccggccctgacgccgccgcacgacggccggccgcgggcgccgccggggaggtcgccgccgatgagccccaccgcgccgtcgcgtacgggtcgtgctctcgcccttctccctgtcctggtgctgctgctcctcgtctgctcgccagccgcgtcagctggtacgggacaatcgccaccccaccgcgactcttcttccgatctcggtgctgttcttgcttagttttatctgtagcttttgttggtcgttagctgtatgtgtttgtttgttacttggacggttcgtggtgcccttgagtggatccttgatgcgttctgtgcttggtcgttgaaattgggtgtgtgtttcttttctacccagagacagtagcgtaggtccctgtgggctcgtagattgagttaagctgcgtggaatttggtgtatggtaaacgccgcctgtttgcattttaggaattactgcttaggaatttttgtttgtacttctgatggatgttatcagtcattaccagcctttactaggggaaaatatcacagtttcttcaaattgcatcctgctaggagtaggatgagcaatggtacctggacaccaaggtggtacttgagtgaaatctatagttttttatgaacattgtggcttgagatcgaatggagtagtttatgttaatgaatttaggcatgtttaattattgtttgagcctctgcaaatgaaaaccatggtagtcatacttctatgactaaaatcattattgtctggcatcacaggagaacagaaaggtgtatgtgtttcgcctggtggacgattccctgccttctcatctgaaggtaagcgtcctggaagagcagctaaggggcgcagagatctggcactatgtagagtattccggcagaacacgtgttgcgatgtgtcccagacattttctgccctgctctcagtgagaaagcttgcatcgactggtgaaggtagtcaagaatgccttcatctgtgggaactgctcgagtgttcgatttgtgatccacgggtgggtgttaggcctggacctccagttatatgtgcatcattctgtgacatggttttcaaagcttgctcagaggcgtacttcgctatcgatgtgaaaacacaggtaaagggcatctctttaagctgtgtctaaataaaattttcttgctataccgatgtggtactttacaaggacagttgcagttgccagattatacttgctcatttcataattcatagtttgatctagataatattaggtgaaatttgatcatagataaaca

SEQ ID NO: 31311 - DNA, 6729 bp, Oryza sativa
tttctgctatggtgggaaagcaagttttgatgccatctctagttcatggacatcttcaaaagagcgtccagtattaagtaatgtggcctcttggaatcttgagattttcgcagatgggcaagagaaatgcctgctagtgaaagagtttcatgggcaattggaggaatggttcttacagcaggccttatatttatcaggttttatatctctttcttattttcatattctaaataacaggtataggagataagtgtgactggtcggaacttgatacaatatctgaagaattggttcttttcatgcctatttcaaacaaaaatatcttatgaaagatcacacaaaactttggattatgtccgtgtgttcgtttaaacttgcaattttcttccttggctctctagcttaatgccatacacatgccatttccccctttcagatgcttgtgttgttacaaaaactaattttttgtagtttgtgcagtaaacggaagagctacattcctggccaaaagcaagctgctatcgcccgcaatgtgagaaagctggaatcaagagttaacccacagcagcttaggcgaaattaggaatgcgtaggtagcatggattcctatttccaccactttgtgattcttatatttgaatctgcaatgaatttactgttgaagatgtcctctacactggtggtcagatagatggatggcgtcactggttacaacctcctttgtcatccttgcgtagaagagcagaagagatctattaattcttgttcaggttatttctgtctgcaggatttatagatttgcttgaacatatgtatatagttttggaatggaatcttcagagattttcttcatactccttcagtaactcttgcattctgtctatttttaatcagcacgagttaaagcactcgttcaaatatgttttgctccagatagcccttaaaagaaatcatgtttgctccaggcagccctaaaagaaacttacaaacatagggaaagacagtacgttccgtgttctgataatttgaagaaaacaaagaacctcttaataattgcatgtgttttgtctctctttggttcgtgtattcattcaagaatttaaaatttagtttccatgtccttttcagattataatgtaaaatgctgatttttgtagaaaagctccttgaacaaactgagaacaggcacagcagctgctttccccgtagggcaaccacgagagttgtaactttattttgtattgagcttcatccatactttataaaagcaaaataaagaagttacagagttgcctaattacaacaaaatcttttgaaattacatagtttgtaccaatcaagagctaagaatgtttgaaaatgccatccatctacaactatgtaacgattaagaatgtttgaaaatgcgaatacgggtggggaatgctcctgcattacaaacagtaagaacaaaatccgtggaccattctatcttacggcagattcaactgcagaaaactaagacagattcaatgcaagacaggaacacttttcctcgttgaaaaataataaaataagattgtcagcaagtgaggttacatatcgcaatctgaaattgatctatgcagatcaaccctgtattacaccctcgttgctcaggaatgccctggcaagtttcatttgtagttaaggagacaaaataatcatcatggggagctcataggaaccccaaaatgaacctaaaataacccgccatccaacagcgaatatgaagatcttaatctttatgtgaatgcgccaggtattggcttgtgtacttgtccaccttcggtccagatgtgccgtacttcgcgtcatagtactctaccattgcagatcccactaacgctgctagtgttagggcttgagcatgcaacctgcaataataacagttatattaattaagtatgtgggctgtcaatttgtagcatgattgactttagtcacaactcattggtgtataatcatatggaatgtagttaatcgtacataaactgcctacatacatgaaaaggtacaggcattcagatccaaatatctgatattgccacccaatgcgttagatggggttaaggtcgtgccaattttacatctacgaggaaaaacagaacttcaaagatttaatacatgactcagtgcattactacattgactgacttcaaaaaagaggtggtaatatcgctagtagatgcgttggaaaatagcaacttagaattctaaccctctggtctcaacaatagtaatcaaaccgttcaaaaataaagaaggtggtccgtatgtacatggcttctatttaggtgtcattgctttatgcacctatctaatctagcccaaaaaaaatggggaacagaacagagaaaattatgagggccagcagtgaagggtgcacactttcacaggacaaaaatgctacaaggtacaagctatatatggaattggacaatgcatttctgctgatctaagttttgacttgctggatcggatggactagtataattgtaagtgcactatacacaaaaaaacgaagctattgttgcagaccaaggaatctttgaaaaccagtccataataatactgatacacttccaaccttagatatcttagtgacaaaaggtcacgtgaattacttcgtacagctagcgacatataaaaatagtaattacaagcaacgttttgtcataaaattatatatgcatagccacctaggtagaatatcaagttaaacagataagttactaaatttcaagtttcctgcgtttcctgcagaatggtctgcattgcaaccttaaaggataactaagcccttcagtgttgaatgtaatcaacaaaatcaaataattcaccaaataaataatggtgcattcttaagtctaccctttttttttgaaagaagggcaaaaactttgccacttttgtattgataagaggaggagaaaagcctcaacagtgaacctttacaggtcttatatctacttgcttggcgggataattgtaaacgaacaaataaaagacctactgttcaagaagaacaaattatgaaccccgtggactataataatatcctacgtggtttgattatctctaacggtgccccggctgcctgctaataatcactacttgtagtcccaataaaaaaaacaagtacactctctacaattaactggaagtaaagttcttccaaaccatgccaatggaataaaagaaggatccatagctccatattcaactacagctggcaatggtaaatggtagccaaactgtctatagtctgttgaacaatgctacactatacgttgaaaccttcctacaggctcatcgatgacccaattggagcaattctgtctggtttcagttgaaatcgaagttgctcaagtcacttcataactcagaatcaatctggaaggcatgtgcaacagaatcacttttctattgtgcaaacattatgttcaatcgaccttttaattatcatggcaaggttcaaaatccttttatcttattgtgctaatgttcacaaatcacaatgcctacaaagcgttctcaagatgaataatccgtgtattcttaatcatggtaagacacgagcctgaagctaagatagatgagacaaaggcacaaaccttgcatggatgatcttgacgctagtcttcatattgggcctcgaccagttgtacgcaatcgagctgctgatcccagtaagccataggcaaccttcactcacaaacacataacataagcaacgtaaaatagttagaaaatatccaaaaacacgaggggaaaatcaatctcaaaatttggggaaaaggggaatcctaaatagaatacacaacataatttttttcgcaagattgagagataaaatcatataaagaaagccgatgaacttctatcgggaagacgcatggattggggatttggtggtgacgcatgtagcaaatcgtacatcagaaaagaaaagaaaaaaaaacaacagaaaagtagcagatccgcgcggaggagatcgaaatcccaggaaaaattcacgagatattttacctacggcgcggagcttgtggtcgatgacccacttcctcatggattcaatcttgcccggggcttccgccatttgcttcgccgcctcttcccccatcttcctctccgatttctctcgcttctctttacgcgctttgtttttcttctttcttttttttttcgagctcttttcttctctctcgttgcaaaattgcaattggagaaagccagcctgcctctagttatatcggaggacttgtttgtttccggtcctcaatgaattcggaaattcgtttagtatccgggtaaattatttggattcctttcacatgtcccagcttgttgttgctaatttgttattctccacttgcaaaaagaaaacgtttttgtttcgttaagcatgttctgtatttcttgtgaccgaagaaagagagagataacggttgcgatatattctttggaaataaatcgtcctaataatttttaggtgcaccctctgtgaggaagtggaaatgactttatgattttgcgaggaaacagggatatgattacaatcttgagcgagaagctaggacacactccctagagcctgaaaacgccacaccgtatatggcatataatttgaaaaacccatatgacataaatcacactctgtcgtgtgatttaaagagacgtaactctctagtattattattggaattctattaaagtatacttatatataatatttgcgagtaccaatatattagaatcgtgcaccggccacaaccccgtactatagcgctgtacttcccgtgatgatttaatttaaactcattatagattgagaaaaaatactagaaaaaggtaaataaaagagaggctttactcaatgaaatacacaagaagacgcatgcatcactgtaaaagcttaaagatatgaatgtcataacgattaatatattcgatctcatgaaatttgtactgaatcacatttttttatacgtaatatttatagacactaaatttaaatattgataagttaagtcatgcaccaacgactacaaaattttgtactcacaataacactaagaaaagttaggtttttactggtggtctctgaaaaaaatggatttgctaaaagccaccgaacaattgtcatattctactcgcgcagtctaaaggccattaagataatgtttccaataaagttggagagagaatttgactaaaatggcttcgctacccttcttactaattggcattatttctcctctccctgtcttcctcttgtttcttcattcacgcaagatggcattgatggtgagcatgacaacaatgttgccatatctagttacctttgagtcttctagtgctcgatttgccgattatcaaaatccgaactctaatgcttgaactagccctatcgtggctcggtgaagagaatggtctatggataaagctggctttatagaaccagtcactactccatcctccctaacctaagagccaccacctaagaaccactttgacatcataagacctgctcctataaggctactccaccactaccgcggcaaacacaaggcccactcgacatgaggcggtgcccaatggctcaaatcagctccatcgcgactggtaccccttcgcaagaggaatattagaagaatgaacaagaaaggcgaaggtataattttcttgggttttgtcattactaaggtggtgttttaatctcctgaagataaagattaagtgtttcacgcaaaacgatgtggtaataatgtgcgactaattgagttttaattattacaaacttgaaaaatgaattaatatgatattttagaataactttcatatagaaagttttcgtacgaaacacaccgtttagtagtttgaaaagcgtgccacaaatatccgaaactttatcctctccttacggtggattcgaacggggcctaagtggatattgtattttagtactcacgatgccctgcagtaaattgccacactttttagatatcattagacaaattttcccaaaatggcaagcaatataatgtgtatgaaactagttattacaaagataatataaggtgtatgaggaccaaagtacaagatatagtcatccgtttaactaagagctttagtatatatcttctcaaagaaagtccaaacatcggtagatatagtatatactccgtattaacgtcccgaacaacaaaacaactttgcagtctctgaaaaaaaaggtacaactataaaaatatttgctcataaacgacaatgcatgagtaaaattgcaacgtcgttcttttcctcctcataaaaaaaaaagagaaaaagaatcaacgttcacgcccttcaattttgtccggctttgcaaaactttttgcagccctcgccaacgcaattcgtacaaaccggaagggggtgggtgtgacagcgcagaaggccaccgaatccaacgcgaaaacggcacgtttctgccttggacggcggccgcgcggtcaaacctcggcctccccctccacgcagctccacctgacccggcggcgactcgtgagtcgtgacacccccccccccccctcgcggaagtggctcggcaggtggcgaggccacggcggcatagttggattcgccacgtcatgttaaaggaaaaactttagtcaaattatacataggtatcacatcactcaaataagatgataataatatggaaga

SEQ ID NO: 31312 - DNA, 12235 bp, Oryza sativa
  unsure (1)..(12235): unsure at all n locations
taaattttagttattactgtgcagttgccaaatttctgatatatttatcaaaagttagtaagaaactaaacatatgcaacttaaaaaaaaatggtatgatttaaaatgacatcaaagtgaaagttaagggatctcaaatgagcttattcccgttccggtttggttggcgtagggaatttgtcggccgttcgacgagcagctggctgggccggctcactcacaccagccgcatcgaggcccaactgagaggctaatgggcctcggccctcgggacggtttgcctccggctccggctgcggatggccaccaccaccaccaccatcatcatcggtgcccgccgcggaagaggaggagaaagggaaaaaccccgcgctgtgtagggttttaggcgggtcgaggtggaggggggaggatggccggcggctcgtcgccggcgatacggccgatcggcaagtcggcggtgcaccggatctgctccggccaggtcatcttcgacctctcctccgccgtcaaggagctcgtcgagaacagcctcgacgccggcgccaccaccgtcgaggtcaccctccgctcctacggcgaggactccttcaccgtcgccgacaacggcaccggcatctcccccaccaatttccaggcacgaatcccccctcttctcctctcccatttgctgcttcgctctcgcgatttagttgctgaccgccatgtgcgcttctcaggcgctcgctctgaagcaccacacctccaagatctcggacttcggcgacctcgcctccgtcgccaccttcgggttccgcggggaggcgctcagctcgctctgcgcgctggggaagctgacggtcgagacgaggaccaaggacgagcccgtcgggacgcgcctggagttcgcgcactcgggcgtggtgaccggcgagaggaagatggcgcggccggtcgggaccgccgtgaccgtcgagaagctgttctccacgctgccggtccggagcaaggagttcagcaggaacattcggaaggagtacgggaaagtgatctccttgctgaatgtgagctgcccatcttattagtccatgttcgttttgcgggcatttcaatttgcgtaaagctcatgtatgttattagaatctagttcatctcctgatacacatgtttataccactctgctgttttactctacacatgtttcgttctggttctgctaagaactgtgatttattttttttctttccctaattaggcctatgcgttgattgccaaaggggtcagattagtttgcacaaatactgttggcaagaattctaaatcggcggtgcttaggactcaagggagcagttcactgaaagataatatcattaccgtatttggtctgaacactttcaagtgcctgcagcccttcaatgtgacaatctcagaaggctgccaagttgatggctttctttccaaacctggacctggtagtggtcgcaattcaggggatagacagttcttctatgttaatggcagacctgtggatatgccaaaggtttccaaacttgtcaatgagctgtacagaagctcaaatgccaagcaataccctgtggctgtattgaatttctgtattccaaccacatcttatgatgtgaatgttgcgcctgataagagaaaatttttcttctcatctgagcatgccattttgctatctttacgggaaggtattgagaatctgtactgccctcaacaatgcagtttctccatcaacagcgttgaagatcctgggaaggaaatggacccagccatcgatgggtctgatgaagacatgtgtttaacagaaaaggagaatgtttcagctcctgaaaatgacgatgacatggatgaaacagatagtgatgatgaggttacaccagagaatcagaaagtgccttcttcagtgacaacaagggtagccactggatctacacccaaagatgtgagccccttgtcaagaggcccacctgctcagcttgatagatctactttgctttcagcctaccggtatgaacaacgagaaaagacgcctacacgagtaaaaagttatccagcacaagcaaatcatgttagaacagggcttgctgcaaagtcttctccttcaagtgctgttcaaccttctattatgaaatttctatcacaaaataaaaggaaacacgaagacagttgcaatcttatttctgaagctccagtgctgagaaggggaacatgcttggagcaagtgaggagaacagatttaggagtgaattcaccaactgcactaacctcaagagtatctaatattccagaggttaatgcacctcaaggaacaaatcctttgcggcaccattccctgcaatcttttgtacctgagatgccagaagattcaccacagcattctgaaccacctaatattgtttctcatcgtgatgaagtgcctcagttgcgtccatgtgatgttcacgctacagaatctgaagtggtaaggtagaattttttggagtgaattcttcaattttctccattatcttttatttttattacttttattgctttatttgccttgactggttgttctgggcattcttgttaagtgtgtatgctttgtgatcttatcttttaaagaagttcatggtgaatttctcatctgttgtcacaagtcatcttcaatctactcttagctattttaacttctgcttaatttggatcactaaacaagtactccaatgtttgtagaatagctttttttctgattggctaaattgtgattgggcatgtgtccagttcaaagaaaagagaacctagtttaaacatatgttgatgagatttactatacaatgaaatgctgcaatcctcgcaggataaccagcatgatccatgccattccaagtttggtgctcccagtcgatgttcagaagtggaaccccaaaataaactgacaaatatttccttgcctgatgctcattatgatggtcatgacactgcagcacattctggacaatcatcttatccagttatgcaatttacacttgctgatcttagaagaagaagaaggcatagttttatgatatcacatgcaaaaaaaggaagttttcctgagaaatcaacaaggtagcacttgaaactatttttatagaaaagttatgttttcaccaggcgctgggctttatgaattactagtttatttttcctacctaggtgttataaagctgcgacactggataactatgtaccagataacgaggagggaaaatcgaattctttagctgcagccaccagcgagttagataagcttttcagtaaagatgactttggagaaatggaggtgcttgacttaacttcaaatttgaatattatcagttttctaaggttccttgtgagattatactgctaatatactgtcaatgaaagaacacttgttatccaagtgataatgttgcttattttccctgcgcgagtgttttcctttttgtcgtttaagtgctatttcaaaaagaactcttttatagatatatactcagtagctcagtgcttcggaggaaccccaatgacttttgtcaatcatgaaaataaagtgtaccaatacattttggttctttagtgggaccagccagctatataactgttatttgttgtataattttggtgctttgatagcttgcttctgttcatggccctatcaagtacgataggtcgtgtgattcttgcaagttcctcgcaagacatnatgtgccttttgttaattttatctgaaagcattttattattgtgaacatttgttttttacttgagtggtgtgatttcattgttctaaataggatgaaatattaaaaaaagtgctgtatgaattctatatttctatttgcagtactttgctaaagaagtttatgaacactaaataactagtacaccttcaggttgttgggcagtttaatcttggttttatcattggaaagctggaccaggacctatttattgttgatcaggtatctctctatagtctatacatattctattaattgatgtcatagtattgtataaacccctggatatctgggttgcaccttcaagataccttatgtagtcatgtctggtgattaatgtttttttcttcttactagcatgctgctgatgagaagtacaactttgagaacctttcacagtcaacaactttaaacatacagcctctccttcagtgagtaagcaaaacttatcatttccatctgttattttggtacattgaactcattcagtacctattaaatggtagggtgttttgtggtttgtattcagaatgttgaaatcaggtttattattaccttttgttatgtatctctggtactgtatatctgattgtattcaaatacagaccactgagacttgacctatcaccagaggaagaagttatcgtttctatgaacatgagcactatcaggtattacatttattgcgtattacaactcagttctgtctactaccttcggtcacaaatatttgactgacatttaggacaagatttttcaaacttttgaaattctgacattgataatttctcaaatgcttagtgtaaaaacaaaagaaatggtgtacgcagatttgcctcaaaaagtactactatcataataccataaacttattagattttatgaacctattctagtcatataaaattgacggttggaatataaaaagtttaaccaaatcttgtccttagcatcaaatattatgaccagaggaagtaattaacatgtcggtcagtcaattgtttcccacttagtgcataacacctggaatcatgcacgatttgtttttttctcactcaacaatactccctccatcccaaaatataaggcacaactaccactaacgcataaacccaatgggatcactccaataaatacaatgcatgcacccaatgggattagagattttaagggtgggtgattttttttttaaaaaaaaagaaataaagaggagagggatgtgctagttaattgcatgcatgcatgcatatgcatgcctaatattatgaaacatcgaaaaaaaggtggttgtgccttatattatgaatggagtgagtagttgataattaagagtgagcaaagctttacttgctattttttttatctgtcagaaagaacggttttgttttagcagaagatctgcatgcttcaccttgcaaccgctattttataaaagccgttcccttcagcaagaatattacatttggtgctcaaggtatcacttattctcatgtctgaaatgtacatttttatgtgcgttgaaaagtggtttaattctaatttcccttgatttagatgtgaaggagttaatctccatgcttgctgacagtcaaggtgactgttcaataatcagcagttacaagctcgacagaactgattctatttgtccttcaagggttcgtgctatgttggcttcgagggcttgccgaatgtctaccatgataggtgatccattgacaaaaactgagatgaagaaggtaaccacagatcaaattgttttttaaggataatttttggagtaaattagctttcgatgaagtaacctccaaatgagctcctataaaagaagtgcaaaccttgtatggtttctgtctattcagaaatttaatgtcatgatttagttgtgatcagtgctcactactccctagaaacaattattcctttatatttaagaacctaactcaatgaagccctcttgcatttgcactccagatacttaagaatctaactcgatggagcatttttcttttgcacttcagatacttaagaatttgacaggattgaggtccccttggaattgccctcatgggaggccaacaatgcgccatctagcagatctccatgctataaaaactgaaggtaagagattgtcggccaacactcatattctctagtttacatgcttgtatatgtctcatctatatctgaagaaaaagagtgaagttttcttgtttcattgcaactccaagtagttcgagtcattatcatctgcaaatgtattgttctaagttctaaacattgtagacaaggttgtatcagatcatcactgttgtaatttcttgaataaacaaaccactcttctattttttcactgaaacaacaagattgaaatgtgttgccaagttcattgtgttacaaaaaccttctagtgtaaaaaaaaccccactaggtttcagaaattacgtcagtcagaagctcacaatcgtttctgtattttttgcgttctattcttttttttttcacaaaaagtggcatgattaatactcttaaggattttagtggcaactcccttgaattatccagtttacagatctcatttcagtgttgcaaaatctcgcaggatcgaaggcaactttctcatgatgtctggcagagtttaggttgggtttatgatggatgctcttgcctttgcgctgctaccattccaaggaaattaggcgctccatggccaacattccttgatgtgtatagatgccagtctctcccacctgtttgagagcctgtgtgacctattcgtgtactaacttacatatgtgatacatacatgacatgcgtgatagtggagaaccttgtttctaagccttcgaaatgggatgcatctccttgcccactagaatccttttgctcggagactaatgccggaagcgaaatactccaacacctttgcaaggatgacgagcaacaaaggtgacatcaggttatcagggaaagctatctggggaaacataaactgatgcatgtgcttacctttattgtgtggttaaaatccagacaagatgtaacttaggtacttgtgttgaaaatgcctcgagtttctgagttgtatgcaacaaagctcttggctgtatttagttgcaggcttgcatttttaacgccttaccttatctataaacagtagacacttgctctcagggtatggattaccctgtgctatttatattatctttttgagcctggaacggctggtagatcatagagaaaatgttgttggaatcagatgccggaaattggctctgctgtccctagatcatacagagagatgagcagactagtcactgctctggttgtttcgtttgctttgcatagaagctactacaatactgtagccgtaagcaacgttgcagtacagctttcctgcgctgaagaaactactagactgtttacatccgtagcataaattctgcagataattttgtctcttgttgagctcactccagcagtctagcttactgatatttgatccaggaattctgtccctgagttgactttagtttatttcaccgttctagaaactggcgataagtataaggccctctttgtttgtttaggattataagccaacttataagtcaaaaagtctaagactaaataaacaagcagcttttttgtttggcttttttaagccataagccactcttacactattaagccaaaagctaggttggagaagcttttttggcttatataagatagatgtatgactccaccactaaacttaggacattaaatttactggcttataaatcatataagccaataaactgacttaaaagtctaagccaataagtctaagcctaaataaagagagcctaagagcctttttggttcccatattacctaataagtcaaaacggtttattatgaaaaaaataaattatagataaaactttatatatttcctcgtaagcaaatgctaaaaggaaattacgttagaaatatcttaaattcaattttaaaaattcaaattctgacttttgtttgacttattacgtcaattgatggggctccagaggtttgagtactagcagtacactgtttttctagctttggatagagaaaccttgagcttcataacagcgtgatgccttttgcagctttcttagcgacatctttacgaagttgcttgattccaatcacaaaaacgatagagccataatgttataaaacctcctaaatttcaaagactacctatttatttatgcaacaattttaatccctcgtaccaaaattttgccctttttttccctctaaaacctcttagtatatttttaaggtaaaatagcatacgggaaataaatattgcttatgtgttcttttgtgttgaataaaatgaaacaataaatgaatgatttgtgaaattattcgaatgtgcaaatgaacgaaatcaactattactaagttaaaaagaatatgttctaaaaaggtttttcaagacctggaaagtttttttatttttaaataggagttcacgaaacatgcatacacactcgtctcaaaaataagtttatttttcactcctcctacacatatcaatataaaacaaaaaaatcaggatacagtcactttctcaaatcccaaaatatagttattactctctttatctattgccaatacattttttacttttacaaactgatacataatgattaaaaaaaacttaatttactacatattggggagcaaaaatgaacttatttaaaaaataacgcattgaaaaaacataaggtgtatatataatctatgggcatgtttagttggtaaaatgaaaattttttggtgtcacatcggacgtttgaccggatgtctgaaggggttttcggacacgaatgaaaacactaatttcataactcgcctggaaaccgtgagacgaatcttttaagcctaattaatccgtcattagcacatgtgggttactgtagcacttatggctaatcatggcctaattaggctcaaaagattcgtctcgcaatttacatgcaaattgtgcaattaatttttctttttatttaatgcttcatatatgtatccaaggatttgatgtgatgtttttttgaaaaattttcggggaactaaacaggccctatatattcatccgttaggtagaaaagacacaggtgaatttctacacagttccaacacgcattaaaagaaaaacaaagaaagaaagaagaaaaaaaccggccattcttgtagtacctctccaagagcttcttcggttcttcctcccgtgtgccacccgcttgccccttcaccgcgccacacgtacactaaccaacaccggccaggatccgacgcgacgcctttggaaactggaatatccccccacccgtaaccgtctcctccccagctccaaccatttctcccgtcctcctcctcctccgccccgacctcgctcgcccgcccgcccgcctccgcctccgccaatggcgacctccacgcgggcgttgctcctcctccccctcctcctcctcttcctcctctcccgctccctctccctccgcgccgatcccggcgccgccgtgtccaggatcgccttcggctcctgcgccaaccagagcgcgccccaggtgctcgacgaaatgcgcccccccttcgccaccctgatctcggatcaatgatctgatgggatttgtgtctgtgtgtgtgtgtgtgtgtgcgtgcagcccgtgtgggaggccgtcgtggggttcgacccgcaggtgttcatctggctcggggacaacgtgtacggcgacaacaagaggccgttccgggtgttcgggagggagaggacggtggggccgtggaggaacgtgccgcggttctacccgtcgacggaggccgagctgcggaggcgctacgagatggccaaggccaagcccgggtacgccaagctcagggagagggctcaggtgaaagcttgtgcaagactcgctgccgctctttctttgttttttgttttttttttgctgcattggtaattgcgcgttgaaacctcgagctttgtgtctggtgctcgtgatgacatgtgggatcttgtcaccggtgttttacaaacaagtataggtgctcatttctcccatgagtccacgtccttgatcatacaggcgcaggagaattaatgaatcacttccatgctagaaaggatcataagatccaactgaggatgaatggcaaacaagagtgcttgttcattttgttacttttatcatgtttgggacagtttctgtatcatccaaactgagattttgcgacattgttatcatttccaattttaacagctcctcttttaaaaatttagtggttggaaacactatgtcaatatcatatcattcactaaattttgcaggttattggaacatgggatgatcacgattatggactgaatgatgcaggaaaagagtttggtgggaaggtgacctctcaaaggcttctattagattttctggatgaagctgaagatagttcacggtatgtacttgggaatatttgaactgatttttattttcctaatgttcatttgttatgttgtcatttatttatattattgtattctaaaattgcctttattcttcttattgtgttaaatttctttctttcttttttgtttttttttccacaacatatatgaacatacctgtgtaggttctacggtctgaatacatagttgtaaaccatcagaaatctcatagcgctctctttcttgtttatttaggaggcagcaagctggtgtttatgcctcctacatgtttggccctgaaggaaaacgggtaaaggtaaagttatatcgtgtccaattttttctgccaattttgtttttcttggaaaccccttgttcaagcaagcatccccatgcatgaatgtatcagttctcctttccatatgtggcatgttcccctgttaaccttatgatttgcaaccatgttacatatcaatctcctagatcacactgtgaattctgcacttgccattcttgttctggattacaaagtgccctgtgctgcaacttcttgttaatcagtagtctttggtttgttgtttcagctccttaaatggaattcatagcatcttttaaaatgtggtagtatgtgatatcaaggtttacagcaacttggtactatgtgaatactgaatacagatgtatattgtgtctaggtgatatttgttttcctatacatacaaatttaatgttgggtgaaactattcagttcaaatccatatagtgacgcaccacaacaaatatataactagtacatgagttgagaagtttcacccatttgcagaactggttgcaggcactgctccattgttactttacatgtattaaaagatagccatacattactataggtaattctgttggacaccagatatcacagagaccctctatcaagtgatggagctgtactgggagatcctcagtggcaatggctggagagggaactgcatggtcctcgatcagagatcaccatcattggatcttcaatacaagtaagatattgtctgccttgtcctaattgaaagagcggatctagaatactggctaaaaaatggatctgccagagaacaatgagtaatcatagtgaatgccataaactaacatcatacataaagaaaactggcaatatgataaaacttgttatcttgtctggggtttgcaaacatagccagctgtccatcttggacaatttcgtggcagatgatagtatcccaattcccagctaaagttatgtatcatttgttacatagataatttttgataaaatcttcgatctatagttgctttcgattgaatagttgtaacaatactatttttcacctctttgtatttatgttttgcctttgattcttcatcttgcatgtgatagaattgtttcaaaataatacaattttcttcctatgcactgcaggtaatatcaaatctatctgccaccactggacctttgttctatgtggagtcatgggcacgctttccaagggaaagagaacgactgttcagactgatcgatagcagtaaggttgcttactttactttcctatgcagacaagctattccttgattctaatctttactgaaaactcagttctcctttacctgtgctaaagtaaaattcattgatttagtagtagctggcgtacttcctgcattatttttagaaacatttttttatcaacaattcacaatatatggcctatgtagaatgcgaaaagaaaaaaaaattctcctggcaagcaggtgcccttttcttgtaatacactgtgaagtttagttaccttttctcttctatatagctgtgttaaatttttttctttttgcgatctatcaatagacaatactccctccgtcccagattataggacggcctcttttcaaggaaaatcaaaatcggtaaattttgactaacaatcatactaaccatatatatgctaagtattatgcatgttatatcactagatttatattttaaagtact

SEQ ID NO: 31313 - DNA, 1105 bp, Oryza sativa
caatgctagaaagtcttataatatgaaacggatgaagtacataacaattgctcttgaaatcatccagtttcacggtctatttacgaattatttttgtgagatctagtttgtgttgatatatttcttgttttttttttgttctgtagttcttgtcatagccgtggtgttgctaggaattacctgcttatcagctgctaatattttcaccaagaaatccaagatggaatagccataaggtacagaggacagaagcagacacttcagtctaactacagatggaaaagctgatcacaccgtccatggacgttccagtgcctagaacaaccatgagatttcaataccaatataacccattgcgcagcctgttacgcatcacaagttttatgaatgtaactaacaatctgtatacgtgtatagcatgtttagaaatttctcatgtcaatttcgttgctttatggtgaataggatgactgttgtctattctctgacccctcttacatcattgaagtaggctccgtttgaacatgcatctgtttctgtttgaacattgaagatcattcgttttgtccgtttagaaagacatgaaagagctggtagcctggcatgtcgtccggcttcaaatctcaaatcccatagtgatgtctattatcgtcttctgcgaaagtggagaaccgaaagtgtggaacacgttatcatgtcgtaacagacagaagcagcctttgctcgctgacttgtgctcgtctgcatttggagcacacggattcagtgcccagacagcgagtgctaactggtcagtacgcggcgccaataaggctgtgtttagatataaagtttggatctaaacttcagttcttttccatcacattaatctgtcatacacacataatttttcagtcacatcatcttcaatttcaaccaaaatccaaactttacactgaactaaacacagcctaattcggttcattcgcccgcgacagagcacatcatcaagtcgatgccgtggacacccatcactctccatcagacgacgtgaacaaaccgtcgacggcaccacgcacgcgcagggcagtatggcggcgaagatcccggtgatcgacctacggct

SEQ ID NO: 31314 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnnaatcttgttgagcctgatgattcatccgctggcctgggaatgaagcaaatagaaacggtgagatcaatatgttatgctctacattttgttaaattaattgaatctgagttgaatttagtacggaaacaatttacacttgcaagttactaaactatacattctagggatctgaggttgcaaaaattatcttcacttcttcaggctacaaaatatttttgcaatgttgttatgctacaaaatatcattgtgatattgtaccaaaagaacaaatttaaagcaaaaccacaaaagaagattaggatcaaagacaagtacctgctagttccaagagctcaagctggaactcggaagcaaggcaatcgaattggtggcccgcacttgagattgatgttgtgtcgcctaatgcactgcgtggtgctcgagctcgccggcgaggtcccgatctgctcgcccgtcgcttgtgctcggctgcaagggaccaaatcagccgccgccggcaaccccatgaagctagcttacctccgtaccatagctgatggctcagaattaaacggagacttaacgccatgcgtgtgacggaggcgcagggttgtggaggcccactagaaaatacgaaaccaataagcgattgacatctggcaagaaacaaggatgggaaca

SEQ ID NO: 31315 - DNA, 582 bp, Oryza sativa
actctaaatgatcccccttcctatcttgggcaagtcattttttttatggagaaaaggtactttattaatggacatttttttatccttttttttttgcagatcatgtatatatctaccatgggccatgcagactggaagcccatgcagtttttgtgtttcgcctatttctatcgaatacttgacaaactgaaggctaccgagtcagctagcactcctatatacaatgtgaggcggtttactaaataattttatttgctgttcccttttcattttctatggaatccctgcacttacaggaatgacatatcaaataatcaaattgggtcagcttgctttactctatcgcagctcagatatgataagagcaaaaggttcactagggaaatggagctattagatgggatggaattcttacttttcatgagttgggaatgcatatatttgatatatgtggctccttttttagttacaaagttacataaacgcatgcttgtcttgtattaaggatcttagattacttggacactagtttttagctttgcagttcagcccgacagaatcacagaagaagcctagctaatg

SEQ ID NO: 31316 - DNA, 2086 bp, Oryza sativa
gtatagtagtagcagtagaggtagcagatagtttactgtagcaccatattgtcaaatcataaactaattaggtttaaaaagtttgtctcgcaatttacacgcaaactgtacaattagttttttttgtctatgtttaatactatacacgggaactaaactaggcctaaaagttttttacctaaaaagacagtagttgaaaggcctaactaccgtagcaaacaaaattgacagataaacttaaaaaaacccgtatagaatctaacaaattacgccactcatatagtagaataaaaagatccttgactaccaactctaagaaaggtaacactattgtgcgtaatatcatgctccttctaccataacatcatacatcaatattgaagctagatgaaagatatgaagataacctatgtgagattaaacaacttttttttattgaaaaccttatcatttcagtaatgtcaaaattgacaaacaaagtacactaaccctgaataaaacctttttcaagcgtctaggcactcctcagagcccgttatcaaaaaaatttctggtgcttcgagaaggagtgatatcctatatatcgatccctactaagcatagttaatgctatttcttttttctctaaattaagtctaatcaccttaattgtttttatcccttggatggttgatttaggtctaaattatctccccctttttcttttgttataaaatcatatcaccttagttttgtttttatgattaatttgtattaccttgtttcttttccttttaaacgatcaattcatatgtgatttaaattgttataaaatacatcatcaaatggtttatatatagtttttttttcaatagtcgatcagagataaaaattatacaaagtgtatagatattttttcaatagtcgatcaaagtcctaaccacatatatatctcccattaattgccatgtcggaaagattcataccgtgaaaattgatcttaatttcgacccagagtgtaggtcgcgtcgtgccattccaactgatctcagacccgagcccgatcgcgtgctcgggccgaacggctcatttgaccattttccatctatagctgttagccacaataacgtattccctacaatcgtaaatattagacgtttacagggttaaacttctaaaatattgatcatcattttctactagaatatgttactctaataggttcatgatattatgtatgtgaattttaaggcattttaaatattgtattgacgcaagtgtagattatacgtaaggcatttttaaccattcgagatgttgttgatgatggaatttaaagatattgatctgatcttattttaaacatcaaataattttcattagagggattaatgactatatatgtcacgctatacgttatattttgctaaactccctccataagcactgcattaattcaagccatcaaacctagagagacactctccacccacacccccatggcatccattccactcctgcggctgctgctccctctccctcttcgggagcacctctggccaagccaccaccggccaaacgatgccggcgtcggagccggcgatctccacctgatcttcgttgtacctggggttggctgcagcaacctggaggcacggctcaccgaggcgtaccggccgtcggtgcagccgagctgcggcgcgctgaaagggaagggttggttcgggctgtgggacaacagctcggacctttcgacgtaccactacggcgactgcttcaaggagcagatgagcctcgtctacgatcccgtcagcaacgactatcggaacctccccggcgttgagacccgcgtggccaacttcggcattgcgagagggttccactcgaagaacactttacacccgtaatatattcatattatatgttgttttaacattttcttatttgatttaaattaattttgatcaaactatagaaattatagctgcatttctaacacaaaacaagcatattattaaattattctgaatattagttttaatgaaactaatttggtgtttgatagatttttttataaatattcaatcacatcaatctgctgatgatg

SEQ ID NO: 31317 - DNA, 1201 bp, Oryza sativa
aaactaaaaccgccaaaaataagccatccgtgctggcgtgtaacaacaacgggaagcgataatccctcagagtgttatccaccggtatgtatacatcagtgactatgtgtgccgaatcttcttaccaactgtaacaccccgaattccatataaccgatgagaactgttttgaggaaatcctatgttcaaaactgtattcctttgtgtgtattaagtatctggttctcagggttatagatacccacatacctaacagtagttgactaaatctcgacaggacccaccacataccatgtcttatacggaaacaaccttcggatataggagtagttccgcataaggaaggatgaataaagttctacatggaaacgacaaggactactcggattgtatctatattggtttccctagctctacttggacaaggggacacctataggtataaatacaaggcctcctaggaggagaggggacacggaacaatagatcaagacacaagagcaacatacgccaagacaagccgccggatatcgacatcggagataagcctatttagtccccatacggttcctacgactactgtcaggagggatctagcgctatctctgatctcaccggatgcggattcgaggaggaagactaccctgttgtcgactacgagtcagcacttcagaccgccaagtcgacaacagttagataggctaccccaaatattgtactggtgtgattatagtgaataagagcaacgaccgacttcggccaacaggagtagggttattacctgacaattcaggggcccgaacctgtataaaaatcctcatcctatctcttttactacaatctcgcatatatcctaataccaacgatctccatactatgcaaataccagaatcgcgacatcaaacatcaacactagtttcaagagctcaaatcaaaacaatcgttgtagcccgaaaatctcactctaaagtcctccctaaaataaaatctcgatgtcaaattcaaatcctatcttaaacccttctccacaaattctttcaaatttccgatatatcaaaattcactgaaatcaggaaatctcctttgcaaccatgtaggttgtcaagattttccaataataaattaaattctaatatctctccatttcatgtctttttccaaatttattcaaataattctaaatagcgaaccattccaaaag

SEQ ID NO: 31318 - DNA, 2800 bp, Oryza sativa
ccatgtaggttgtcaagattttccaataataaattaaattctaatatctctccatttcatgtctttttccaaatttattcaaataattctaaatagcgaaccattccaaaagttccttgaaattcttctatttccctctcatctgtcaccttttcttaaatctactcaaatacatttcaaaaaccacaaaatctcattaatccctcccctttgaaaatgaaccaaattaatccaaagaacatctaaatttaattcaagactcaaacctcatatgaaatataccaaaactcaagcaaacatccttcactagaattcctataatatgtgcaaatttgtgcatcaaattagattccaatattgtagcgcccgttccatcgtggcgcctagtgggaaaattaaatcttaaaaaacctaattgcgaaatatgtttctttgattgttgtcaagtatccgtgcctttcccgatcttcatttcccaatctatcgtcgaattcggtttccaattcaaatcatcttccaaatcagatcctcccgcaaaagtctattttgcctccctcgggttcgtgggccgatttcttctccccttggcccatttccctctcagcccgcttcctctctcccttcccgcacgtgctgtgcacgagcaccatccgagagagagagctcatataaactgcgatatttatataaatactgaacatcaacacaatttgtaatatcttactttggccagtaaatatataaatttaaactattttaaaagacatttataaactgcgatatttagtttcacaataaatacagtaacacgaatcgttcttacatcatcaactattttttccccaaaactaaaaatgtttgattgtagtataactttaaaagtgcttatatctgtagagagtgtactacagatccaccgtcgcattctaaggaactacgggagtactgatgtaatattgcacgggctagttaaatgggatttgttaaacaacaacttattagctcctattttcatatgtatatatatgccatagatattagaagttctaatggatttaatatacaacttctttattttttttatttatagatactgttgtactttgtatacatgttactgttatcaatctagttccatgaccatacggcttagagattttccattaatactagtatacgaggtcgtgtattcctgcgaatatagccatcacgttatcctgtaatataccgtgtataagaaaattcattaatttaatatgtaactgaaaaatatattgtaaaggatgcataggtaatgttgggagacgactccgcgtcggacgtccgatattccaccaaatatcggacacccgactgtttacgcgtcatcacaccacctatgtatacagcatgcaaaaaagaaatcagtcagtcaaatgttccagttaactaacgagtgaaacatcaagttatataggttgaaacaaaaaatcatcaactgaaacatttaaaaagtttatgaaacatggtgaaaatacacgttgagacatatcactatcacatatgaaacaactaatgttaatggattgaaacatatgtttttctttcatcaaaatataatcatgtgatatcttgttgtaaaaatttaattacaaagaatacaacggtgtgatcggatagattggataattagtttaagagaaaaatcgttttgaaactagctaaaatgcatgcatgcatgcatgcatgaggtggagagagagagaggagagagagtagtaacagtttagttttgtgaaacatgctgaagacacgtattgaaacatatccctatcacgtatgaaacaaaagtgttaatggattgaaacatataattagtttttatcagaatataatcatgtgacatcttgttgtaaagatttaattacaacgaatacaacggtgtgattggattgtagattagataagtaatttacgagaaaatttgttttaaatatcgttaaaggtgcatgttataggcttggataggtgtatgtgtgtcacaggctgtatgtccgatttttcaccttgcttcggacgttcgaggagaagcgttttccgtaatgttgccctattgccgaggttgggctattacattgaagatgttctaatttttcttatgatatgtcttagttacaacgatcgatacaaatattatcattgttatggttatacatgtgaaacgtatattgttattgatgtttttttcacccattgcaatgcatggctaattttgctagttaaacatgatgatctccttgcatttattgatttctaaagagtgacaaaagcctgaaaaccagttatttttcaccctcaactatcgataccagatgaaaaaaccaccgagcacctttgcaagctgttttggtctacgtggcagcccaatcagcaattcttttctttttaaatcagcgggcccctctcttctacccctcacctctctatctatctccaaaatactctctcttctccctccctcaccaactaacctcgaggacggtggcgggcagaactcgaggtgacgaagggggcggcagagctcagaacgatggcagtcggagtgggcggcggcgaagagggcgtgtgcagccaccggcgctcgggacagcggtgaggttggagtgggcggcagcgtagcggatgcgatagcacatgcagagctccaacccatttgtcatcgcgctgtccagccccacccatgacaccctcttccctggcggcgaaggtacggcagtggaggcgagctttcattatcggccagatccagccaatgtggctc

SEQ ID NO: 31319 - DNA, 7602 bp, Oryza sativa
catgccaggcgcgcttgccaacctcttcgccggtcatgccgccagtcacgccgctctcgcctccacctccatgcttcgcgctctcgcgccctacctacatggtgagcgtgagcgtgtgcgggagagcgtgccggccgcttctgccacgtggttcagaaggggagggagaagagagaggggggggtgaggatctgacaagtaggccctagctttgttaaaaaatgtttgttgactgcactaccacatatgctattcgaaccctaaaccgctctcaatagtactggggggtttgtctggtttttgagtttaaggggtaattcagtcgactgttgtagtttaggggataattcgtacttttccctttagaatttactcagattttgagaatctaaagttgtggaatccagaaaataaactaaaagtcagaaactggaaaagccaacttttccagattttcacctgctagattctctccgtctgcttctcagaatcttaaactcgcccaaacatgacctaaatatcatgccacaatgacaaaagtgacgcaatattagatatcacctctccaataatagttgtataattgggcaattggagaatcgaagagtggcagcttaattataagagtgttaacttacatgagtggcaaatagtcaaatgtcccaaaacttttgcggtattgttcggtggaattcctacgaggctatactgtagtatcaagcggagggcgaagaattatatgcaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatgaccatataacaaacagacgatgatggttagactaagtacagtgtggaggatggataccgccacacttgttgtactcctgtacttgtaacatcattttctcgtaacagagaagcagatcgatcatgctccacctaccacaattccgtgaaaaaaaaagataggctagtcataacttctgaatattacgtctaagaatgagactttgattaaccatttgaaattcaaccaccaatctattatagtatttaaacagccttagaagcatcgcgtttattatgtaggctaaaaatagaaatataatttataaataaataaaattcagaataaaataaagaatattaaaagaataatccatgttgcgaagatgttacggtttgtttttgctggcggcacacttaatacaccgtcagcgaagatggcagatcttcattggcggtcgtctattttacatgcggtccacttacacaaccgcttctaaaaaataacttttcactacctacacagctgccccaaaaaaaatttacttcgcgctataaaaaaaaccctctcgaccccttatccttatcccttcactccacaccactcatcccttcctcccatcttctctcgagcgctgcagaggggaacgagacgtgccggaggggcgcggccgacggttccggtggcgggaggaaccttggacaatgatagcgagtggttggcgaggctcccggtggctggccggcggccgaactcgggcttttggtctgaaaccaaggagtataacgtatagcgatcaaaaacatttttacccattgcacggacattttctctagtgactccatccacaaacatgcaagttacaactaaaattctacacgtcacaccaaaaaacaaaattgaccgtgaatatattaactatttgttttttggttgtgagatgttaaatttgaacatacatattttatggagtgatatatcacatattaatacatcttctcaacttttctcaaattatttcataaccttttaaattgacatacaaacaaatttccctcagagtttaaaatagtttcccatacacatgcatagccaactcttgaacagagaaagaatcataagtacttcttacgagactaagtttggatccagggacttaactttagtccctacatttagacactaatttagagtattaaatatagactgcttacaaaactaattatataaatgaaagctaattcgtgagacaaattttttaagcctaattaattagagaatgtttactatagcatcacataggctaatcatggattaattaggctcaatagattcgtctcgcaaattagttcaagattatgtatggattttattaatagtctacgtttaatatttataattagtgtccaaacatccgatgtaatagggacttaaaagttttagtcccatctaaacagggtctaattattattttttggtagcctacagagagggtattgctttggaaagctcagagactggctagaagaattgagataccgtgacggggacaccttgttcggagctccttacgatttccgctacgccccgccggtccctggccaaacctccgaggtgtactctcgctactttgacgagctcatggcgcccgtcgaggcggcgaccaagaagaagcggaagaaggccgtcatcgtggggcacagctacggagggatggtcgcggtcgagttcattccgagcaccccacgggcgtggcaaggcgagcacatcgagcgcctcatcctggtcgcgcctacgctcccatatgggttcctaggctcggtggggtcgagttcgatcctcctcctgactgccacatccacggcgcggtccgtgaggcccatgtggaggagcttcgagtccgccatggcgaacttcccgtccccggctgtgttcggccgcgagccgctcgtgatcaccaagaagaggaactactccgcgtacgtaatggaggatttcctagccgccggttgaggcatttgtatccgcgcggggggggggggggggggggcgaaatccccaaattgcggaaattgtccgaaattgcttaaaaattgagcaaaatttagttgaatttgaacaaatattacccaaattcatgaaaaaaatgaaaaaatgaaaaatttcggccgaaataatattgtatcaggggtgacggaaatgaccgacatttccaaccctgagccgccctcggcttcggcgagcgcgtcgagcctttcaggcgacgggctgtcaccaggatgtacagcttcgaggcgccgatggtgcccatgacgtgcatcaacgcggtgggcaacaagacgccgttgcaactggtgttgtgggacgatgacgacgacttggacgcaccaccggaggtggcagcgtatggcgacggagacggcgagatcaacctgtatcagcatgttggcgtttgacagggagatgggtcggcagccaggacaggagaagcgattcaaatccgtcaagatatagctaatgctaaccattccacgattgccatttatgattttgcactaaagaggatcattcaagaaattattgaggtgaatcaggtacattagtagatattcacgtacgtgatgcgcgataatcgtatatgtatcacgcgtggaattctgtgtaataaatgaatcccctggtttgtgtataccgatgggatggttgatagataaaaaccaaaaaatattgctctacttgtttcagggtagtggaaatatattgcatcccggcctttgttatccggcatataacggtgtttagattcaggggtgtaaagttttggcgtgtcacatcggatatacggacacatatttgaatattaaacgttgactaataacaaaattaattaattacagatccccctttaaactgcgagacaaatttattaagcttaattaatccgtcattagtaaatgtttactgtagcaccatattgtcaaatcatgtactaattaggtttaaaaaacttgtctcgcaatttacatggaaactgtataactagtttttttttctatgtttaatactccatacaagtgtccaaacattcgatctaacatggtgtaaaatttttgcctgcgaactaaacagggcctaaaacttttttacctaaaaagacagttgttgaaaggctaaatcctaactaccgtagcaaacaaaattgacggataaacttaaaaaaacccatatagattctaacatattacgccactcatacagtagaataaaaagatccctgactaccaactctaagaaaagtaacactattgtgtgtaatatcatactccttctaccataacatcatacaccaatattgaagctagctgaaagatatggagatagcctgtgtgggattaaacaactttttttattaaaaaccttatcatttcagtaatgtcaaaattgaccaacaaagcacactagccctgaataaaacctttttcaagcgtctaggcacttctcggagccagttataaaaaaaaaattctggtgcttcaagaaggagtgatatcctatatatttataaagttcatccctactaaatatagttaatgctatttttttctctaattaagtcaaatcatcttaaatattttgagcccttggatggttgatctagggtctaaattatctcccccttttcttctgttataaaatcatatcaccttagtttttttttatgattaatttgtcttaccttgtttcttttccttttaaacgatcaattcatatgtgatttaaattgttataaaacacatcatcaaatggtttatatatagttttttttaatagtcgatcagagatgaaaattatatatttttttaatagtcgatcaaagtcctaaccacatatatatatatatgtcccgttaattggcatgtcggaaagattcataccgtgaaaattgatcttaatttccctctcattaagccaacctaaaattgagatgtgcctactaatgagacattgaagtgaggtttaccaaaagaaatatagtacatatgtacacttctcccaattaaggaggcagtgaccagcgctatcattatcaacttgggatgcggcttccctgttcctaatttttgttcccatccctgtttcttgccagatgtcaatcgcttattggtttcgtattttctagtgggcctccacacccttgcgcctccgtcacacgcatggcgttaagtctccgtttaattctgagccatcagctatggtacggaggtaagctagcttcatggggttgccggcggcggctgatttggtcccttgcagccgagcacaagcgacgggcgagcagatcggcgacctcgccggcgagctcgagcaccacgcagtgcattaggcgacacaacatcaatctcaagtgcgggccaccaattcgattgccttgcttccgagttccagcttgagctcttggaactagcaggtacttgtctttgatcctaatcttcttttgtggttttgctttaaatttgttcttttggtacaatatcacaatgatattttgtagcataacaacattgcaaaaatattttgtagcctgaagaagtgaagataatttttgcaacctcagatccgtagaatgtatagtttagtaacttgcaagtgtaaattgtttccgtactaaattcaactcagattcaattaatttaacaaaatgtagagcataacatattgatcttaccgtttctatttgcttcattcccaggccagcggatgaatcatcaggctcaacaagatttgtgaatgacgtcgttgcagcagatgtattgtccaagaacatgggacttgctcctgcatcatgcagttgtgatgcctttgatggaggtatcatgctgttgtttagcatagcaccaagatctggcgtcgatgccggtgcttgataagagagattaatttatcaagatgctaatgcatgtttagatgtgagttgtttggatgctggaggatttaacgggagaactgagacaaatggcgccataattctttttcccgccagcaattctatctatttggcgcctaaaatatgttagtaaagttaatggtgttgtttgtaagtattaaacggagatgtaatgccgttcgtgaaacagaggcgcaagggtgtggaggcccactagaaaatacgataccaataagcgattgacatctggcaaggaacagggatgggaacatgaattagggacagggaagccgcatccatccacttgacgaggatgacaaataacaagcagatccacggtaagccacaaatcctaccaaccgcaattaggtgccaagttataaggaaaccaatattggacaagtatatatatgcttgttagtatagttagccaaaaggctcgggacccgacagccgacccaagcatggcacggttcgacaggtgtcgggcccgtgttggcccggcctgacctttggaccatgcctaggcttttgccacagcacgatgggtcggccaggcacggagcaaaatagacaagggagctataatagacttattcaagcaatataaagcaaaatagacttattctccaaccatataagagacggccaaaagatataggggatgcaaaatagacttaatccagccatataagacagcccaaagagatgagggaggtaaaaaagacttttttctagaagagcacgatgggatttcatgcctttaggtcagtccggtacggcccgagtcttattgtgccttgcctgccccgttggtgcagcaagtgggtggactcggtccgaccaagagtatagtgtaggtcatgtcgtgccgttccgactgatcttggacctgagcccggttgtaatcgggccagatagctcatttgaccatcttccatctatagctgttagccacaataacgtattcccgacaatcataaatattagatgtttacaaggttaaatttctaaaatattgctcatcattttctactagaatatgctactctaataggttcatgatattatgtaagtaaattttaaggcattttaaatattgtgctgacgcagtgcagattatacgtaaggcatttttaaccattcgagatgtggttgttgatggaatttaagcatattgatctaatcttattttaaaaatcaaataattttcataatggggattaatgactatatatgtcatgccacgttatattttgctaaactatctctatataagcactgcattaattcaagccatcaaacctagagagacactctccacccacacccccatggcatccattccactcctgcggctgctgctcctgctgctccctctcccccttcaggagcacctctggccaagccaccacaggccaaacgatgccggcgtcggcgccggcgagctccacccgatcttcgttgtacctggggctagctgcagcaacctggaggcgtggctcactgatgcataccagccatcggtgccgagctgtgcggcacgttgaagtggaaggggtggttcgggctgtgggagaacagctcggacctctcggcgcaccactacaacgaatgcttcaaggagcagatgagcctcgtctacgaccccgtcgcgaacgactatcggaacttccccggcatcgagactcgcgtggccaacttcggcattgtgagagggttccgctagaaaaacccttcacacccgtaatatatactacatgttttgtgataatattattacta

SEQ ID NO: 31320 - DNA, 479 bp, Oryza sativa
gggtggttcgggctgtgggagaacagctcggacctctcggcgcaccactacaacgaatgcttcaaggagcagatgagcctcgtctacgaccccgtcgcgaacgactatcggaacttccccggcatcgagactcgcgtggccaacttcggcattgtgagagggttccgctagaaaaacccttcacacccgtaatatatactacatgttttgtgataatattattactaaatttgtacttctttgataaatctgatcctaaatatgtagttttatatataatatagttcgttttatggcagttttgtgatacgccatgtttgacgaaactatcacaagacaaaatatttacgatcaaatttatcaaaggattacaaatataagacaaggaatagaagaccaccaaactacaggcgatgtactatttgtctgtagcaattattactctctccgtttcaggttataagacgttttgacttgaa

SEQ ID NO: 31321 - DNA, 1435 bp, Oryza sativa
caatgggtgtgcacactttagtagcgagtctggagtcttgaacaatgcagaggggggtctttccactaacctgatcacgaaaaaagagggagaaaaggggggaaaacatgcatattcctctttatgactcgcttcgaaaagagaattttcaaaatgaattctgcaaaatcatttcatttcgagtgtcccagacgagcctacatcgattgaacttgctatattgatctacatatgcatgccaccaaacaaacacaacagtggattccattttcgtagtatgattttccagtgacaaccaaggaactgagacttgaagagtgagaatctacgggaagatgacattagaggattgtacctgcgccttgtgccgagacgcgcccttgaggacgatgtgcctagctctagcaattcagttcgccggccacccacggctccgtccccctgccccctcctacaagtgtggctcttcggcttgctacgcccgttgctcgcccctccaccccatggccgctggtggcgaatcaccgatcacacacaccctaggactcaaaatcaagctataaccatgaccggcactaaatccggtggccggaggtggaagacgagacaaactgtggatataccaagtaatgacaaagtaaaagttcaattatgttgacagtattcagcaaatgtaagggaacatctgaaaacatgctgcagtagtgcaagcagcgagcgacctagcttccactccttccatgttgatactcaccagatcaagattcatcaaagaagaactacgagctacaactgttccatgttaatattcacaagatcacgatttcgtcaaataagaactacaagctagaactgccatccaaggagctagcaatccgccgctgcaagcaaaccagggagtgaggtcccatgtgtcaccgactcaacgcaaccctaggaggaggaggaggaggaggaggagaggaagtggacgaagcgaggagcacgatgcatcctcgaggctcttctcccctcctgcatcctcccgcttcctccgtcctgtcactgcggaaccctggagaaaagaggagaggggaagaggaagaagaagggctcacctcggatctcgagaatggaggcgcagaggcggcgtctgagggggagggagaggcctggatgagacgtcttgccggaggaggaggctcggcggcgccggcggtggcggtggctcacgagagcggcggcgccggcggtggcggtggctcacgagagcggcggcgccggcgtcgaggggaggcggcgcgaagaagcgacggaaaaaaaaaaaagaaaagaaaatcccgacctcccgagcagtgtgcttgcctacttggtaggacggcccaagtagcaattctacattgcggcccaagtagcaattcactctgcggccagcaacagtaccagcaaaatttat

SEQ ID NO: 31322 - DNA, 1223 bp, Oryza sativa
agacattttctgccctgctctcagtgagaaagcttgcatcgactggtgaaggtagtcaagaatgccttcatctgtgggaactgctcgagtgttcgatttgtgatccacgggtgggtgttaggcctggacctccagttatatgtgcatcattctgtgacatggttttcaaagcttgctcagaggcgtacttcgctatcgatgtgaaaacacaggtaaagggcatctctttaagctgtgtctaaataaaattttcttgctataccgatgtggtactttacaaggacagttgcagttgccagattatacttgctcatttcataattcatagtttgatctagataatattaggtgaaatttgatcatagataaacagttattaatcgtgcttacaccaatatacatgccacgggagtttttaagttaaagttgtggcatgttaattgcttttgtactttcttatagctacggtagctcctctctttttttattcctttgcttgcagaactgtaagtagctgtgcctctgctttcttgtgatatttttgttggatattattttgttgttcggttctgatatctcccccttgctgctttatcaggcattgtctccatgtggtttaggtgacatcctttgtggcaaagcacataaatgggtctctaatggcacagagctatgtcgctctgctggtttctctgtgcaagctttggagaccacctcgggtggagtggatgacactttctgctatggtgggaaagcaagttttgatgccatctctagttcatggacatcttcaaaagagcgtccagtattaagtgatgtggcctcttggaatcttgaagattttcgcagatgggcaagagaaatgcctgctagtgaaagagtttcatgggcaattggaggaatggttcttacagcaggccttatatttatcaggttttatatctctttcttattttcatattctaaataacaggtataggagataagtgtgactggtcggaacttgatacaatatctgaagaattggttcttttcatgcctatttcaaacaaaaatatcttatgaaagatcacacaaaactttggattatgtccgtgtgttcgtttaaacttgcaattttcttccttggctctctagcttaatgccatacacatgccatttccccctttcagatgcttgtgttgttacaaaaactaattttttgtagtttgtgcagtaaacgg

SEQ ID NO: 31323 - DNA, 722 bp, Oryza sativa
  unsure (1)..(722): unsure at all n locations
nnnnnnnnnnnnnnnnnnnnnnnnnnnnnnnnnnnnnnnttgtcgccgccgattattttcttcatcttcatgattggtggatttcgccatcaccgttgatgcgcgtctacatcttcatcgtcggtttgcttttgtcaccaccgactgttctttcgttgttgttgggcgcctacatcttcactgctagctgacctgactgttgccaactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcatatcagaagctattcatatgagctacacttggtctatattacccggaagatttattacttgggagtatggtacatgcctcattctttaaaggttgtcgaaagcatattttt

SEQ ID NO: 31324 - DNA, 499 bp, Oryza sativa
  unsure (1)..(499): unsure at all n locations
gtcgccccggtatgtatgacaaattccgatgccgctgtgccgaactctacttgtatagtgctacctccatcccaaaaatatagcaacgtatctggacatgactaatgtctaaatacgttgttttaggatgggtctcatctcatcctagattgatatattctgtgacggagggagaatatgatctttgtctggtttcgcgtacgtgttgtgagtttggcgcgcgggtgcaggcgtgaagcaacggggagctgcacaacgtgaggcaccgcgttcggtgcgtggcgggggtacagcgcgtctccatcgcgctcttcttgctggcgcccaagtacnacgtggtgcgcgccccgtaggcgttcgtgagctccgagcgaccgcgccggttcagggatttcggctacgacgactaccgacggctcaggcagtccaccggggagcacgccggcgaagccctcgcgcgattagccgcatgatgcagtaataatcaccttaaccacgg

SEQ ID NO: 31325 - DNA, 386 bp, Oryza sativa
  unsure (1)..(386): unsure at all n locations
gctgatcctgctcgccgggaggtacatggggaagcgcgtcgtgttcctcaagcagctcaagtccggcctgctcctcatcaccggtaaaccccttcccgcctctccccgtgcctgtgatactgcgatgattgattttggcttgtggctgtgccatctgggaagcttgtagtgtgcggatctatgaattgattttgtatagttgcacttcgtttgttatttagttcgggaattgtgaaatcagtacctgtagcttatgtcgatttatatctgatgcaaatgtgagatttattacccaatttataatcgagtgttcatttccctaatagatannnnnnnnnnnnnnnnnnnnnnnnnnnnnnnnnnnnnnnnnnnnnnnnnnnnnnnnn

SEQ ID NO: 31326 - DNA, 533 bp, Oryza sativa
agaatcaagacatacttccttctctgtctcaaaaagttcaccctcggtcttcttggcctttgccttcttgtcccgggcaaagtacttgtcatcaaacttatccaccttaacaccagagatgtcaaccttcgtggatgtggcaatgacgtaggcctggttcacacggcggatgggcactccattgatcttaaaaggtcctgaaggagaacaataagaatttaggccaaaatccagtgctttgattgtaaaaatctgaacccaaccaattcattgattgtaatcagagcttaaccaatttcctggcttaggtcagatcccatcaaaatgaaattaacttgattaaaacaaagtgagactattacattctactaaaaacatcaaaatatgccagagggtgagtggcaaaaatatacaattccctttttgcattcagtgtgcatgttatatggaatttccattacaaaaaacagcacaatccattttacatctttgtattacagatgcaaatttcagctcaatctatatcaatgagg

SEQ ID NO: 31327 - DNA, 1289 bp, Oryza sativa
aacaaagagaacggtataggaaggccagcactgcagatccccagctgtatgtcccaacaagagaaagatcagcaatcagtggaagatatatcagactcatccgtcctgttccatctggaaatagcaccccacatagaaggctcaggatatatgctcgaacatgcctctccacagtctgatcatctgtcccctctggtaattcatagaaatgcttctttagccatttgtagtgcagaaaagattttccaggcattgatggtcctcttggatcatgacctagacaatcaatgaccatctgcgcataatcatgatcagtggtagaacaaactggacggccatcgataggaagagctaacaacattgagacatcttgtagtgtaactgtcatctcccagaagccaggtggaaactatgagtttctggtctccaacgctcaacaagggcagtgatcaatgccttgtccaactgaggcatcttctggcaaatttgtgagagcccaagcaagccagcatccctcaaataaggacggtatctctcatgaaattttaaaggtttgtgatgtcgcaacttcaactgttccacagcctgcaaaaaaacattgacctcagtcagactgcaaagtttattcttcctacaagaacttgttactcatgcaactatgacaaaacttaattgctcttagattaacctgatcaccgaagattgcgtccgatcggtggttgatctttggattgagtaatgtgttggatacatgctctactgatgggcttacaagacaaggtagtgggctttgctgcggagtaaactcaacattgtcctctttatcagaagtagtacttggggaagaaggtgtggaggtttcatgaaagtccatgtcattttcagccaaagcacttctcccacggccacagccacgaccacggcggccacctcctcctctctttgaagacatgatcctgtactgttctagtatttgggaaattcatgagaccagtcagggaaaaggcacagacgttgacacttgacagtaaaaaaaacacaagcatatgttgagaatttatgcagtggtgaagccctgaaagctgcaatgggtgtgcacactttagtagcgagtctgaagtcttgaacaatgcagaggggggtctctccactaacctgatcacgaaaaaagagggagaaaaggggggaaaacatgcatattcctctttatgactcgcttcgaaaagagaattttcaaaatgaattctgcaaaatcatttcatttcgagtgtcccagccgagcctacatc

SEQ ID NO: 31328 - DNA, 1754 bp, Oryza sativa
ggccttgtattaatacctataggtgtcccttgtccaagtagagctagggaaaccaatatagatacaatccgagtagtccttgtcgtttccatgtagaactttattcatccttccttatgcggaactactcctatatccgaaggttgtttcccgtataagacatggtatgtggtgggtcctgtcgagatttagtcaactactgttaggtatgtggtatctataaccctgagaaccagatacttaatacacacaaaggaatacagttttgaacataggatttcctcaaaacagttctcatcggttatatggaattcggggtgttacagttggtaagaagattcggcacacatagtcactgatgtatacataccggtggataacactctgagggattatcgcttcccgttgttgttacacgccagcacggatggcttatttttggcggttttagttttattggcacaaatgagttgacagggatgattgttttgtcgtagtggtacccaaggatatttgcatataaatgggcaagaaatatttaatacaatgggaaatatgcaacatttttcatgtgtcaaatggtatggatgatacatatatcaatctttcttccctatacataccccgattcacaaaagaatactagagaatcccaatttagggaaccaccggtgtacatacttgtaaatcaattcaaacagaagttttataagcacaatagcctacgaagaatcccgattcgcttcaagaatctcttgcatgaccctctttagcgcccattcatccgtaagaatccccctatgggaagcgttttcgaccttgatcgacttgaattgccccctctgtcctggctgccgacgcatcttctcgttgaacgctaacatgctaatcagattaacagccccatctcgatcaccatacaccaattgtgccggttcatcgaagttgccatcccagtacaccaattgccgtggcgttctatttcccactccattgatgcacgtcaacggcaccatgggcgcctcgaagtagctcatcctcgcaaccattcgtctcctaaaaggctcgatgccgtcgccaaaaccaacggcggcaaggagatcttccagatcgtacgcagagtagtttctctggtttgtgatcacgatcggctcgtgcccaaagaccccgggagatggaaagttggcaatgctagcctcaaagctcctccacattggtcgcagggacaagtccgtagcatctgggacgcagagaatatcgtttggcccggaggcaaggttcttcacggggcccatgaaccccggagcgagcgtaggcgcaaccaggaagaggtgctcgatgtacctgtttcgccacgccaatggagtgctcctgacgaactctagaacgaccatccctccaaggctgtgcccgaggatgatggccttcttgcgatgcttcctacttgcagcctccacaagctccatgaactccttgaagtgtcgcgagtaaacctgggatgcctggccagggattggagcagcgtaacggaaatcgtagggaactccgtgcatgttgtctccatcatggtatcccatctcttccagctattctataagctttgcaaggcacctttctctacaaatcaggcacacagaagaaaaacagtagatcagcgtaggcaacattataactattctaagtaataattactacagattactacagtactacatcatcagcagattgatgtgattgaatatttataaaaaaat

SEQ ID NO: 31329 - DNA, 523 bp, Oryza sativa
gctataataagctgatcatccggtggcatctcgcctgctgtaccacacacaacagcacactccaccacactctgcccccaccgacgaaacgccgtgccaaaatcagacctcaccgtcgccatcgccgtcgcctctccggccgtgtgcccacaaaattattgatcccctgtggccatggcgacgcgagagacgacggacggcgagagcctagctaggccgtcgacggcgagctctctctcactcgctcgcggtcatggctcccgctatagctagctgtgcattgctgacttgctgcacgcaggggtgccctttctgaaaggtgtctcctgggaatttgcgcggtactggtgtctcaagataatgcagctaagctaagctgctatctgcctctcactgccgtgaccaatcgacaataattaatcaatgacctataattatatctccatctgtactcgtaaaggaagtcgttttcgacagtgacacggtttccaaaaacaactctgatttattatttctataaaaa

SEQ ID NO: 31330 - DNA, 647 bp, Oryza sativa
  unsure (1)..(647): unsure at all n locations
nnnnnnnnnnnnnnnnnnnnnnnnnnnnnnnnnnnnnnnnnnnnnatcaattaatagaatatgtatagactataatgagatacctgatcaacaataaataggtcctggtccagctttccaatgataaaaccaagattaaactgcccaacaacctgaaggtgtactagttatttagtgttcataaacttctttagcaaagtactgcaaatagaaatatagaattcatacagcactttttttaatatttcatcctatttagaacaatgaaatcacaccactcaagtaaaaaacaaatgttcacaataataaaatgctttcagataaaattaacaaaagacaacatatgtcttgcgaggaacttgcaagaatcacacgacctatcgtacttgatagggccatgaacagaagcaagctatcaaagcacccaaattatacaacaaatacagttaaataataagctggctggtcccactaaagaaacaaaatgtattggtacaacttaatttcatgattgacaaaagtcattggggttcctcccaagcactgagctactgagtatataacaataaaaaagttctttttgaaatagcacttaaacgacaaaaaggaaaacactcgcgcagggaaaataagcagggtaccgagct

SEQ ID NO: 31331 - DNA, 400 bp, Oryza sativa
  unsure (1)..(400): unsure at all n locations
cccgttgatctgagcggcagtactccctggtgatgtcctgaaactatctggcccgaaaccccaaccatctggtgattgtcttgagtttgcgttccttgccaggttttgcgctccattggtagaatgatcaacctttggtctgacctgagcaggttgagatttggggtcagggaatgcctgccatgttttggcttcagagctaggtaatgagtttgcgagcattccttgctcaagctcccacaccgttccttcaatcttctccttacgctacatatgaatgcaagtctcaggtaagattctaacagaattaagaaataggttaaatacgttgtaccagatnnnnnnnnnnnnnnnnnnnnnnnnnnnnnnnnnnnnnnnnnnnnnnnnnnnnnnnnnnnnn

SEQ ID NO: 31332 - DNA, 2355 bp, Oryza sativa
  unsure (1)..(2355): unsure at all n locations
nnnnnnnnnnnnnnnnnnnnnnnnnnnnnnnnnnnnnnnnnnnnnnnnctgtttgaccactcgtcttattcaaaaaatttatgcaaatataaaaaacaaaaagttgtacttaaaatactttggataataaagtaaataaaaaaataaataataattctaaatttttttgaataagacgagtggtcaaatagtgcaaacaaaaactcaaaatcccttatattatggtacagagggagtaatatctatatgaatatggacaatgctagaatgtattataatctgaaaaggagatagtagctagctattggatcgatccaaaaggacatttcaacaacaatagaaccatatactccctccatactcataaagaaagtcgtttaggataatgtttaagtcaaactttggaaatataaatcaataaataattctcaagttgttgagtttgaaaatgtaacaaattatatgtataaatttatcttgaaaaatactttcataaaagtatagatatatcacttttcaataaatatttttatagaaataagaagttaaagttgtgttttggagaccgtgtcgatgttctaaacgacttcttttacgagtacggaggaagtattacaattaaaacatttacgacggtttattactggtagtatccagtagaaattacaactggaataatgaaatgatatgtttgtactgtgttttctcttctttctactgctcttacaacagcatggttctgtttcttctcgccttgacactgtaccgaactgtcgttctcttcttcctttcctgaagcattatccgggcctgtttagttcacgaaaagaaattttttgggtgtcacatcggacgtttgaccgcatgtcggaagaggttttcggacacaaatgaaaaaactaatttcataactcgcctggaaaccgcgagacgaatcttttaagcctaattaatccgttattagcaaatataggttactgtagcacttatggctaattatggactaattaggctcaaaagatttgtctcacgatttcccccctaaccgtgcaattagttttttaatttatctatatttattaatactccatacatgtgtcaaagattcgatgtgatgtttttgggaaaaagtttttgggaactaaacagggcctccatccaatacagtgactgatgagacctgcatgcatgttgtgtcatttgggcgggggcttttaactatttgccacccctatctcaatgacatgtggacccacatgtgtgtatgacatgtgggtccagtggcaaaaagttaattgccacatctaaatgtggcaaatggttaaatatctccaccttcgtagctactccctccgttcgattctaagtgcagacataatttttcgtacacaattttgaccgttcatcttatttgaatttttttttaaaataattaaaaatataagtcatgtataaagtattattcatgttttatcatctcgtaacaataaaaatactaattataaaattttttcaaataagacagatggtcaacagaaacttatggttacacttaaaataggacggagggagtactatcgaactggcactactggagaagtggtctttagtccaaggttacaaaccaggaccccgaatccgggactaaatatggtagcgccacgtggcctacgctttttattttatttattttattattttttgctacttgtatattgattttgaaccgaactcaataataaaatcatccacaaattgacatcacaaaatcatccgcaacttcacaaaagcatctaaaaataatctacaaatttgcatcacaaaatcatctacaaattcaaaaaatatctaaaatcatccacaaatttacatcacaaaatctaaaagtcatcccaccggctatcgctttccctccggcttgcccgccgcctgccacctcccctccgtgtgcgccgccgctgcccgccgcctcccatccgtgcgcgtctgctgccctctcctccccactgtctccccccgcctcccatcccctgccatctggcgctgcctgccgccgacgtagaggtggaggggaagagaggatcggaggagagtggagggaaggaggagaaggagtagaagataagaagataagaggaggcgtgcgtgtgcgcaacgaggagataaggaagagagagcgagagatggggatgatgtgggagagagatatttattcccggttggtgataccaatcgggattaaagatctatctttagtcctggttggtaagttcgttgggacctgacaactattgaaccggtactaaaaattatctttagttacagttggtaacaccaactaagactaaaaatcaa

SEQ ID NO: 31333 - DNA, 26061 bp, Oryza sativa
tgaatgatcaacatgtacaaataaaacatctacagtatgcgttggagcaatggaaccccctctcatgcggtaggtatgctgtgttcttacgcatgagtactttatctgacacctaacaattcagagacgacacgatcgaccgagttcttctgtgccaatctttcgtgcagccaaccacttcaaagttcttttcaggaccagacgtgctgcgaaaggcctgcagtatgggagctcattgatccaaccgttcgtcatgaatgtgatttggaaactgcactcaaatggtttggacttcggggactcgagttgacctgctttctttggcagtttcccattaagcgtaacaagaaaatagggtgagcgtggaatggtaaacattctggaaggagtccatccaaagcaagtcagttagtagttggcgagtgacatgcacgcacagaagaagtctcccatcgtttagccaaacaacatatttacaaacaaaaaataatttataaataaaaattttatatacatgttcttagcaatctaaaagcaaatgctgaaaaataaactttaatgagaaaacctcaaaatcaactctaaatttaagtttaaaaatttaaagtatagctaataagtaaaagcataagcataagcgaaaaaataaggctgcttagttctgtacaaaatcttcatagtgtttttatgatgtatgggcatgcagagggtgcagtatgctgtagtacaatagaacatccacttaattaagggggtatttagatataaggttgtaaagtttgggcgtgtcacatcgggtattatatagggtgtcgcatggggtgttcgggcaataataaaaaaactaattacagaatccgtcagtaaaccgtaagacaaatttattaagcctaattaattcgtcattagcacatgtttactatagcaccacattatcaaatcatggagcaattaggcttaaaagattcatctcgcaaattaatcacaatctgtgtaattagttattttattagcctatatataatactttatacatgtatttaaacgttcaatgtgataaggtgtaaaattttgaggcgggatctagacatgccctaactaacaattacaaaaatcgaatatatgtactagtactatgtagtggcagtggcaagtggtgtaccactaccagcttgcaaccagtcaattaaatgtgcattagtattgaattggcaacctccataatcactcaattaatggaagtttcgtttccagccgagatgatacaaatacaatacccgctatcctaaaactaaagacctatctcaggtgcaaagtgcataagatacatccaaacattcatggctaaactctaaacttgaagggtgtacttacatttggggaaatttaacttttcgtaaatttaagatgtagcaattaattattgagtaaattgcattggtggtacataaatttattaggtggttgtaatttaatacatgaacttgtaaaatgcttattttagtacacgaacttatctaatccgtgccaaaatggcttggcaaggttaaatttacctagctgatgttggttagaaggtggcgtacatacgtacagtgagtatgcataaaacatactatatttataaatttattctctactttatcttaaattccgtatgtttctaaccttgtattattgctcagtttttttatatctttctctacaatcgctatatctcattttatcttattttatctttttattgaataggtgtatgtctaagtagcaaccttctcgtatatatatttacgcagtatcctaatcagcacctaaatcaataaaattaatcgtgcatttattgtacttttgaccttagttcgcacgcacaagataagttcatataccaaaacgagtattttacaagttcatacactagattgcacacacccgacaagttcatgtacagccggtgcaatttgctcttaattatttgtcactcaatagacatgtgggccttcatgtgtctatgatatatgggtccagtgacaaattctaatcaccacttgtaagagtcgcaaataattaactcattggtttgcaaaattactccatagttaaggtgtctgtacgtcttttcttttgccagaaaccaggtgaaatgctcctcatgatttttaatggatgacaccgtgaattttagatatacgttttactattcaacttactaaattttttagtaaatacgtagaaatataagaaatgcttaaagtacgtctaattaatattaatataattcacactaaaatcaattatatttatttttttaaaaaaaatatgaatgttaaacttagccaaaaatcaacaatgccatctactatcttcattctaaaatatatatgaatctagatccaaagaaaacattttataatattatgaatctgaaaaagaaagacatagccagaattgtagtattagaatatatttcatccgattttagattttaatatctaaaccaaagttagtatgcccgtgtttagttccccatccaaaatttttttaatgtatgtgtacacacatttaaacatagcctaataccaaaccaaattcacagattccgcttgtaaactgcgagacaaatctattaagcctaattatctatcattagcaaatgcttactgtagtgtcacattgccaaatcatggtgtaattaggctcaaaagattggtatcataatttacaagcaaactgtgcaattggtttttcgtctacacttaatgctccatgcatgtgtccaaacatttgatgtgacggaaaagttggaagtttgaagtgaactaaacacaacctatattcaaataagggttaattggatacatgccattaaaatttttatggttttgaaatataccactagtattcatgtatttggaaatatgccattataatttcacacatattcaaaagataccactacttaccccttggatgcatttccagataaaaatggaccaaactacccattttcccctcgtcttacttcttcccctttctccttcctcctctcttccttctcaggggcgacgcggcgcgtcaacggtagtagcggcagcaacgcagcacggtgcgtcggcggcggcgcggcggcacagcagcaacaacggcgcgacacggctcggcagcgacagcgagacgcggctcggcggcggcagcagcagcggcgcggcggtggagcaagctgcagcgcgcgcagcgggatggcggcggagcgagcggcgtagtgagaagagagagacggtagaagatggggaagagagagagaggtagaagatgagggtatttttgtccaatacatgcaaaatgcgtatctcagtggcaccgctaagattagaaacaagtagcaatggcatcgttacaaatacgcaaatagtaatggtatatttcaaaaccggtaaaattttaatggcatggatctaatgaacccttaaaataaagccccctttcctcatcttattcctctactgaccaccctgatcgagccgttaccaagctccaccactgacgcatgctgagcatgggcttcaccagcaccacctcacacttgaactcatgcgtaccctctttttcgttgggagcctgcataagctttcaggtcattcacagtgctccgacgtgtcattcggccaaccctcgacacattggagatctgcggccagctagacatcgcgtgtgaccaaacaaagttcgcagagcctagtttgggcactcgttatttcgacggctctctaacaacttgagggcaggcaagagaatggcgcgccatgttgtggaggtcatggccttgccgcgttgtggttccccctcccccctcccaggggcgtgtggcccctccccccatgaccgaattcattggaagctcgagcaggagatggtggtagcagtggagccatggaggcaagcaggaagcatactaggaagaccgacgaatgaaggcgacgacgacctcgacctcacccatcccgatctgcggccctggaggtagctcgtcggccctgtcccgcctcaatccgtgtcgccaggagcttgccggctgcatcgatctcacccatcctgatctctgccttctttgggagctcatcggcccggtcctgcctcgagtagtgctaccgggaggacgataggaagctgcagcactggatcgatctgaagcggcgcagtgctaaggttggggaaggagtggcgtcgcggtatagaggttgggaaaggagcagcggcgcggtgcggtaggtgtgtgagattcgattgaggaaagagttgagtggggaaagtgatttcatggtggggctggcctgagaaaaaaatggtaacatgcccaccaaaactacacgcacactgaaagatgggagcttcatttgctttttacctacgtggaagcttgggcttcttgatgagggccagacgcactgctattgcccttatagcgagctttagctgtagggatgggcatcctggccatcccctcgtgcaacgagcttcctgcagctgagatgtacaattggttggaactgaggatggtgatgtgtatggatagagttaggcagtgagaagagaatggagatgagctaggaaaggatgaagaagaggataaatttggtgctttacatggtgtgttggcaaaacaaaatgattttgttatatgtttgttgacaaattttctttaaaatttaacaaatataaatatattataattgtaatgtaataacattataatttgcatgtaactttaatattacttgtatgtaaccttcacgtaatttgaattgttagatttgcttcgatagtcgtgcaaagaggaaaaaacacggcacatgtataggtgaagagcttcgattccatgaacccactaccacatcactaatacccttttctaaagttatatatataaattataatgtagttatataaagtttaaaaaatataattacactataattataattatattgtatttatgtttaataactttttagaagaagatttatcgactagtcctaaacagaagcagacacataagctaggggacaattttagtatttacaaagccaaactttgggacaaatgcgagcacacctcttaaacacacccttaactaaactttaggtataagagcaattttcagttcacaaaccttgcagcccaacgcgtacgtaagctgaccacgcactgacagtctaaccaagcaggactgtcccacaaagtcaaagcgaaccgacttgacctaactggctacgacgaggtctctaccaaaatggaaacgtaccagacaacatccgggagacagcgaggcgaccggcgtcgtacgtagtacaaattagtcgtcgtactcgtaccctcaattgccccaaccccgcaccgtcgtctcttcgttttcccatcgcagcggtgttttgctcgtcgtttttcctctcgatcggcccttgaccagcttgcgctcaactttcgtggtttattagtccaaaagttatgtccacttctcggtgccgccatgtgggtggttggtctaccaaagttcgggaaactattttgatcactcgatgggatatccctcatttgcttaaaaattatttaaatagttacttcctccattccaaaatactcccaccgtattaataaagatagtcgtttaggacaatgtttaagtcaaaccttggaaatataaatcatgaataactcttaaattgttgagtttgaaaatttaaaaattatatgaatagatttgtcttgaaaaatactttcataaaagtatacatatatcacttttcaataaatatttttatagaaataagaagtcaaagttgtattttagagaccgtgtcgctgtccaaaacgacttcctttatgagtacggagggagtaaaaggctcaaccactcttaatctaaagaccaagaaataattattatcatctcatagtttggatcactcatgcaaccaatagaattaaatatattgagtatggaggattcgaaagaaaatgctagttaatggcatgtattcatgtattccttaattatattatgaaacatttaaaaaaaatagttgcgccttatataatggaatggagggagtataaaaaattgtggaaaaatttaataacacttatacaacatatctatataaccccacaaaatattaagttcaaactcaactcatatatcgagatataaaaatatcagcatatgaatagtattatacggatcacatctgaatttttcactaaagccgagtatttaaacttaatttttattacctatcgattttactatatactttatattatcaattttttataattttttttaactatttgtatcgaatttgaaaggaaaaaaacacaggaatatctcttcgagggattaaaattcactcccactaagtcgtggtttcctcccagctgccaggctagctcgctagttgcactgtgtcgccggcgcgtcgcagatcctatcattcccaattcccacgcggtcgctgagctcagtttcacagttttcacacatatgtacaattgacagccacaagctctaattttggttaattaatcaatttcctatttatttcatggcatgtaggagtaagtgtgtgttcagtgatggctatcggtgggtgggtggggtgtactactcccctataaagggaagctcgcgtcgccagaacttgggcactaccaccactcgcctcacactcactcgctcagcactacttgcaccccctagctgagatcagtagtaaacggtcagtcaattgttgcaaagcgatcagctactggcgatggctcagggaaggggcagtgctgcaggacgacgcaacgccgccgtgctggcgatggtcctcctctgcgtgctcctccacggcgagctcgccgagtcggccgtgtacaccgtcggcgaccgcggcgggtggggcttcaactccggcggctggctcaggggcaagcgcttccgcgccggcgacgtgctcggtgagttcgatcgatcgattcagtttctcgtcgatcgtgtcgtttgaacgctttctctttttttaaaccgttttcgtgtcgccaactagcgcggcgcgtaagtggtgcgctacctaactgtttacgtgacacacgtacgactactgcactgcggctcatgaatgagtcaccaactgaccgattgcattgcacctggacctggtcgatcgagcaaccactcgcggctcggcgtgtgcatatggttggctggttgctttgcttggcactagcgactatcccaacttttattttgggggaaatttacagaaagccgccccataaattatttagttgcaactgttcacccctagaaattattgtaaaaaacactaatgtgcacttactgaactgaaagggccccgtatcactgatgtagaaccatcaaaggttaagctagctaagccaatcttggataagtacttgcattagacttattattcatatttcaatgtagaatctctaaaaaaaggtcaagactatactcctataagtatttaaattcaataaagatcgtattgacggctcacaatttataaaaatatattgatatggttaaacatgtgtgcagtgggatggtctttagaacaaaattgagtagtcaatgcgtatttaataaaataacttataatgtgaaatgttaagttttaagtgacttatggatggtttttgtaaatatctctttcgcttgacgagttcggcgtctactgtgtgtgacgtgcacaaaactgcctctacaggctgcaacagagcattgtatttttccccttgtaagcacacggccacagacaaatgccatgttcgatgttttgccattgacgaacctttatcctagaaaaatataccatcgtcgttaccccgatccatttttttctgaatgcccaaagtgtcctcacataacgaacttgaggaattttttacatgcctgaatacccaaatgtgattaggctgtagatcgatgattactgctaatcaaatgttaatcgggagataataatcttgacacgattgcatatatctcgcatcgctctcatgatctcatcaatgtgacgaatgttgtgcgtatccatgcgtgttgcagtgttcaagtacagcccgtcggcgcacaacgtggtggcggtgaacgcggcggggtacaagtcgtgcagcgcgccgaggggtgccaaggtgtacaagtcgggcagcgaccgcgtcaccctggcgcgcggcaccaactacttcatctgcagcttccccggccactgccaggccggcatgaagatcgccgtcaccgccgcctgatcggccggccggtcgccggagtccggcgggatcgaatgtagtagtggcaatctctaaatatccgggaagtagatccaataattctgtcagtgtcctacgttgctgaatgaccgtcttcgtgtttaggcctctgctttgttgcaggttagttgattgttggcaagtatagagaggaatatatgatttatgtgatgtgtattttgagaagaatttaataaaagccaaacagctgcgttctggcccagccgtatatatgtagtacaaggttctgaaaattgctttgtgtgaatgcgatggttcatgcatgtttgtaccatcctacattcgtctgtggcagttgagagaagaagttcagtgaactggtataactaattggtgcagaagctaataacagtcaaatgtttagtttcaacattgagaagctcgcactgccgtcttgaataacagcaattttattcacacaagaacaaacaatttctattttatagttatgctcgttctggctggaaagaattcagatttcatagctacaagttcagttcaggcctagtgtaacccaagtccattgactacttgcaaactctgccagacattgtagatcgaagcattagaaattacaggcaaatgcttgatgacaatacttgtatgttttactacgatctacagtgtgcgcgggtgtgctctagtaagccttctagtaatgaaacatttttttttactattcattcgctaggccttctagtaatgaagcctttgttctcgagtctcatagtgtgaagtatgcaatttctgttattcaagacggcagtgggaacttctgaaccaattcggtataccagttcatttctgaactcctgaaaaacatgtggccacaacacttaactgtacaactctcacttctcatcaccaattctactacagtttactgacatcatctatctccagagaataattagtagacaataatattgcaaagtttacaccaaatatctagcattactctttttccatgtacaattgggttacattgagctcaagcaaagaaattaaacagctatcatgtgctggactcctggctttggatcatgttctcctggaacgttgtatggtttcttgtcatcagatcagctaagccttcttttttcttgccatcagaactcagaagaacctgagctgaattttactaaaaaggaacgagataaaaaaataaacggtgtttgcagtaatggtgtcaactatacataactttgatgccagatcagctgataaggttgatgtttctgctgtggcaaaaatctgtaacatcaggcaggactgacggcatttccttaattttcagaacttgcagtcttgtagcatgctccataacctcaaccgtgctaaggaattctgtacagtcgtggatggagaagcgggtgagattcggaaatgagccattccccacatggaacaccctaagcttctttagtccactgattttcaggtaccgcagctcagggaaactgttttgtaaacatgagacctctgagcaccggagcgcgtcatcctttagcttgagttcataaagagttgtgagtgagcctagtgattccatcgggctcaaaacaatccacgagccagataatgtgatgcttttgatgcaactgaaatgtggatcttctagcaggagattgcgatgtactcttccttgtagttttagcttatgaagttgctcatggctcgtcactgcttgaactatatctgaagtaattggttgaaatgaggcaaacggcatcattataaatattgaatggagattccctagctgcctcagagattcggctagtgcgtggttttcattccccatactcgattgtgcattgtaccgatcaatatcaaacccatttggggactctggtctgtattcaactccccgccaggtcctaaaacgtagtttcctcagatttgttaatgccattaagttcctttcagcttgtgaattggggagaattatgactccatgtaatgtttgtaaattggtaaggcgtcttatgtcaagagataccctccaattcaggtagatgtgccgaagagtatcaaggctctccaatatacctggaagctttctaataaacgtcccccttatatcaagtgtttgtagcaacggaaaattgctttccggaaatggaaattcaccaagattagtatttctcaggctcatgtatctcaaatggttcagattactttggacacttttaagatcacatgccaatctctcgtgtccttcaagttcaagaactcttatgtattgcatgcttgttaactgttccaagatgttgtgctggaaaccccacagaggaaacaaaaagaaagcgtgacaaaatgccctgctaaaaggccttaatgcttgatgaccaacagtaatcacacaagattcaattactcctggaaatattagcagagatcttagcttctcactgttacttagttcatgaaatgcaataagtttggtatggagagcgagacgacgatagtattttccttctgctcttgagactgcatcaccattttcacaataaaagaatcgactctctcttgcttctgatcttgctagctcacataataggccatgaatgcggacccttttgaaaccctgcttatgcgcaggcaacaaaggttgaactaggcacctttgtatgagttcgcgtaaatagtcatttgctgtttcctctcttgtttttccatcttgctgaggtataaagtcatctccgatccatagttttatcagtttagagacactgatttcagtttcttctttgaaagcacctagatacatgaaacacagcttcatatgataaggcaagcagctgtagcttaaggccagtatctccaagcactgattcccagcttcgtagttgctccacttcatgctcttcaatatattcctccaaacttcgaattgcttttccttcccagataatagtcctcccaataccacaagagcaagaggcaaccctccgcatttcttcgaaagttggtgccctacatccttgagctgtggtggacaacttgttgtgtcaacatgattcaacccaaaaactttggtaatgaatagctgaaagctcaattcttcactcagtggatctagctcatagggaagggaagatgggtcagcagaaaccgcaatttccttggagcgagtggtcagcaagattttgcttccattcgtagatttggggaaagcttcgcttaattcaagccaagtttctgtcgtccatatgtcatctagtacaatcaagtatttcttatgctgcagaaacctgaacatggcatttttggctgcagctacctgtgtcgagttcaactcaaccccaatttgagctgatgtgatcttcaagaggcctaaagcatctgcgttctgcccaactggaacccaagcacaagcatcaaaatacatctccacactacttcgagagctcgttcctttcggtgaatcaggacgcaatgaggtgccccctgtttggattgcagaaaccttattgtaaaccagagatgcaagtgtggtttttccgacccctcccatccccactatcccaaccacttcacggtgtgctgtgcagcgcagcaatctatcgatgatcatgccggcctcctcctcccgaccaacaacgacgtcgtcgccgaggtggcaagaagaacgcctccacaaggaatcggcagcagacgtgacactactgctgctgctgctcatatcccttagctcacgtaacatggaagcattcttggcccaaccatctatgatcgattggaatctggatttgatctcgttgatttgcttggcaaatctgtaagagttcaagggctggaggagagggttcagagtgtgatacctcccctcatggagctccacgctctcgatgaggtcctcggcgtcgtaggcggcatctctgagggagtgtaaccagaaccagttgttgttggatgtggcttgccgacggatctccctcaggtcggcatccttgaggaagcattccactgcctggagctcgtgaatcagtgaatccacctgctccttcacgccccacaacgaggtgatccccgacaaggctgtggtgcttagacggtcaacgaggctagaaagaaaagcaccttctgccatggctgctagcctgctactcctctcccctttggttgtccgaggtatgaagcagcagcatccatcgtatttccatggaggttttcaaggatccttttcagaaggcataatttttttgggtaattttttgtaccatcaccatgtacgctacccatcttctttagaaaaaggaaaatttcaccatcagataagtcgtacccatccactccagtccaaattcctacagctgatcggcttattttatcctgagtcattgactcattgtcaggttgatccaggtgctgttctttttaccagggtggtgtgttgtttttttaaggccccgtttgacttaaaacaaaacataagaatttcagctccatagaaaaaacttctctgtgagcctttgaaagaaaaagatcgaatcctatcaactcctctgaaatggacaatcctataaagattttagattaaagctagcaagaactccaacctcttacaaattttcctttgaatccccttgcccgccacgatgaggactcgcccggatctgggccgccgacgcgtgaaggggaagggagggcgtcgtcaacgaggaatcgtagtggcctgcgtgccgggcgtagctgagctgggctgcgttaggcatgaagaataaggcggcattggggcttgatttggagagggaaaccgatggcgatctcatccgcgacggcaaacggccgccggcggcgaggggcgcggagagctgggagagcgtcggactcccacaccaccgaccacagggacctgtttgcatatttcagccgttggatcaaggacctatctgaaaaattacggtccagtccactagtagggactagggactagagaactagggatcctggtggcaaaatgggccaggatacggccccaacggcccagcccagcactgcacgggcacgggagctcgtgggccgtgccgtgcttgggccgccattcggcacggcccgtttctgtagcgggccggtacggaatagtaggcgatgacaaattgttgctcggctgttgccatggtgcccttccggcggatccgtcggccggcggcgagccggcgactggatatatttcttgaagacaacaagaaaagatttgctctttcttctttactcgtagcgctgcgcggccgtagcacccaatgcgatggactacaacccgatagccctgcagctgtgactgtgaaaactcgtgagtcatgtgatcacgggcccgtgtcctatgctcggcattgaagctatacacatttactgctacactttttacagtcttctgtcaccgctgcttgccctctctgcacagcattgattatcagaaatccagacttggcattggttctcccccggcattggcaaccagccagcctccagctacacactgacactgcactccagcctccgtaggagtacttcagctcactatagaatggcaacggcaatggcatcgttacctccaggccccagctagtgcagagatttctcttcctttgcccagtttccaggcagaagcatcaggccaagagctcaagacccaaccagtgtagtggttgcagtcagtgagtgagtgagtgaccagtgagatagtggcatcgatggctcggggaagaggcagtgcaatgcgaggcgccgtcgccgtcgcgtttctcgccgtcgtcgtgagctgcatcttcctctccggctgcggcgtcgccgacgccgccacctactacgtcggcgacagcctcggctggtccctcggcagcgggagctggcccagcggcaagaagttccacgccggcgacatcctcggtaaatcataggagtacttatctctgaacatttcgatcaatctctgaacatttttctcatcgatcagacaaagccagctgtaactgaaaccgttttgcggacatggcagtgttcaggtacttgccgtggatgcacaacgtggtggccgtcgacgaagacgggtacgccgactgcaacccgccgccgttctcgaggtactacacctccggctccgacagcgtcaggctcgccaggggggacaacttcttcgtctgcacccgctacggccactgcaacctcggcatgaagatggtcgtcaccgccgtgtgactgagggagaaacatgtcaagactgtttcgtacgtctcgatcgagcgaaaatgctgtgaaatgtcacactctctctatcttgttccatccggttcgttctcagtttttagcattttggatgattgattagaggattctctagctgttctatgccggtgtgacacgactcggtttgccaattgtgtgtgcattgttgacgctgacaagatgcgtttgttctgaaatctgaagagaagtccctgtctttgccactgatgatgatatctactgcaaattctttagcgaagatagcagttaggctatgtttagattccatttttttcttcaaacttttaactttaactttcctacacgtaaactttcaatttttctgtcacattgttttaatttcttcaaactttcaattttagtgtggaactaaacacagccttagtgttatctattactccctccgtcccataatataagggattttgagtttttgtttgtactatttgacaactcgtcttattcaaaaaaaaattggaattatttttttttacttactttattatccaaattactttaaacataattttttgtttttatatttgcacaaactttttgaataagacgagtggtcaaacagtgcaagcaaaaacttaaaattctctattttatggaacggagggagtagtatatggtgattttgttagcgcaacgccgattaccgattagggaacaccgcaacaccggacattgcgcactgacgaatgttcttaggactttgatgatctgaacatggagatataataattgtaagtcacatgactaaccagccgattagttggtactaaatctgatccaaatcttctgttgacgtcccgtcaatttctttggcatcatgtagagtagacatttggtacactggcttgggcttttctgaatttaaaatttaagtcatacagaactctttgcgacttgtgctgcaagagtacgatcaaattgaccatggtttggttgttaataactctagctgctctaccagctgcgcgtggaaaatacattttgagagaccaatggaagacttaacaaccattgtcttaccgtaagcacacatcgatcagccatgacgcaggcacgaaattagcgagtctatctcgtaaacttgaaaatgatgtactaactatactgtttcatcatatatatagtttcgaaatatggattgatctggtaatcgatgaatcagaaatatagcaggcaagcttttatcttttctgaagaactcatcagagaaaaactcaccttattaattccaaagcttctatgcgtctgcatgctcttctgatctgtaatctcaggctctattactctctccctctgctaaataaatggaaataatttactacctctgtttaaaaatatagcaacttagtatcaaatgtgacatatcttattattatgaatatatacaaatccttatcgatcaatattatgtaactatatattttagaacagaagtagcaacaagatattaggtaactatatattttagaacaagaacagaaatagcacatctcgttgcggcgagacattccaaacgtaaacctcgagttgtccgtgctcgtggtctccaaaaaagaacgaaatgctatgccaattgccaatatgccgatgaattcaagacggcaatcttgagaagtcatttcactttgatttttggaaagccacgtcgtggagtcgcgggctacggcctacgggtgctggtctcgttcaaacacactgaaatatcccttgcagagaggatccgttagcaatatcgcatcaggcatgacgtattgaaaaaaacggatctaccgttgactttggacaaaatttactcaaacagtagcaaaaacgatctccaaatcgatcgatccttttctttccacacaaccaaagcatcatctgtcctcatgaaaaaaaaaagatctttaatagaaagaaaaaaaagtgaaaaaaaataaagagcagtggcccaataggtccaaggaattggtcagagctttcttgggccggagggcaggcacagaacaagattctggaaccttctagacgcacccgctgcccgtataagataggcatccacgccgcacagcctccaaatccaaatccaaaaacccattataatccataaacaaacaatcccctcctcctctccaatctccattccctctcgagaagaagaagaaatcgcaacaatttgacggccatggcggtgtcgatcgagctgaccaaggaatacgggtacgtggtgctggcgctggtcgcctacgcgttcctcaacttctggatgagcttccaggtcggcaaggcccgcagaaagtgagtctacgcccctcccagatttggttcattgctctcgctcgtcttgatttggagagaattttcgattgggattttctctgaatgttcttggctgatgctgctgccatcaggtacaaggtgttctaccccaccatgtacgcggtcgagtcggagaacaaggacgccaagctcttcaactgcgtgcaggtctgtcagtctgtcgccccacccaaccccgagattgctcctcgatccgttcttctgaccgatgagaattttggtggtgtgtgcagcgggggcaccagaactcgctggagatgatgccgctgttcttcgtcacgctgctggtcggcgggctgcagcacccgctcgtcgccgcggggctcggggtgttctacgccgtcgcgaggttcttctacttcaagggctacgccaccggcatcccggacaaccgcctcaagattgggtacgtttctttttgcgaattttcctactggagatttattctgtgtgctgtgctggtaattaaactgtcgctctaacgaaagatgattcgtatgcatagctagttcaaacttaaccttgatttctagaatgctagtcctgttcgtttcttgggtagcaataaccaatcagccaacactctgaagtctgaactttgacttcatttatgaatggttccccaagtactgatggtattaagtggggtaggtggtcaatgctcaattaagtggaggatacagtaggtgtagtacaccaaagaaaaatgtcaaaggtgcgtgtttaattggtgatatgtcaagattgaggagtgggtgacaacgtggagtagctttgaagtggatcatacagtatactattcaacatggtacggatcgtgcaaatgtccccatctcttcattttataatctgtcaaagatcgcagctacttgttggcacgacgttgatgaaacttccaaagtttacatatttagtatttcattactcatttcaagaggtatatataaggtgtgtccagacttcagacttcagacttcagactgctcgagtcgttgctaaatcgctattaattatgggttgactcgtacgtcagtgggtaatgcagattgcaaccctgcaccaatcaccacagttatgatagtctagtctatcggtgtcctttgcattgagtagcaaagaaaggatcacttgaactgaagtttcatctgaatttgcaccaaatggcacacctatcactttgtcaaccatctcatatcttggtttctgatcgatcatagtggttctaacctggtcggattaattttttggcaaatgcttcagggggctgaacttcttggcgatctttgggttgatcatctgcacggcttcgttcggcatcaacctggtcctgagggaatccatctgagctcttcagttgatccatgagctgaccagctgagagcttccgttgcgacttgtgatgttgcctataggcgtataggtcttgtgacttcagtcagctagattttagtctctgtttttcctttggtgttaataaggctggttgtagttccatcttaaaaatacgactacatggagatggatttgcagtcttccctgttcctttctactctacttcctttgtagaggggttgtactgttaagatttacctttcaccacatcatcagtgttaagtgcagttgtaaatttctttataagtttatcatgtcttgtcctgcgatgggaaatgattaacaacgtcaatgcagtacgtttttttatattattttccgtcctatttgagcgtccattccaacatcaaacgctctagtgaaagacaagtgtgaaagagtatcgtcaacttcgccagttacggagtacaccatatagtccaaaacgtttggtagaacgaccaagatttgctaaaggcagattggcagtcattggagtcgtcgacaaacagcatcaacgacaaacaaaacttgtcaagacgtgaaaaaataaaaaaatcttgtactcaaatcttgtttgcctgcagacctgaactacaggtaacatccaatatgtttattagatgtcaacagcggagcatatggagatcaaaatgacttgctccatccatactccatagtaagtttatttttagctctttccatttgtcccaaaataaatttaattttagagtaatcattgtattgaagtttgtgaaagtagaacatactgtattagaagtagataaaaggctcgttcagattgatgtcatttcaaaccatactatttttttggtagagttgtcaaatatgtgcatccatttagtttttttaccaaattttagtaaatacataagaaattctgctaaaattttggcaatattgccaaattgccaaaattcaataaggtttattttggctacaatctgaacagctccaaaatccgaaataattacattaagatttgataaagtagaagtattctagttttttttttgttttgtagtggtatttatgggattgataaaaaatgaacttatttggaactaagcagtatgaattacaaccaagctagtctaaccataaagtgctcgagtaaatagtacacagtacataatgaaactatacgctacatggaaaaatatcgaagttatatatatctatcagactatcaaatatcctcgcttctaccagcagtgaatctcctctgtgctggtgtcgcccttttgctcacaatatgcctgcgctgcccttcgtacggcaggacatcctcgctgtcatcctccctaccgttaccatcctcatgaatcgagtcaaaaattttgctcttgccagtggatctccccagggttgatgctgccctagtgcgcactttggcacgtctgcgctcgccttcgtctggatcagagccatcgtcctcccgatcgaaagagtcatcaaaacttctacttctgtcagcccctctcgtgttcctccacctattgtgtccgtgctggctgtcatgggtatcattttcggggccttcatgcttgcacttcaagcagaccttgttgcgtcgaaagttcacaaagctgcatctataggaggagatgatgtctagttagcgtgttgaggagatgaacagtaagaaagattgaggtagtcgtataacatacgaggggcactcccattctccagggatgagctgcctctttggtcgagattcttcacatttaaaacacatcttattccgtgcaaagttcatgaagtggcacctgaaacaaaaataaataagttatcaaggcaaatatataataatgttgaacagtacaagaaaacaaatatggcattcgatggttactgtggacagatccagtctcccgttttcatttcagtggtagctgtttctatcttctttggtccatctgctttgcattcaaggcagtgccgatttcgagcaaaatttaagaagttgcaactgccaaaatgagaggatgttaggacagggtcattcacaaggcataaccaggcatcaacagtccagcacacacacacacacacgcccacgcacacacactgtggatggggaataaaaataataacagtgaagtaaacgataaaagaggccaccataatatcataatcttctaacaccatagttaaccataacctgatatcatctaagaggtgtgcctctatgatccacaaagaacattacaaatattgtaaagtccatagtaatactagaggtttcttgtccaaccatttaactcaatacttactttaagtaccgtgcaattttctttgttgaagcaaagacatatttacactataaatgtactccctccatcccaaaatatagaaaccaagtactatgaatttggatagggaggtctagattcgtgtactaggttgtgtctaatccagtactagattgctatattttaagacggagggagtaccaaagagcgactacaagccgaaacccagattatctggattcactcattgagaaactgttacaaccaagcatacaatgaatcctataggtttaactacaacatcgggaataagggtcctagattagtatgaaatggttctttctactcctagtatccaccttgtaataatcagagcattgtggacaaagtaggaaacaggtaatcatatcacaacattagatatgaattttcaaacgtgtacttccaagcatgccttactttaaataatcagtacttctggatctggttcaaatttacataggctgtttctgcacaaacaaatagtcttcaagctaataatgcagaatgttgtgggctgggatttcattgggtaaataccaccgggaagatagccgaatggcatcggattgattgggatgagaggagattataggttggagagaacttgagggaaactagagtttaaccttctttataaaactcaattccaaaagacttagcccttatataggctggcacctaatcctatctaatcttatctccaagcaactaactctaacagctgctacagtaccttgcgggtactgttcacgtcatctgaagagggctctccttgggcctggtcatcggccgtggcctcctggcccaatgcctaacacagaacagtagataacatatgctacagcattatacagtgacatcttgatggtattgccaagcggccaggcatattggaccaagtctattagcactattttttttctcattctacagtagaatacactcgcagcttacgcaagaatcaaacacatacagcacagctcaaacaaaaattcagaaagcttaataacttgagagaagctaagtccaaagaaaatcttagctatcaaatagtacaatactcaataaacagaaccatgtaggagttgtactacctccgtcccaaaaatataagggaaagctatgcatttacattgccaaaatcccttacattttgggacagaggttagtatcgtttttgtaagtgtagtcataacattatattatgattagcaacatttctatggtacaaacaggcatacaaaccaatgtcatggcatggcttattagatgaattagttaacagcattcaaatgggaataagaatgaaatccaaaatggtagtcaaagatgcccttctgcaacatgatgaaaagctaaaaactcatggtgttttacttgtggcaagcactaaaagtaaagcaattcatcagaatgtgataaacctggtcagaaataactggtgctaacaatggtattgattcctggttttataaactacctgaggggatcatcaaaaggccaatttatgcccttagcccctcacatatttcatatgataatgtatcggtgtaatctgacagttaaatataaataaagtaagagtaaatttcaggaaaccccatgttttatggtcaaagttgcataaaaccctaggtattatgactggtgacacataatctcaggtattatggttctaaagtttcacaaatcctcacccctatgacctatgtatgttgagcacaaatttacttaaaattctaaaacatggtgcatatgaaaattttaattattaagttcttgactaaggctgatagtttaactcttcgctacattgaaaaaaatgtttcaaacatgctgaaactaatcaagatttgaataaggtggggttttatgaaacattgaccataagacctgtggttaagtgtcacaaatcatagcacctgtggttttctgcaactttgaccataaaccgtaaggttttctggaatttactcataaaataaaggttcataacaataggcatggaagcataacacccagttactatagtactataccataaaagacttactttgggcaaagccaatcacccttcttcatttctgtttcagttgtttccctaccctttccagctgagaacttaggctttgcaatgcccttgtcaaaagttttggtcttgctagaagtttggaatacaggtttaggaattgatggatcaattgttgtgtcgctaagcatagtaagctctgaaagaagctttctcgcagattcttgaacaccaccattaacagagttttctcctgaaaggctggttggatctattgcataatttagcagtatgcgcataacatcgacagtacgagcttcgtcttcagcgttcggaatgacataggctttatcacaagatccacgtaatttgcaagcactacaggcctgtataaagcacaaaatattgtgaatgttttttgcaaagtcaaagtaaattatgagaaaaggaagcagcacgttacgcatagaggaaaagtcaaaagtccatcgcagggagaaatgtgacagttgtgaaaaaaatcaagagtccactacaggaagaacggcaatacagtatgttcagaacagaacaattaacttacatctccttcatcaatctgaagaaactctctgagtctttttgcagaattcacaggcttccggaagatgttaggacagccacactcaacaatagcacggatatcctgcttgggaaggacactggcccaataatccagtcaaattaagatccaaccaacatagaaagaaatgagtacttgcaaaagtagtgggcacaaacagtccaaagaatcagttataccactgacacacatgactccagctttcatttatattatagcttctctggataaaatgtattttgtatttaataaaatagcactatgaaatgagttcatgcttagggacgtgatcatcgacaagttcttaccaaacatgcacaataatcatagaggagaaaggcaaaacaaaccatttagcttactaaccaaaatgtagacacagaaaaatcaacactgcatgccatgctaatgggattctcgggacattgggattagggagaacaattgactactctcagctcacgaatgtccaagttaccgaatcttactgcttttctaccagacatgatcatttccgcaacaatttcaagtgcgtgactaacgcaaaaacctcacccactaagcaaagtattaaactaattaaagcccagttcatgcacagaaccgaggcgataataaattgcaaggcatccatctcacgggcaaataacctgaggagatcgaagcgctctcggccgaacttgaggcatgcgttcttcaacctgttcaggtccttggatgggtaattgtcggccgaggccccagggtcctcccccgccgccgccgccgccgccgcggcggtcgcagccacctccccctccgcagcatcagcgcgagacgcgagggtgggctgctcgaagtaccccttggcccgaagcttctcgaggaaatcgccccactcgggccacggatgatctggtgctgcggcggcggcaggagcgtcggcgacatcccccgcggcggagcagaagcggagggagaggagtgggccggtggggaggcggcgggacggggcgggcaggagggaggagcggaggaaggaggaggtgagggtgagggctaggagcttggaggaggaggccatggcggctgggtgcgatggtgtcggggaatcaggtgagcagggatggaggcgggagcgaggaggggattagggtttaagggtttagaaatgtcgcggtctcgtttagcgtccgtaggaaactagcaatttatcatgtttttgcttcaattttcaagttgtaacaccgttttatacaagctaaatttctaaatgcaaaaacagtagaaaggtattatcttcacgaacgggattttcatgtaatttaacacgagccaacaaattaaatttaatacacaactcttagcttctactccctccattctaaattaatcatctacgtatttataagatagagtaatagatagaaaactaagtggtataatgtataagatatgaattatctctatatttatactaatattgtgtgcaagttattttagagagattatcttcatagttacaatgtgaaaagaaattatcaatattgtgtgcaaattatcttagagaatttatctatatattatattatcaaaggaagaggaagccatggcagtattgtgtataaagtagactttgaaagcacaattgcgttagacatatcgaacaaccattaacttatatatgcattgatataattatactccttatatattcgatcaatcatgaattaagcaatagcttaactggttggttttttttatggtggaacctatccaaccaaattcaaatataaaaattacgatataaaataatccctctatttcatattaatatatatgtgtgtgttgatttattaccatatatacgaatgtgggcaaggctagaaagttttataatatgaaacggaggaggaagtaatacgtatgtaaaattcactattaatttggtttatataaacactaaaatcgtacatgcatacaaacaaatccaatatagtcggtctcacaattttatttgtcaacattaatagtgtgcatgtttaatcaatcaacattagtttaagtgaaaacattaatatttttagtctggttttcatattttcatgatatagcatagaatacatattgtgttattttaaacctaagcatctatgtttattatctttttacatgattaaatgtttagagttcttttaagtttgcccccctcttctaaagctgcaatccactcgaaaagaaagtagagcaagctaaaatgctttcagaaaataaagatggaacaggattttacactgttccacaactttactccaaacctatcgagttaaacaataataagttaaaaacctgctaagaccctgtttgatttagtttaggattattatgagtaaactgaaacaaatagatagcttattatgatagattattacaatctataagccatactactataatctgataatccactttaaagatgattttttaaaaaattattggatagctaacagctaacaaatagctactaattaagagacataaaggttatgcttattataatccagcttatagtgatatagctaaataatctagattacaataatattattaagatgctcttaatcgagctaaccagcctttaagtttggaacaaaaaatcaacctatgtgtaacccttcttttgcaaccgatacccggttagccgctaccagaaaaccgttcagcctccagccacacggcaccaccaccaccgtgtagccacaaaacgcccacacatcccaccgtgtaggtgc

SEQ ID NO: 31334 - DNA, 9559 bp, Oryza sativa
ctcctccgaccccgccgccaagcagcagcctcagcagccgccgccgccgttcaagttccagcggatttggtccgagtccgacgagctccgcttcctgcagggcctcctcggctgcggcgcgcaggggctcgtcttcccgcgggacctcaacgtcttctacgaccgcttctccgagtccatgccctcgccctacacccgctcccagctctccgagaagctccgccgcctcaagaacaagttccgcggcatgtccgcccgcgtcgcacggggcctcgaccccgcccgcctcgcgccgcacgaccgcgacgtgctccacctctgctcccgcctctgggaccccgccaacgccgccacctcgcccttcgccgccgccggtgacgcctcctcggggaacaagcgccgccgcgccgccccgcgcgccgggccgctcatgcccccggatccctcaggggacagcaattcccatgattacaacggcggtattagcgccggtacgcccggcgcatttggggatgggcacggtggtgaggaaatgatgtatcttgagcaggaaagtgggcactttggttatcatggagatgtcgcgattgcggctgacggaagccttgatgggattgtgaaggtgcagcctgagactcttcctgccctccccagtatcggggacattgcggttcacagtgagaatggcaacggcaaggccgtggtgccacgtagcaatgagcatcacatggcaaatgccgtgctggatatatttgaggagtgcttgcgagaggtgaaggccaatggcattacctacggtgctaatgtgaatgggggcagtgaacttgcaaggcgatggagagcacagaggattgatgagcttgatgtgttgagccggaggctaaggttgcttgttgaggatgctgcagcggctggtcgctaagcggacatactggtggttttggtgacgtgcttccgcccttcaccccatgtgtataaaatattaaaatctagattattatgctatatgcttttgtagttcctcactcagcttgggccttgccttagtcagcctaatatgcctattatttatgcctatgtacatcgtctacggatattgccttttagtttaattatttcatcagcataatatatatggttccagcattgttatctatacagctgcctgctgttgcaatcgttttatttttaatttacgtttctgataacttgttcatgtagcttcatccattcaccttcttttgcttccataacttattacttataagctgtgaaataacagaattttgtttccttgtcaaccacttttatcctcttcccttggaaaaaaaccacttttatcaagagttttttcttacccaatcccagtgctatacctataattgcttaagctttctatactaactaagcatgaacaattgacgacattgcatagaaaatgttttatattataaaaatatgctcataatatagctctacgagtgtgagaaatttgggagtagttagtatgaagtctctgcatttcatttggttgtcatatgaagtaatgatattgttctgttttggtactgataggagcagtcaaaagtttcttttctagctcattctgtaagctgagtctaattgattctttaagacatcgatcagatgaccattttaaaccagttgccttttacggttttgcattgattatacatttatactagtgaaagagccaagaggagaagtggagaacagggtagagaggcatataacccttgcctgaatccgaacaagtttgtgagttactgagttagatgttttttggaatattgctgaatagaatttgttttgccaataataatcgctctgccatcctcgcagactatccaacaatatttccatgactaggatattttgaagtgaactgtattttgagttaaaacattatatatttgccaatagttcacggatagaaattccgtagtggatcttggtagtgattggtctgcacagttgatagatctctgggtgcttgcagcagttaatcgccttactgtggagaaagcattagggccaacagattacctgctttgcacagattgaagataatgtgtagaattggtgccttggtatcccagtttgactaacatcagaatgccttctcatgataactgattacagtccctaaattgatatgcttttgaagtatctattttgaattgaagcttggcatggttagcttatatgaagcttcatatctcatttgcgtgccatttcaggatgtgtagcaatgcagtcctcttttgttttcactccgttaggccccttgtcagaggactgtcttctcttccatgtttttgtgctaaacacaagcatgccattctaaatatcagtgtgcatgcttaatgtaatgttttgcaagtgaattgatttttcagtaagatggtgctccatgcagccttttttttttggcaggcagatttgtggctcatgtacagttattatgagatattgggaacagtggtttactttaaatgtcctgttgacctggcaaaaggtcgggacatccatgttctcaactctcaatcgaatgtgtttttgtttgcactatgtattattcatattttttatggttcctaactggtgtattttcctgtgtaagtactgttggtttccagtggtctcagcacaccatgcaatcgaccaaaggtcttgaacgacagttacaatttcaagcatgacatatgtactcagataagagaaccgctatgtgttcaaaaagataaaaagatgcaccatttgcagttttaatctgtttttcccccgtcctgtgacaacagaaagaaacagatcaatcgagtatacgtttgagtggcagtgatgactgaagttagtcaaaacctgtaaggttcggtatacgtttgaccgtagcaaatgtaaaatgatttgcagtccgtgcatttcgagaataatttgaaatgatctccgcgtgtcaatcccagttatgaaattgtccactaatgtcctgttgtaactttgttgcatcttgagcagaactgcataatgcaaatggtctcatacggcagaaggttgccagatcatctcattttttgtcaactgtcaatttgtcatggtgcgatgaagattccatggattacctttgagttgtcaggtgtgcggctgctgtgaactataacttggtagcattatttctcggtacctaggaaatcttgtcttcatttttgggagtgaatacttggacacaagtcacacaatacatgtatcctgaaactggcgtacaacaacgatagatctaatatcggaaatgctctacatcgcttcgacagacatttttgggcaaaaccacatgaaatcgttaaccttgcgatttaggggctgtttggttggttaccacactttgccacgccacactttagtcatgctacagttgcttaggcatgtgtttggttcgctgccgcaattgtgttatgccacactttcttaactttgggacccacatgtcatgctctcaaatttagagctaagtatgccacacttgtggctaactatttctaagccacatttgtgccaccatgcctaaacttagtatggcaaggttaggcatcaaccaaacatccccttattctttgattcatgcttcagtcgtactctcttcgtcccataaaaaaacctacctagtaccggatgtgacacctcctaatacgatgaatctgaacatacatctgtccaaattcgttgtactagaatatgccacatccagtcttagattcaccttttttgggacagatggaatagtagttttagatgcatttaatagtgcgggtgataagaggtgtgtggttttcaaccctaaggtcttgtgttcaatcccgacgcactcacattttcttcttaaaaaaatatttggagggatgtctctcccttcaaatctcacttttttttagtcgtaatagtttgagctctcaagtgttaggttttgaggtcaggcaaagggggagggggatggcaggtggccatagcagagctgcgaggcggccgtggtacggtggtacctcgttagccgtggcagaggaggaggggcggtggggtggtgttggcaactagtgaaactcgttattgaaattgaagtatcggaatcagataagataaagtggtgatacatttgggttatgaggaggagagagcggcataggggattaaatatggcatggcggttccatagatgctagaggcgacaccagggaggaagagggtggcggaagacccacatgttggaaaaaaaaaactatgctgagtgacatagataatttcatctgacaatgaaatttacaactagtaaactagatgcacaattacatcagatcctgaaattggccactctttattcctatgttaaaacctcttttattggtatttgctcatttaaaatcctaatagtactacccttctgtgcttgaccgttgtttttgtccttggtagtcggtccggttgcatccaaacctatgatatggtcaatttgtttgtccaaatcgtttgtctagtgggctctgggctgttctgctcgctctgcggtcaccattttacttggtcctctaagaaaaccgttttgttttagttgttgattgtgttgaaccattatattgtgttcaacaaataatgtgattttagctctaagttctaacaaatgaacatcacaaatccagttgatactggagtgctggagctggacatattggtttggctgggtcattgactcattaaattttagttaattatggttatttgatttgctatcagttttggaaatgtacaggcaaccaagatatgtaagtatctagtttttttcggcattgttaattctaaattatagtttaattggtcaacaaaacaaacactctcattatccctttacatgattctaggtgtacatatttcttgttttcagtaatactagcattaattattccttttataaacatcacaaagccagttgatgctggagtgctggagctgaagatattggatttggttgggtcattgactcattaaactttagtgaattatggttgtttgatttgcttctctattttgaaagggtataggcaaacaaaattatcttttctttttttggcactgataattttaagttatttgttgaattggacaacaaaacagacactctcaccatcccctgacatgattctagatgtacatttcctgtttccaataatactagtagcattaatatttttttccaagctttacacgtgcgtgcactaacattgtaatgatgcaccatcacgacatcttcgatgaagtgatatttttttctcgagtcatcctgttttgaaaagtacagaaaaattccagggatactaaattaatctgaatgcggattctttttggtccctgttacgcctaatagtttttttttaaaaaaaaattattgggaatacgtacgtgcgagcaaagtaaagatgagctttagagagctggacgctggaaagctacagataaagccacacttaggcgctcgtcaattgtcaccgatggatgagtagccgaaagcaaaagatactaggggacctcaatatccattttatttctttagataaatatccattttattaatggcatagcattagaccaattctctattaacattcccattcactcacttatgatgatgtcagaggaatggctggcatcaagatattgggccagttagaagagctttaaatttagattataacaagcaactggtgggctggaatttggagaagctaaaaaaacaagcttttgccttcgtttttttttttggattatgttgtttgaggaagcttttgattttaaaataaattacaggaagctccccacatgccaattgtagcgggacattttatcgtatggatttactatcgtaagatgcttatcagttataaaaatatatgatttggggcatatttgaaatcattatttttaatttttttagaatcaatatctttctaaatgttttgattaaatgcatcttatgtgtaaaatttatataagtgttttataatattatactataattttatatgtttttttctaatatcttatagtagaaccagtgctcggaatatattctgaagactgtttggatgtacaaaatgacatattttggcataaatatgccctttttatttcacttacgaagttataatggacaagtttggctctatggtgcattttgttagctatattttaagaactagccaaataactgtgtgttgcaacggattgtagaagatagaaaaaaaagtagttctcatggttaaaaagggaatacttatctctacctggttcaaataagattcttcatattaaaaagaaaaacgtagcccacctgttttttaggggttacttagtacaatgatctcatgtagtgtacctcatgaccccatatatcaatggtggtgctgctgtagcgtacctcatggtcccacatgtcaatggtggtggtggtagggatagttaaaaaaaaaaaactttgacggtaaaatatagcatatactgcaaactgcaacaagaaataattctttttcgtctgtaactaaaataacgtgcaatactgcaagacagaccaaacttgcctctagattgccgaacttgcagcaaacacaaatggctaccacgtgtgtgttttatagggcagttcagcttcttgggttctgaaatccccgctgtttttgtctctgccaacagcagatgacttgattccagctcttcactgtttgattttccgtttgtccgttcgtccacgtgcttgcttgatccaatgcattcaaatgtcgcgccccacctgacctgtcgcaactcatcactgaattactcaacattgaatcctttgtacccaaattacccaagtgtgattttttgcttgagctgaatgtgcgtgagaattgttcgtttcagtgcaagctcacctggagagttaaccaagggtatgtcttgtagattctggattttgttcgtacgcctcttagaagcgatgttttttttttacaaaagctttttatatataatttttaatattaaattcattcgttcgtaccggttaatagttataaaaaatagattatctatcaattgataacccaaaatttttatattgagctgttgagggctgaacgccttctttgaaacagaaggttttggtgagaattaactaataaatcctataatgttcatgcattctttccgggacgaactcttatcattcagagtgggttcaattcaagcacacttgcgctatttcagcacaaaattcagcttggcctaaagttctcagccaatccacccaccaaaaacacttgcatgatgcatgtacgtggcttaacagccacatcgattggctgatttgagaaaaaggcgaaatgacatattcacaaacaaaaaaattttataaataaaatatatatatatataatcttaacgatctaaaaaaaatgctaaaaaaaataaactacgactgaaaaaaaaaccaaaattctttaaatttaagatcgaagtttaattttttgctgataagcgaagcataaacaaaaagataaagggagtgactatatttatggcgccatatttttcatcaaaaaaaaatagtcggcatatatttacattgtaaatctctaaagtacatatgtaattttagtgcatttataatgtaagtctcaaaattacatatgtaagtcctaaaattacatatgtaaactacaaaattatatatgtaagtggtgtgtaagtgcaatgtaactattgtataaatttgtgtaaatatataaaaagttaaactaaaaaagagaagcgagggatatctctgcccatgccggccgtgatctacggacgtgagtcacccacgacgctcgcaagcgcatcatgcgggtcagactatccgactgaaatcgaacccaaaatgtggcgacagagatttagcaatactgaagataaatctataagactggcggaatgttcagacagtttcagaattcagaacccatccactgatccgcacgcccctcaccaccaaaagtcgcacaaggaaaggagtggcttgtccaagcccctcctgctccagcccggtcaaatgcggcaggatttcccccttaatcgccgccacgttcttccggatcgcgactccttcaggtcagggcagcgctagaacaacggacgatccactgatccggtcgtcttcggctacgaaacggcctatagttttcgtttagttctttctttcttttttactggtcggttactcacttcgccgacgtcgccgtccgaatgcgacggagcagaatctgaatctgtgtacctgtggccgtgaggaaaagataagagaagaaaaaaaaatgaaaagcagtactgcgtgtacggtgtaacgggtcatttttttctttgctgcgtagtaatgtctgaattcaccgccttaatcctgtcacgagcacagtcaaaagagtgtcattaaccttttccaaacagagcaattaccagctaattatggcgtcacccccaacgttcgactgtgtgctcgtctagggcggcttgattacgcgccattagggcttaataatgcggattagtagctcaacaatccacccacacacacacagagctttgtttttcttttatttttctttttccactggtgatatttttctgcttccaaggcttccggctttctctgcctatagaggagcttttcaccaaactcccctttccttcctcctcctcttctccccctcttctcactgttcttgtgaatacttagatgatatcatcctgtcactgtcactagtcccacttcttccccgcgttatcaaagatttcaatctctataggttctctgatctcgttcgcaatcccagattccatctgtaaaaaaagtcttctttgttgcaatccggattgatagtcttgaggaggttcttgttcagctttttagaaggagcaagtggaggagcaaggctttgttttttgtttttatttgctgtttctcttcatcgaacgagaagaaatcggcagtttgtgggagtggcttgttgttctaggagaaatcgtggttggatcgtgttctttgctttgtttcaatccgattggcgacgggcgccgagggatttagcgccaaaaggaaggaatttctgtgcttttcttcgattacacggcgaattctgggcgggcgaatttggcatcttttgatcgcattttgttccctggctggcgagaacaccgagagctggggagatggtctcggaggcgcccatggcggcgggcgccgtcgtcgtcaccgcggcgctgtgcaagaggagcaaccgggtcgcgcgggtgctcgcctacgcgctcctcgagtggatcctgatagctctcctcctcgccaatggcgtcttctcctacctcatatcgaggttcgccgccttcttcggcctggcgccgccgtgcgccctctgctccccgctcggcgtggacagcctcttccagccccgcggcgaggggcagggcgcccgcgccgagcccctgtgcc

SEQ ID NO: 31335 - DNA, 1200 bp, Oryza sativa
tttaatgcagtttctcttgcaaattgtcatgttactgtgatggggatgttcattgaatacccatgcttagatttcaaattttagctattgcaacatcgcttggtactgtagactgtagttggcattcatttttccatcttgcctgtactgccacatttgtactgatgaacctttattgaaagaaaaacgtgaacagcctgaactaactgaatgttgatagggtgaaatggacgttgtaacaaaatagaagtaaactcacgccactaaatgtacttcgagttgttcagtgctggttgttttgtatatttaatgttactatgcaatctgccttgatttttgttgcatgcagtttgtgagaagcatagtggattgaaagacaacaaccaggaaatttcaatcgggagtgagatacctgagaatgagcagggtgctgtaaaacaagaattgctttgcgtgctgacaaatccgagggggaatgaatttggtattgacaatttagaaggaaatactgagacagttcatcaggctgatctcaataatggatggaattcgatgccagtggaagctggagtgcatgcctctgaaacttcaactgagaacaatgaggagtggattcagccaggtgagctgagccagaaatcgaatctgatgccgatatactctagggagcatgctgatgaagaaattaaagaggacagaatttcactgactgagataaaacaaggattggactctgtgacaattgattcttgggaagaagttcatttgatttcaaatgatggcaccaaagagaatcaggctgaacagcctgagctgaatcatcaatcaacttttatgacagtacgtgctattgagtatgtaacagacttgtttgatgctaacatcagtgcaggcaacggtaagaaataagattttaatcatttggtttgtatcttttgttgacttctctagtgtgatcaactgatcatcttttttttttcaaattgatccagttaatccaacagaggctgctctaccaagcttacatcaattctcttatggaccatcaacaagcttaaacaaattatgtcctgactataatgatgttgaatcagagagtgctccggatacaccaattcacattgaagatatcgatggtttacatgagttggcaaaccataaagcaatgacttctgataccaagtcagttgatctggaaag

SEQ ID NO: 31336 - DNA, 444 bp, Oryza sativa
  unsure (1)..(444): unsure at all n locations
nnnnnnnnnnnnnnnnnnnnnnnnnnnnnnnnnnnnnnnnnnnnnnnnnnnatgtggctgatcggggcaagtatggaagcaatagctgatcagcagaagcttacgttcaagaattctccgagcaatcgtggaaggtggggtaatgtgggtctttggagttatactcgccatccaaattactttggcgaagttagtcagtttattttgcacgaacaagcttgggttttactaacctgtaagcgaaaaggatttgcctatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31337 - DNA, 470 bp, Oryza sativa
taaaatggtgtgatgtgttagcatttttgcaagtaacaaattatataatttcaaagagaagttgtggttgttaaccttcagaagtgggattccactaacgaagagaagcaagagcgtcaggaatacaggtccgaggatcacgagccattcagctcctgagagaactggagtagatgctacaaatattccccaccaaaggaatatctgtgtccaattaaattgtcaaacaaatgtcagtatttgttcaaaacactgtaaaattaaatagattatatcatataaagtgtgtgcagaatatatataaccagcagtgcacaacaaaatatttgcaattggtagaaacagatagctatgcaagatgaatggcatagaatgagaaggtccaagttttcaacagttttttttagcaaactattgacctatgttttactttattttttcaaggtcaaactgcataggcaaatactttt

SEQ ID NO: 31338 - DNA, 1517 bp, Oryza sativa
tttaacatatttttggtgtttcttagttcattctctttatctccttctctctttgtttagcttaaatggatttatttttcttggccgcaaaaagtgttacataataatcgtaccgactcaaatatatgtattttctggaaacattgtgaatgtgcatttcaagcattgaagtttttttttagagtgggttttataaaactccaccagttatggacaaagttgtacaaaacaaaagggattttagcacgtaactcatagccatgaatattattgctcaaaagtttcacatgaccacaccattaaccaatttaacatacttctatatcaaaatttaaaaaggctatacttgcatggatataacatctttatgatggataaataaaaactcatgaatttgatataataaatctaaaactcagaagttgttgacgagggatactcgtggaccggatgagttgagtattggggtacgttggaacgagggtctacgtagtacgacatcacgcagacagaagacaaggattatactgattcagaccccttatcaggtaatagccctagtccagtttatatgagattgatgatgatgagaacaaattacaaagagaatagtcgaaacagatggtaccgatgagatcgtagtcgagggattcgacgagatctcccggcgacttggctctgtgcactctggcttcgtaaactttagtgggtatgtggatgatgagatgcgatgcccttcacctccccctaggggccccttttataccgtggaataccttgaccctaagtaagacttagggataccttgaccccaagtaagacttagggatatgtaaactggcacgatataacaaaaggctttaccccttccgagtaggactccggcaattacttaactcatagagatattttccataatttgagataaattcctaacgacgtatacgaaaacgatccgtacacgtgaaggtataccttatcggtatattctataagtcgtatgatagatgatatgccttatctgtaaccctgacagaagtatattagatcaaagttcaaatgatcaatagtgtggttttatgaaacattatgaccataatacatgggactatccgcaacgtacgaaaatccctatagttttgtgcaacttagaccataatacgcgtggttaggtgaaatttactttacaaaagttcacttactaagtaaaaatgaaccacctagttaacatgcatttcttctttccagtttctatttaggcaaaatgcttgagttcctactacatagccatgctcatctaatttggtatcattgccatagtgattatttatagacaagcaccatatatgtaccagtgagtgcaccctcttaccaaacaatcaaagggaaaaaaacaaatgacatatctctaactcgctataaccattaaccccagcaattcacgtatgtgtaatataatccttttgtgaggttggaagatatgaaatagaaaaactatgtgattttcaccataggtt

SEQ ID NO: 31339 - DNA, 2929 bp, Oryza sativa
  unsure (1)..(2929): unsure at all n locations
nnnnnnnnnnnnnnnnnnnnnnnnnnnnnnnnnnnnnnnnnnnnnnnnnnnnnnnnntttcccctttgtctacaccaatagttcaccagcgtgatcaccaagttttcatcttcatcattatagtttgaggggccatgaattgaacaactgtacgtctatgtattcatctcttatcatcaaatcagttgatatcatcacttagattaaattgcttactctttggttttcgcgtgtttccccatatagatgtgagaccagtacgtccggagtcctttcggccaaagttttgtaaatattatccatcatgggtttggatatcaaatgagcattagcgattacaatgaccagctagcaataagatcgaggtttgtacggttgtatcaattccatataatcgtaatttaatcataatatatctcatatgccctcttgtcaaaaatatttgacttttaacacaagatttagtcaaaattttaaaacttttaaaattaattttgtgttataataaatttgtaaaaacctatagaatttatagtatcatgataatacttttcaagacaaatctacctgcactctttgcgtgttttctaaacttgccctctctagttataaatatttgatgtttaggataaaattcaatcaaattgttaaaactattacccccaataatttctcaggtgcttagttaaagaaaatgtatgtgcaattctgttttgaaatttattactagattttacaaacacgagattatggtttctttcaatggtggagaaatgtttttttactcccagttggtaacccccgtagtccggttttccaaccaggactaaagataaaaaagtagctctaaccttttgaactccccattttttttacaactgggaccattgtggaatttggtcgaccatggctaccatggatacaaccgttgctcacatcatggatcaagaagaacacttcaagatcaagccgtccaaattctggaatccaattcggtcacctgctaccgtgctgaattcaaatggccgccaaatgtgcatacgagctccgttttgggtccgtgagtacttgatggaaagctctcggagtcctctttccaacgaatctagcctcgtatacaaattccatctcatttggctgcaatcgcataaacaaggtgctgcgtcacctatattgggccaatgggtttgtaacttcgtttgggaccttggcctaagtggggcccatgtggggtgcgccccaaccaggtggagcacgaccctaggcaccactattaaagtttagctttgctactttgccgtgtaatcctgtgatcggttagatcgccggtttactcgttacgtaaccccaacttatcatttgtactcaattcctatttgcaattcagattgtttttatcttgttcttacttgtttcttcgatttgcttgcaggaataaggttgatttgcatcggcaagatcaacagcccacggagaggtgtattgatcgctaaggcgcaacgcaacgtcttgtacggttgtagtcgaatcatcaacgtttctctcaaatcgtagttatcatcaactcaccgaaagatcgggccaaacaactgtcttgagtgtcaaaatgaactcaggggttcatcatggtttctccggtagttttttattattattttaactaaggtttctccagcagtggttatatctaatcgatcttcccggtcacatgaacgttcaaacactacagctagaaactcagcctgctgcatataccttgctagatatggtttccacatccaaagtgcaaactgcaatctcgcatgcatggattcgtctttcagcaaactaagcttttggcgatcagacaggcgccattcgatatctcagccatgactcaatcatgttcgtcactgtcatgtctcggagggaaccgaacgctagctaacacggcacatggagaataattgtcgaaaaacgacatggcacacgagcaatcaaccgacgatggctactcacggaattatatatatcatcgttatcgtgtactcttatgtagtatcaaatttatgaactgccccttcccttttttaatagatgaagccatctccttttacactactactttctttttaagaatcggaaactacctactaagcgcatatattctgccgtaacgtgctcatcgtcctctaacccagtacatatgctgattgtaatccataatagcttatcaattatccaaaatagttaatgagtatatatatcattaacgaattaaaaaccaatataaaaaactacaataaaaactaaaataaactatgagctgtgataaacacaacagaattttaaagcttgtttagagagtttaaaattttgagaagctagtaagaatctgaaaaggttgaattttccagtatgacttttacttcattttctaaattctagcttgtaacaatctaaaaaaattggaattttcagcttctaacttttactttgttttttaaattctacaactatatattactagaaaaaatacccgtgcgttgcaacgggtgaagtctattttaatcttattattgttatatggtttagttaagatgaaattcactgtgagaattcgcttggatatatatatatatatatatatatatatatatatatatatatatatatatatatatatagagagagagagagagagagagaatcatgggctgtagttaggacttcggtcgtctcaagttagcatgcgagtttttttaaacatattttttatatgattacttctgtattatcaaaagtgaacgatcttaaaaacctacccatacacggataacgtatcaaaataccagcaaaaatatcttcaatttttataatagataatatttcagagactgaatgacaatctaaactattgagtaaagtccatcaccagtccctaaacttg

SEQ ID NO: 31340 - DNA, 4988 bp, Oryza sativa
cctattaacttaacattttaagtcagttttttatatgatttataaattaatggatttaaagttttaagttaattggtgaagtcatatctctatcttacataaacaaaaataattttttcaacccagtttttggcttaatagtgtataagagtgacttatagctttagaagaccaaacaaaaagctattatttgtttagatttggagttttcgactcataagttgatttataagcataaataagagggatttgtttaaactggatctaaaaatacaccacgattacaagcggcgtcccggtaggcaaaacaacctaaaaaggcgcctgcgcacattgccttgctggacgacgctggtgcatgcacgcacgcacggcattgcagagcccgtgacgtgagggcgagctagccaacaacgctcacgagccgaatacaaccaaacgccgctccgtccggccacctccccttcctcctccatcatctcaccgggtgcgcttcccctccccttcgtacaacgaagatttgctattcgccagggcccaaccacagttatagctcacgtagccgctacaggcttcttcgccgcctcgtctcctcctcgatctcccttcctccctagaaaatctctcggatctcgccgagagctagcggctggctggcggcggtggcgcggtggcagcaaagtgtacgctttgcagttgctgccggcgcggcgcggcagcggtgacgacgaagagggaggaggagagaggctgtgtcgggtttgtgttgtgtttgtgtgtgtagtgtgagatctggagacggccgggaggatggcgcgcggcgggagcttctcgcggctgcggctgcgcgcgggggtcgttgtcgccgccgccgccgccgccctgctcctcttcgccgtcgtcgcgccgcccgccgcggcgctcaacatcggcctccagtccgccggcgacggcgcggtacgtacactatatacgtcactacccactctctctctctcctaatctgctcgtactcgttggctaacaaagttgattaatcattatgactgggggagcgacgccccagagcaaggccgggttgtgcaaccgcacgtgcgagtccgaccactgcacgagtaagtggctatgttattcgtcgtcgtcgtcgatcctaaatttgattgtgatatttgctctgacgacggtgatctcgattgggtgcgtgtgcagcgccgccgttgctgcgctacggcaagtactgcggcatcctgtacagcggctgccccggcgagcagccgtgcgacgagctcgacgcctgctgcatgcaccacgacaactgcgtccaggccaagagtacgtcacagaactaatccatcataattaccaactactgtcccgtatttgcatagcatatgctgcttagttttctatgtgtatatatatttttttttctttcgctcatatcatcagatgactacctgagcaccgcgtgcaacgaggagttgctggagtgcctggcgaggctgcgggagggctcgtcgacgttccaggggaacaagtgcatgatcgacgaggtcatcgacgtgatctcgctcgtcatcgaggccgccgtcgtcgccggcaggctgctgcacaagccttagcttacatagcctcagccgtgctgcaggcaccacccctgccggcggcgaacggcggccggatcgacggcatgggcggcgcgaaggatgagcagtattgtcctctaacttcgaatcactgacgtgtaggtccagtagatgtggggcctacatgtcagtcagtcacagtcaataatgaccgtactacagaggataaagtgcttgtgcgttattgggtgggtggtacatgttttgcttgcttggtgtgtgtcagtgtgtgtgtgtgtgtgcagcttagctagcaccgggctggcggctgcgtgcgtcgccttcaacttcacagttcacgtgggctcccccttgacagaggcccagacttacgacaaatatatgcagatcacaaatattactacatggttttggacttcggttttgtgccacttgctgctttatttatcgtgcacatctggtgtgataatgttatcaataaacgtatacatgtcccacataggtatgacaagacaattcgtctgccggtttggattatgtgatggcagatggtatcataagcttttcctttccttcagatggatctttgtaagatttgtacttggacggttggcgagtctctatgacgggatatttaggacatccatgatatagtagaaaagtaaatattagtaactaaaaaaatcttattatcaggtaagatatattgtgaaaaatagtaaatagttactaccaaattataggcttactttcaagatataaacactttgtgacgtgtcctacctattttttagttgtgccattgcttatgtttgtggttttttcagttcaccttgttacccgtactcttcacatatagacattgtgatgtaggctgtgtttagatccaagggtgaaaaattttagcgtatcacatcgaatattcggacacacatttaaagtattaaacctagattaataacaaaacaaattacatattcctcctgtaaactacgagacgaatttattaagcctaattaattcgtcattagtaaatgtttactgtagcaccacattgtcaaatcatagagtaattaggcttaaaagattcatctcgcaatttacacgcaatctgtgtaattaattttttttatctatatttaatactccgcgcatgtgtccaaacattcgatgtgacggggtgaaaaagtttttacgagggaactaaacatggccgtattttcaatttagagtaaattacacccacggtgtatcaacttggtaggtgggtgtaatttagtacaagaacttgataaatgagtattctagtgcaacaacttggtagatatgtacaatttagtacatgaactttataagtgactgtataaatgcaacaacttgcaagatatgtacgattttgatacaataagttcagaagttatgcgacaatttaattatttggagcacttttttatacatattcaatttttaagtacttattttaacaatatactagtgtggttttgtatataagcatatttatatttttatcctaataactaataactgaaagtcaattaaactggatgtaaaaattattatatttcagttgagatttgagaaggtgaagaaaacaaaaatttttaaaggtaattggatgtgcagtataattcttaaagattaaattcaatattataaggtattaaggtaatatccgtacgattgctatgtaaaggcatattgacatcgcgagaaaaactcacatagcatatgcttagctaagttgatgtaccaaaatactaaattgtcaagttcttgtactagaacgtacctacttgtcaagttgttgcactcgaacgttcaattctcaagttcttatactatatcgtatccacctatcaagttgttgtatatgggtgtaacttgttctttaattcaccattaacatttgacatgggtttatcttaccatccacttttgtaataaacattgaggatgctctaggatctgcgtaactataaagtactactgaacagtgggctaatcagacaacttaagaacacatggtcataactatgcaggatgcaaccgtgttcttaaacagagtcgttgagctgtgtttattaaggaaactgcaataatacatgctatgaccgtgtgattagttaacagcctaacttacaatactgtttattagtcccgttgaactgtatcaaccatacggcagatactcccggagttgtaccgcttgctcctaggatcagctactgaccacatggtaaaaatcaggcaagaacagcagttgaaacaaatatttttttttttgaggggatagaagcaaatctaaagaaatgttgctccgcttccacgattcatcgaacagtgggctaatcagacaatcagcgtctgtttgaaaatatgacgagcattgctgatttgctgtcggcatttggtaacattaagaactggagatagattttattaagcataaatatcacccctggaaacagagtagcagcgtagttgtgtgacttgtgtctgaagacggggaaaaaagcacagctactctacatcgtacatcaaatttattgccataaaattcatccatgaaaacagagtagcaaggtatttacactgtctgaagacgggagaagaaagcacagctactcaacatcgtactgcagatttattgcgacgaggataggtaatcagcatcatcaccattgcttctaggtcatcactcgtttatttgacatataggtaactgcttcaactaattttcataaagtggctgaggtgggattttcctttgtaacctgagaaagcataaaaaagcatgctagcaaattttaaaaaaaggtggaaaagtttatgaaacatcgatagctataattttacgatgttgtatgaggtgtactggtgtagtatccacttcagcattgcaagcaagccggtaagtttaagatggagtacttgttatgtataaacaggaccaaattacctacaaaatttctgctaacagtgacttaaacaaggacactaataaatttctgccttcggagttttcaagtgattgacatgaaagataaagtaaaacatcattcccatttgtaaaaatacaaacagcggcacaataccttgtttcaatatatacaggtacaagtaaccaatatgtgtcctgtgttacaggctacggcaaaactatacagtatcaagtacaagattatgcagtataagattatacagtctaaaacaagtacttcctccgtttcgcaatgtaagactttctagtattgtctatattcatataaatattaataaatctagacatatatgtatctagattcattaacatctatatgaatgtgggtaatgctagaaagtcttacattgtgaaatgga

SEQ ID NO: 31341 - DNA, 2880 bp, Oryza sativa
gcaggtctcttgtagcgtaaagaagagaacaggctggaaacattcgctccaaaagagaactttttgaacacagggtcaagttcatgtaacgctgcataaattactgagcagtgaatggcaatatctcaagatatattgttataagtatacaagtatacaaacaatataagcttttcaaagcatggaaaatactaacgttaactagaaaaaaacaaccaaacaggcaaattcaaaaacaaactaactcaagaaaatttctcttaacccagattaatggaaatgcaaacagcagaaatagcaaggttgaacaagaaaatttatgttcagaacaagaaaagaattaccaataaaagtgctacacgattggttataagactattccagcagcacctatgaatcgaatgcaatcttgtttaggatgttacgttgttatctttcggcctagatgcaatgtaaatatttgtttgagcaatcagagaagtctattacaattttcgacttctatatttaagtaggaaaatccctgactgtttctcacaagaagtcatcatgctaagacaatttacaacttgcatagcaagtggcatcaggttccaaaccatgcaacataaacaacacaataatcttgcaagattcaatcaatcatcatagtacaaactacacacatgtataaccaatttctacttggcatactgaccgtgcccaactttattgattgaaagttcctttgcctgcttcaagcatccatcatctccaaatgccttttctgtgagtaatagaaacagcaaaatatataaatataaatcactatccaaatccaagtaaacctgcacatgctaaaagatgtaaagcaacaacagagccagaagaactgttcgacactaataggtctgtaactagtacacattatcttcttgtttttttttaacaaactaccaaccaattccttgttcagatagcataactgatgaatgttaaactccacaactccaagaggatgaacttcacttaccctcaaagaagaaagagatattctccgcactcttgaagaaaaagtcgttcttcacctgccgctgcattgggaaacaatgtaacagtaagttcaaaccgcgatgcatgtgccactggcaatcaaatctagcagcgagactagaaactactcctcctgataatgtacatacgacaagcatacagagacagctattcagtaaaggggaaaaatatctttccccagacatacgtgatcctttgtggagaagacgtcgccagcgccgtcgaagccgtcgacgagctccgccatgcggtccctcatcgccctcacctcctccgcgctggagaacgaccccagcacgaggtaccctgcgaccaacgagacccccccacgcgcgacaaggatttaggtcccctcgtatcgtacatagttctagctgggcaattcgctgcctccgattgctgggagcgacactgaccagatggccgcggaggaggaggaggggaggggaacgagcggtggctggcgcttaccattggcgtcgaagaagcggagctgctcgtcggtgaggctaccggccggcggcatggcggcggacgggaaggggagatgagaagtttgacgaaacagggggcgggtggattgcaggagtggactacaggatactacacgaaaccgcataaagctggaataattaactactccgtatttgccactcggccgtgtttgcaatccttcgttcccacccttctccatcgtattccccacacacacgtactatttaaaattgctaaatgggtgttttttaaaaaaaatttatacaaaaattattaaaaaatcatattgatatattttattttaaaaaatagctaatatttaattaattacgcgctaatagaccactatgttttctgtgcacactgtacatgttggaaacccatgattgcaaacacagctttagggcgttcggaaccaagtgctcgcacggaaaacggagcgattcattagcgcgcgattaattagatattaaataatttttttcaaaaatagtttaatttgtttttaagcaacttttgtataaaaactttttttgtaaaaaatacaccgtttagtagtttaaaaaacgtacgcgcggaaaacaagagatatatgttgagaagagagggtgccgaacacagccttaatgtggtgataaaattatttatcactaaacccacatgtcatagatatatgagttctcacatgttatagacaatgagtggcaaataattaattgtcacatcttaaaagtggcataaagttaaatgtcccatttttacgtttccttgaagcaaaagcgggcatcgagtttcagccacaaacgtttacgcttccttggagggaaagcagattattgtggtgcgagcgtcttgggcttttgttttgtaggcttctaagctgcctagcaggaagctgggccttactacatactccctccgttaaaaaaaaagacaaaccttgggtttctgtgtccgtcttatatgaaagtttttttataattagtatttttattgttgttagatgataaaacatgattaatactttatacgtgacttgtctttttaattttttttcatattattttcaaataagacgaacggtcaaacgttggacacggaaacccagggtttgtcttttttttaaggacggaaggagtatatcggaacctttgatccgtacggataaggtttttttttcatttttcatttatttatttatgaaaatatttataaacataatttttatatttttcaaagtattgcagatttaaagattctacacccgagcttcttgatagggggtaatatttgaaattacaaattatttttctaaatatttcaataaaaaaa

SEQ ID NO: 31342 - DNA, 903 bp, Oryza sativa
tgctccggcccgtgaccgcgtccgacgccggcgagttcgaggagcaggggttcgtggtgcgcgtgctggacgaatgcgccgagacgtggaaggagccggacgacatcggcaacgtggcggtgctcgtgaacgcgtcgggcgcggtgccggcgtctacgcgggagtgccccgggttgcgacccagcaccgtgtacttcgccgtggacctcgccggcgagacgcgcgtgtgcgcgtacagcctcgccgcggcggccaagggcaagcacaagaggatcgaggtcatcgagtcgatccccatggcggaggggtacaagccgccctgcttctggttcgcgccggtctacacgccgtgaccgtgccaccgcggcggctcgagtttgatggtgaccattgcctttggatggacgtattgcgagttggatctaagccagaagaactcagagaattgtccgtcttcttcacagtggaattcttgcatggttgcatatgtctttgcatgtctagtgttcatcaaccttgagtatttttatctcttgtggatcataatggagtggtagattatcaggaatccaggatgttctctgctttgtgtaaagtagatcagtataggagtattagattatacggagtcatatatatgaaggttcatcccaaatgtcagcaacttttgagtccccggcgattgtgtcgtttatcccaaatgtaccaacaaattctcttttatacggtcgtaagaatctcctttattaatgcgagctacagcgagatactactactatactccctctgccgatgtgccctttctagtacaacaaatctggataaaggtctatccaggtcctctcctaggttagcttttttttttggacggaggaagtagatgtaagagggatgctatataat

SEQ ID NO: 31343 - DNA, 764 bp, Oryza sativa
  unsure (1)..(764): unsure at all n locations
nnnnnnnnnnnnnnnnnnnnnnnnnnnnnnnnnntaagggtttaccagaaaagcatgcaagtccatgtgcaatgaagctaaagctagccttatcagattcatgccctcccaaacattcgcctgtatccatctcaggccaaaacataaccacggagagtttgctcctccagaatcaggagcgaaatatcaccacaaaatcatcaattgaagtcagataaaaactagcaattttcaactttcatggttagctatcagcaatgttaacttattcatatgctatcattctgtgttattcatgtgtcttaaccatgttagtgccttaggctgcagcaatttcgaaattatttttgcaagtctagtcacttcactggctatgttggaactgcccttgtactaatgatgaaacttgcatgcagagctttagaaactcgattgtattgatgcccagcgaaattgcaattaaagttgcccaataaaagcatactattgctgactttaagaggcatgtaaattttgtagagtttatgttgttgtttgttaacttccatgaaagtttcacccgtctaaaatgccaaatggatccaaagagttgcaaaattaagcagcacaacttccattggaggaaaagaaagaacaggattatatgttagcaacataacctttgaatagcatatgaattgtactatcatacctggcaacaccctgacatgctagctaaagatgtaagacatgatgtctgaacattgtagtcctgagatgaaagt

SEQ ID NO: 31344 - DNA, 704 bp, Oryza sativa
  unsure (1)..(704): unsure at all n locations
nnnnnnnnnnnnnnnnnnnnnnnnnnnnnnnnnnnnnnnnnnnnnnnatcgtcggacaacacagcgactacaaggctggtgaacgccgtggtggccacctgcatgccgccggatgtgttacactacttctgaagtctatcctatcctccacgtcaatcacatgcaaccacgtgcgatcatgatctgcagttagagatagagttcctattatctagttaatcttgttttgcatgcgatgtaatctcttccaggttgttaggtagctccctggtgatcgctcccaggttgttgggcaacttcctggcgcacatgtatagccacaatcggggctgttccgatctaattaacacgaacgctccgcacagcgtgagtgcgagagtttccatccaatagagaaaactcacatggtatcagagcgttgatccaatctaccgaaaaatcaatcccttccacctttccctgccatggcgtcttcctctagtaataccggcaattccttcctaggccaccccgtgagtgagaaacttgggaagaacaactacgcgttatggagagtttagatcagcgctgcagttcgtggtgctcgcctccaagggcacctgacaggcgcgacgaagaaacctcaagcgcagatcgtcgtcacaagcagcgacggcaagacaacagagaagagaaacaatccggagtttgatgattgggaggcc

SEQ ID NO: 31345 - DNA, 297 bp, Oryza sativa
taagctgaccacgcactgacagtctaaccaagcaggactgtcccacaaaggccaagcgaaccgacttgacctaactggctacgacgaggtctctaccaaaatggaaacctaccagacaacatcccgcagacagcgaggcgaccggcgtcgtaccttgtacaaattagtcgtagtactcggaccctcaattgccccaaccccgcaccgtcgttatttcgttttcccatcccagcggtgttttgctcgtcgtttttcctctcgatcggcccttgaccagcttgcgctcaactttcgtgg

SEQ ID NO: 31346 - DNA, 602 bp, Oryza sativa
  unsure (1)..(602): unsure at all n locations
taaagtttcacaaatcctcacccttatgacctatgtatgttgagcacaaatttacttaaaattctaaaccatggtgcatatgaaaattttaattattaagttctttactaaggctgatagtttaactcttcgctacattgaaaaaaatgtttcaaacatgctgaaactaatcaagatttgaataaggtggggttttatgaaacattgaccataagacctgtggttaagtgtcacaaatcatagcacctgtggttttctgcaactttgaccataaaccgtaaggttttctggaatttactcataaaataaaggttcataacaataggcatggaagcataacacccagttactatagtactataccataaaagacttactttgggcaaagccaatcacccttcttcatttctgtttcagttgtttccctaccctttccagctgagaacttaggctttgcaatgcccttgtcaaaagttttggtcttgctagaagtttggaatacaggtttaggaattgatggatcaattgttgtgtcgctaagcatagtaagctctgaannnnnnnnnnnnnnnnnnnnnnnnnnnnnnnnnnnnnnnnnnnnn

SEQ ID NO: 31347 - DNA, 553 bp, Oryza sativa
  unsure (1)..(553): unsure at all n locations
cgaattcgagctcggtacccctaatacccttttctaaagttatatatataaattataatgtagttatataaagtttaaaaaatataattacactataattataattatattgtatttatgtttaataactttttagaagaagatttatcgactagtcctaaacagaagcagacacataagctaggggacaattttagtatttacaaagccaaactttgggacaaatgcgagcacacctcttaaacacacccttaactaaactttaggtataagagcaattttcagttcacaaaccttgcagcccaacgcgtacgtaagctgaccacgcactgacagtctaaccaagcaggactgtcccacaaagtcaaagcgaaccgacttgacctaactggctacgacgaggtctctaccaaaatggaaacgtaccagacaacatccgggagacagcgaggcgaccggcgtcgtacgtagtacaaattagtcgtcgtactcgtaccctcaatnnnnnnnnnnnnnnnnnnnnnnnnnnnnnnnnnnnnnnnnnnnnnnnnnn

SEQ ID NO: 31348 - DNA, 12190 bp, Oryza sativa
  unsure (1)..(12190): unsure at all n locations
ctctcttctctcctgcaaggctgcaacgcaacttccaaggcttaatggcgatggtcagtcacacaccgaagaaaatgaaaagctttgcagtgcagagcaggtagttgatgcgcaaagaggagtgagttcaggatcggttctcttgaaagttcagttcaggatcgatcgatcgattgtcacatgaagaacgataacaaaagtaataataataatggagactccctctgcaggtggtagacccgaaaataatacagggcccatggagcctactgggtacacggatgaataatacaaccacgcatcacatgggtagagatggagagattagacggggagaattcgcattatgaaaagatctaccccaatcgctagcttagccctcttgttaattagtgccgctctaacctaatcgacaggaaatactagtcattagtcaaatggcacaccatacacgtacactaaccacccaacaacgcaaaatattgatgcgtcggctgttacattgcagatgcaagatcgatcggttcatcgatgggttgctctgctgctggcgatcagggtggatctacgatgttagcatcggtatcaggtaattccgacgatttttggcacctatggttaaaatgcttattcttatattataacacataaatataagtataactagaatgctatgatatctatagacacatcatgatatcagtgaaccagatccgtcgttgctggcgatgcggatgagcaggtggtgtggttcactcacgcggttgtcattctctcgcgccacgtctgagctgtggtggtgtggcgtggcacgcgattctgtttcgccggcaatggtcccggtctgcggcctgagcccggggggatcgatcggattgaaagctaaaaagcgctgaaaagaggagccgtacctaaccgccaccgcggagccttacgtacgtactccactccgcggagtacacacgcacacgcatctgttgctgttgctgttgttttggtttagcctcgtgccgtcatgatgcgtggcaacgaagcggctgggtcggcgggcggcggcggcggtgcggctcgcgtgatcctctctctcgccgtgccgccgcggcctccggtctccgcgaggccacgacgcggtcgtcctggaaaaccaagggcttttgttcgaaatgatgccaaattacaccctattaaaattttaggaacttcggtagttttaagctgtattcgtttgggatggttgggaaccaaactccccgcatggaaaacggagcaatctattagcatgtgattaattaagtattaactatttttttttcaaaaatagaacaatatgatctttttaaacaactttcatatagaaacttttttgcaaaaaaacgcaccaaaatagtagtttgaaaagcatgcgcgcgaaaaatgaaaaggagagttgggaacaaggggaaacaaacttaatgtgccatataaagtgtttgatttgctaccgatttatatgtttgctaatatagtaccaaatttgataacaccaaaacctttggcactgccaaaatatttggtaggataaaaatcggcactaaaccaaacaagtcctaaaacctcgggttgtctccttttaggcgtggcatagatatgaattatccctgtcacgtttttagaagtaggatttctcaaaaatattcgtctgtaacagcggttatatagcctttttctaaggtatgcaaactttagaatatttgattcatccttttcttttctctatccaaaatctatcaaattattcagttagaacgcgacgcgacctaaaatggggataagtctctggcttcgttcgcaacagatgaatttacccccccaaaaaaaaacgatgcatgcacccgtggaagtgtgtctgtcgacttttttaatccttaacctgctcgtgcgcaagatggggatggatcacgaatcgggaatggatgttttaccttttccctgaaacttttccatctccagcaccgcgaaattcggtttagattagagttgaacgatcacactgaaggctgtagtggaagccaggtcaaagggagagctcccccgtgcagctgggggccggccggcttgactttcacttgcaatgatggggacacgcactcggcggcatcagccgctccggccggccacgtcgccggcgccgccgtgcagccttgcccgtgtcgccccgttccggtcaaaccagcagctgttctcctcgccattcattgctattttttattaccacctggtcccggaattattatgcactaatgcacctgaccacacgcttgttgaaactgcctgagacaggtcatagagtcatatagagaacaaagatctgggtggtgaaattctgcactgggtccggctctaattcttgaacagatcatggcatctgaatggccaggtttgcatcgaggagattggagaatcttaaggtgtatagtagtatactttctgagctactcctaactggttagtggcatggtggttgctactggaacaaacatagcctgatagccaatgacctgcctagcctaaaaactagtcatcctgtactggatccagaactgacccaacaaacctgagcctaacttgagcaatcaatgtatcgcacccatttattagagccagaaaatagccccaggcccagtggcacgtccatgcacaggaacggtcccgtgcttaagcaatccggcgctagattaggcacacatcactgacgcagacatcttcaaacacaggaagttctagtgacagcaactcgcgaacaaccaaaaccgaaagaaaagtccgaaaggttcggctgaatatatactagtttagccagctaagcaattgggcgtcagcacatggctgcctaacagcctctccgcgagtgacctcacgggaggaagccgttcagtacgagccctgaaagctgcagttcagagtgggaaagatgtgcacagcgtacaggtgatcatggcaaaaagttttcaacaggaaaaatatgggtgcctcaacaaataattgccaaaaccgatattatacatggaagtgggccaagaacaccactagagcatatttaaaggcattgtttactatgatcaactcccaaaattctgttttcgattccacttttccaaaacttggggggtaacaactaattgaaaacacagatgatagacagttctatcgccagtagcaacggtagttagtaccttatgaacttggatagcagcatcaatcggtggcactcaggtaccttctttttcaccccccaggcatgcagaacttgagtatctttatgcagaaaaaaaatccaacagcccagtatttacggaaatagcttctttaacctattgatggccacaccagctgtcttgttcatgggttctagaacaagggcgtggctgaaatctgcaaattgtagtaaaatggatacacaataagaacttgtacaaaatagtggacacagtttgcagattccaagggagacctgttaatggttaatactgtgaaatactggtaaggtatacagaggaagaaaggtaagacggaccatcaacagcctccttgtagtaacccagcatctcccttgcagtgcctctcctcaaataagcttttacaatctgaaaaaataaaaagatcgatgtgaattctcacatcaatgtatataaaacactactcaatgaattgcgaaaaggatcacacttatcagaatctcaactagatgtgaaagcacctactaaaaaacttataaacagcactgcattaatcagaaacagcccaaattctttggatggttgattcaatgacagaaccagctcatcataaagtaggaaatatagcatttcgagaaaagaattggaagaattgtcctatatcttgtacttccccttttgtttcattatcaataataacatcttaatagtagaataatatatacaaatctgaatgtgcgtataaaagtctgaaccaagaaagcagatcctaacctttggatcaatatcgatggcacttgtgcaatctgcctcagcttggcggtaactgaaaggggtccgaaaagacaaaccatgaaataattgatgcgcgaaaaaaataagttacagaagccagctcatcaaggtaatctttgagaaaaaagatgccatagaggttaataacatacctagctagctctagaaaagcagcagctctgttgctgtagtatgtagccactttattatttaatttgattgcttcagtatagaaatttattgccttttgccattgtttctccttaaatgcaatgttaccctgtcaaggaacaagtaacagaaagaaaaactcagtaaggacacaaaaaagggaagatattaatgtaataaatccataatggtggctttgttttttacttcaacagtggttcaaaagaacaacttgaacataattttgggccattacaaatagttttactgcactattagacctactggttggtactgatctgtatacattactattagatctgtaccagtgagtatactctgacatactgatttctaggttattactattagacaacctttttttctcttttcctttaacatgacaaattataagatgtaacacctaaaaactggcatgtatcgactagtgcattatcattagcctttttcttcaatttccatctagatggcaagctaagtgctactacggaaagtagtaactgtgttgagcagatgttagaaaatcgaaagctatgctaaaaaaaaatcatcaaaataagaaaggaactgactttctctttagcagcttcagcagcttcttcactcatcgcctgtttactcgagacattagactttgctagagcgtcaacttgctcttggatggtagcataaattgtttgaatggtgtccaataaaaatcgatcaccaccatgccttgcaatcaaagaaactgaaactggacacttatcatgtgtacccagaggaaccgtcacctgaaaagggtcatcaaaatagttgaattagttaagatgcaataagggtttaccagaaaagcatgcaagtccatgtgcaatgaagctaaagctagccttatcagattcatgccctcccaaacattcgcctgtatccatctcaggccaaaacataaccacggagagtttgctcctccagaatcaggagcgaaatatcaccacaaaatcatcaattgaagtcagataaaaactagcaattttcaactttcatggttagctatcagcaatgttaacttattcatatgctatcattctgtgttattcatgtgtcttaaccatgttagtgccttaggctgcagcaatttcgaaattatttttgcaagtctagtcacttcactggctatgttggaactgcccttgtactaatgatgaaacttgcatgcagagctttagaaactcgattgtattgatgcccagcgaaattgcaattaaagttgcccaataaaagcatactattgctgactttaagaggcatgtaaattttgtagagtttatgttgttgtttgttaacttccatgaaagtttcacccgtctaaaatgccaaatggatccaaagagttgcaaaattaagcagcacaacttccattggaggaaaagaaagaacaggattatatgttagcaacataacctttgaatagcatatgaattgtactatcatacctggcaacaccctgacatgctagctaaagatgtaagacatgatgtctgaacattgtagtcctgagatgaaagttccctggcatttagttttggggggcatcccagaacagttggaatgaccagaattccatcatcctgtggattaagaaacatcatgacaaagaaactaacagtatgataacactaaataagattatcacagcacattcaacgacatgttaacgaaatagcatcataaaataagtaatcagtacaataccaacaaataagattatcgcagcacatccaatggcatgtaaagattatgaatcagaaacaagagcagttcaggaaaactatcaccacataacatggatcctcaggtagacacttttactctaagcctttctgtttcacaaagaaagttctcaaatgtatacttcaggctaacagtacagtactaaaagtaaatgaaccactattttcatttccagaagaagctttgtaactgggcccaacattgtgttaactgctaagtaattggttcaaaacaataatatagcgaaggaaacaagagcaacatgaaatatcactgatgaaaataacatatccaagttcacggttgcagaaatatgttaaatatttcaatttgtccatatattcaattgattctagatttcatccacttgttttcaaacaacataaatttcaaggaaatgacatttgtaaaacctaaaaagcattagatatgctttccatctatcgttcagaggaataataatatgtttttcaataacatttatccaataaaaccagcaaaactatcagtgatggccaactaagtgtgttgagaaatcagtcagaagatcaaacaagcagttcctgacaatgtaggtactcgctactgaaatctcgctaaattccagttcatcccaaactcaattctttaccaaccttaagaagagcaccgagagctgcacggacttctttccttgcatcttgactgttattgatagttgactcaccatcatcagacaaattaccaactatgcatgcatcaacagcaggcttaacagagtttatccactccatatgttgatctttgaattcatgtctggaccgaataacatgatactattaatttttttggcacgagttaaatagaatacaccaaatagaacaaacagacacgagaaaaattatcagtttaattattaaaaaaaacaagccatgtatataaacaacagagtttgtctagtatgacttctaaaattagaaaacctaagccaaagccaaagtaagaccacataatagagcatggaatgtgttctttgtttgcaaatgccaaagcttgcagtagctaagggaaaaaaaacagctattccaattattaattatcgtgatctgaaaatagatatgtaggagggaaataatctacatgcaagcaacgagggaaataatctacatgcaagcaacctacggaagtatgtagttcaagtcaactaacatcattgtttcataaacctgtgaacatcatcagtttccacataaataactatacaggctagaactcacagaggaaatttaatactaccatattttatatgtaaccagtagttacttatttatttaataacatgatcatgtagggcaggagcatacttgtgaagaaactgcatagccctagaaagtgctagcaatgaagaaaactttgagtcaccatgaccatttgaattgttcctcaggctgggtattcttgaagccaaataattttcaagattaacatgacccaggacttgtcctaatgtaatacgcaagggaaaaaaatcaacatgaggaagttggtggccagcaaaaactaagggaattttaaaataagaatgacaagtgtaaagaggagatacatactcccaaatagcttttccacagatttcgtcaccacctgagtcaatcttcttgcatgcacctttgacatttcaaagcaatcatctgctatgtagaaatgtctgggttgtcgaatatcagcgtagggtagcctcagaaggagatggccaacacgacgcagtacacttggatccctcgcaaaccaacctacagacaaattaattaaaaataaatggggcacggcaagtttacaaatttgaattaagagtgattctggaagagattacaagtcaatacatattttgttctttaaaagaaatatattttcaaaggtacctatggcatccaggctaggagcgacaggaataacaccattgttggggacaacagcatgtgaaggccggaatgccaagacgccacaataactacctggtacccttactcctccaatggtatcaatacctgcagaatcacattctcagcacattatttatctattaaagtatatatgacccatgcacacaagaccttatggttccacaactgtcacaaagaggatgtattaattttggaaaccagtgaaatcatggacaggcaccaaagaaatttcaagtcaatgcctgaccctaaacatagaattgttttggatcctctacagtcgcaatgaaggttaacatctaatggagggaagtcagatggatcagacttggtagaatgatgcaatgtaaaggaaggcagtcacatcagaacaacttcttttcttgagatgcacataatagtaaaccaggaaaatggattgaaaaaaaaaatcatacatcaaccctaaaactgacaattgtcaattgtcaatcctgaaatccagataatcactaccacacataaacaactagtgaagtaattcaaatgtacaggaaattcagatttatactaagctctgatactaaaggatgaggagaaagtggcattaaacaaaatgttgcccaaataaggacagcatgttgcacgcataaatctctagacaatgaattaaaatagtcagctcacctaaggaaaaatctacaatgccagcagcaacagcaacagctgacccacttgaacatcctccaggtactcgatctggagcagcaggatttgttggtgtgccaaaatgtttattctcaccatggatactgcacgtgtattgcacaataagtaagatgtaagcacacattagacaagtgaattatggcaaactaatcttataaaatgtagagaacatttctgcttttgtgatatttcataaaatgaaatagaacatggaagggtttagtgaacccatatgcagaaagaaaaaatggttttacctaaatgccatttcatcaataacagtttttccaacacacatagcaccaccatctacaagagatgaaacgactagagatgtttgtgttgctgcatcatgtgtctttgcccattctaagctgccaaaacttgttatataaccagttacgtggaatctgcaaataatcaaaacaagacatctgaggtcaaggataaataaaatgatgtacacgacgaatgttaacaccaaattgataataccggtctgccccttcacagtgctgggaacaagttaagtacaaaaatgaaaaggtgcaacagcattttgtggccaatagtgcgcaaatttaagaaacacactttgccatttttggcactaaaaaagaattgtcatgcaggcatgcacagttttagataaatacatacatagctgctgcggatcaaatgtccatttggataatttgtgtaacctaaaatttgtgccagtagttgggttgcagaaaatagcattttctccatgaagcagatatgcccacaatacaattttcaggtcctaaaataattaagttcagattggtatctattagcaagtatctattaaatttataaggatataagagcctcagaggagaactaagttcacttcagaagaagtagtggtatcttgacccagagaaaataccttattccagttttagtgttagaatatgcactgaactgtaaatgcaccttaagtaggttaaaaactaaaaggttccaaaaaaatgtctggctttgagttgaaccagatgagagcatatccttaaaagttcaaaactatgatattatctggtattttagaacaagataattaaccatagtgtttataagtttgcatcacagcttcatgactgtatgaatgataaggttgacattcccccccccccccacccacaacaatgctttcaaaaaaaaattttcacaatgaagcatagaacatcttattatttcaaatttgtaacaccttgtaccttttatacacaatagtgtctattcataaagctgcaaatactttagatgggtggtttcaatactcttccaacgatagttcaagaattctttggcaatagaaaaaaatactattctggtttcctttgaatggttaagtaatcagcatcttgaagcaaattatagtccacgtgctaaaaaactgtaatctcaacttcaaagctaaactttaggaaacaaccatttgtcatgcaaaacttaaagcggatggtttcatgaataaaaggtataagtatctaataatgatacattcatgtaagtttagatacatgcatgatacattgccttgccaaaggcgaagcggccacaggatgctatgccttcttgcataataaattcaccttaccacaaaccatggtacagttactaagcaatgtaatactatggtagatcattaagtaatcgaataaacattacatggcattgtttcccatttcagtgtcagccaataatatttggcaagtgatacatgaatatatctcatttaaagggcgttataatgaactgtaagaccatctccactctgcatcttttggaccaaaatagtgtgatgcaaacacacctagctacaaactactcgcgttttgaaagctttccatatatgtaaacaaaaggatgatataattcagcaaacccaatgtgccatctcgagtaaattcgtgcctccctaactgacctgataccaataccccaatgagaagtagtgataccctgatagcatgatcaaactgatcaaattaccgctcttaaaccggtgctagcacgctcccaaccaatccaatcagggactaccaacttcaaatcacgcaaaaaaaaaaacacaagcgaggtcggggagcgcggagagagcttacgcgtcggcgatggcgaagcagagccccgtgagtgggtgtcgcgcctgggggggcggcggctgcggcggggggaggagctcgaggcgggcgatgaacgcgccgttgtcgggccgcgcgggccgccgcagccgcttcgccgccaggaggaccccggcgatgccgaggccgagcagaacccacaggttggccgccgtcgaggacgccatggggtcgggttggggtagccgctcgcctgctccgcgcgggggcgagtggggtgggggggagttcgagggttagggttttgccgcgaggcggcggcggcggccgcggaggcggacggcgaggcggcggcggaggcggaggcgtggcggaaggattggataataccgggggttcgctgctggcttcgaggacttaaatacgtctttggaaatgaaatgaaagggaactagctttttctgtgtttagatctaaagtttgaatccaaacttttagtccttttctatcacattaacctatcatacacacataatttttcagtgatattatctctaatttcaatcaaaatctaaacttttgcgttgaactaaacacagcctttatcaaatgggttatcaaaggaatttgtctctctcttttttagagtttttttttttgcagggcaaacataatttttgtctggtggtacaaattgagaacttgacggtattgtatcgtgtttacgtatgtgtctaagttgcaaataatgtattgaaaagttgttacagcttgcaatgtacactaaaacctaagaatgaattaaaaagcaaaatctgcccttcagaagcttttgtctaaggtacgtaagccgttgaaatataagcaatacaaaatactgaacgtaaacctaaggctgcgaaaaatggtgtagacagtatttttaataccgtcagtttattgttatataattttctatgtgcaagcagtacacggttcggttatatgcagaatgaacgatcgtataggggtctaagaaattagggcaatttaggtttcaatccaaaccattgtattttttaacatatttttggtgtttcttagttcattctctttatctccttctctctttgtttagcttaaatggatttatttttcttggccgcaaaaagtgttacataataatcgtaccgactcaaatatatgtattttctggaaacattgtgaatgtgcatttcaagcattgaagtttttttttagagtgggttttataaaactccaccagttatggacaaagttgtacaaaacaaaagggattttagcacgtaactcatagccatgaatattattgctcaaaagtttcacatgaccacaccattaaccaatttaacatacttatatatcaaaatttaaaaaggctatannnnnnnnnnnnnnnnnnnnnnnnnnnnnnnnnnnnnnnnnnnnnnnnnnn

SEQ ID NO: 31349 - DNA, 625 bp, Oryza sativa
  unsure (1)..(625): unsure at all n locations
cccctattaatttcgagctatgcgggaagggagccagtgccatcgccagtcaacgagcccagtagaggtcgagctcgccctcccttctatgagggcgcctcgctcagcaaaaaaagcatgcggcgggcacgcagcgttcatcccttcaaccaccacggcccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgaatagaaagatttctacggatattcttcgtatcaattttataatgcttatcacctccttctgagctattcccacggtgccttcgggtcaaagcttaatccttaatnnnnnnnnnnnnnnnnnnnnnnnnnnnnnnnnnnnnnnnnnnnnnnnnnnnnnnnnnnnn

SEQ ID NO: 31350 - DNA, 408 bp, Oryza sativa
  unsure (1)..(408): unsure at all n locations
ctatagggcgaattcgagctcggtacccgttcattcgatggaaacagcaaaaaaaaacaataaaaaaagaaaaaaaccaccaatatgcacgtggtgctaccattttagtccaccaaccgccaaccgggactaaagataatcccagttatttcacccggttctcggattcgtggtccggtttgcaactcggaactaataaaagggttacaaaacggaactgatgaggcattctcttctcctgattttgtttcatgctcctattttgcttgcttcaaactgggtctaaagcaccccgatgtgaagcaccactaaaacagtctggatatatcattgtcgtgtacaaaaatgattannnnnnnnnnnnnnnnnnnnnnnnnnnnnnnnnnnnnnnnnnnnnnnnnnnnnnnn

SEQ ID NO: 31351 - DNA, 1056 bp, Oryza sativa
  unsure (1)..(1056): unsure at all n locations
ccactaacaaattaagcaggcaaaaaaagttacaaaaggttacctggaaaatccagaaaactgctagttttcccaagttatcgcgcatttcatcaaaccgtttgtcctctccccattgaagaatcctagacaaatttagacaatataagcattagtaagtcattttggataacatcgaatgttttggctcaagctaaggataagcaatgtagcaagtaaggaagttacataaagtatatataggccatgtaacagccctacaacatcatagtcatgaataataacgtcaaaataaaagtgatttccttgaaaaaccaggcttgtttccttgaaactgagaaactgctagaattatcaagacaccacatcagtcctggactcaagtagtaagaagcatattgtgcatctgcatctgcatccatctgcataagcatattgtgaagatgataaatgccttctcttcacagtatccatctgcatctgtgctttggtggttgcatattgagcatgcttattgatcaaattcattaaccagttcataagtgaaatgagttatgtgatgggctgagcaacagccttcagagatagcaccatagtgaaattccaaaatggaaccaatattaattatcaggtttgactgataagatccttttgttgctcataaaaaagataacaataacctacatcagaccaacaacacagaatatatgcgtgaaggcatgaagcatttaagatagtagaaagtttagtaatgcatttcatatttgaacaaactttgctgttttataataatatacctcattaataagaatagtcctaagcgaagaccccaaatcacaacgagcacagtcaatacaacctgataaagggatgaaagttaagaaatccacaaattaaaaaaagcatgtattgttacaattataaaagaatatacaaacaaatggactgtagagttggctaaagctactatccgtcggtagatttccatgtaaaatggaacgaggttatnnnnnnnnnnnnnnnnnnnnnnnnnnnnnnnnnnnnnnnnnnnnnnnn

SEQ ID NO: 31352 - DNA, 1354 bp, Oryza sativa
aaggccggcgagctcccaaggaaggtggccatggcggtggcacggtgcgttcttggcgtggcgagagtgagcaagcaaagcaaaggctaatgtaacgaggatttttctggagatttttcctcgcttttttttttgggcgtcgttttgcagcgtctgttttggggcgaaatgtgtccacacaaaacaagcacggctactacacgaggcttatctgctactactcgttatctgctccgtcttgagggctacgtgccgaggcctgatggcgcaatctgacggctttccgttgtcgacaatacgtgatcataagcacatcgggaacacaaagcaagccgcattgcaaaaaagtcttaaagacatttatcttttttgagtctcacaaaaacttggataagactttcggtgctctataaccaattttgcataaacccttcccttcttaataaattttggccggctcagctatagaaccaattttgccaaaaggaaaatcggtttcattacaacaaaagatcaagacaacgtcgcagcgggcctgggcctgcggtgtagccgccaggcaatgtttccccatggaagaacgacgcttggttgcagaaccaccactacagtggtttcgtacaatatcacagcgcccccgtctcaagaaatggggtatagtaataatatggagaacaaggacgggctacaagaatgaacaagtttatataaacttacacttatcattgtcatctgtcagcacctgaaacaagcacggtcccgctgggtacgtctgaataacagcattctagatttcaatagttgacaaaagtcaaaaccagtacgtacagcttttaagatatttcaatataattaaaaggatgaactcagaatgtacggagttgaatcaagaaaacaaagcaacatagtcacacaacttaacaagatgcacatatggcagcattgtaaatgaatgaactattactacaaaacctgaaaactgggtattatgtatgtcacctaaaacttatgcaatttttcatttgtatcctaaccacctgtttatatcactgaccaagtttttacggatagaaactatctcatcaaggactcttaacgtagtatagtaacccactatgacaggttaaaacagagtaatagaacctgaaaactgggtattatatatgccacctaaaacagagtaatagaacctaacgaggatttttctggagatttttcctcgcttttttttaaaacagagtaacagaccgaattttaatttataataaactttatcaactcaaggacaattcaatagccagacgcaacggttgaaagtatagtaacccactatgacaagttaaaacagagtaac

SEQ ID NO: 31353 - DNA, 236 bp, Oryza sativa
  unsure (1)..(236): unsure at all n locations
nnnnnnnnnnnnnnnnnnnnnnnnnnnnnnnnnnnnnnnnnnnnnnnnnnnnnnnnnctgtgcacgatggagggtctgtatatagaatgtattatcctggtgtggtaccacctcgccaccaatgcctggttgctgagttgaggagaaattaacccaataaggaataaaagttatagtcaatgccaacaagaaactagagactgcacaaggtaccttaaagatgtacatagatgggt

SEQ ID NO: 31354 - DNA, 2359 bp, Oryza sativa
aggacgacgcagttgataagaaggaggctgatgctgcagcgaagtatgatgccttcgacatgcgcgtggacaggcactggactcagaagtctcttgatgagatgacggagcgggattggcgtatattccgtgaggacttcaatatatcctataagggttctaaggtaccccgtcccatgcggaagtggtctgagagcaagcttggtactgagctgcttcgtgctgtcgagaaagctgggtacaaggaaccttcgccgattcagatggcttccattccacttggtctccagcagcgtgatgttattggtattgctgaaacaggctctggcaagactgctgcttttgtgctccctatgctttcgtacattacccgcctcccacccataagtgaggaaaatgaggctgagggtccttatgctgttgttatggcacctactcgtgagcttgctcaacagattgaggaagagactgtgaaatttgcgacctatcttggcattaaggttgtgtctatcgttggtggtcaatccattgaagagcagggttttaagattaggcagggctgtgaggttgttattgcaactcctggtcggcttcttgattgcttggagaggaggtatgctgtgctcaaccagtgcacctatgtggttctggatgaggctgataggatgattgatatgggcttcgagccgcaggttgttggagtccttgatgctatgccatcgagtaacttgaaacctgagaatgaggatgaggagcttgatgcaaaaacgatctataggactacctatatgttcagcgccactatgccacctgctgtggagcggcttgctaggaagtaccgcggaacccagtcgttgtcacaattggtacagctggcaaggccacagatctcatcacacagaatgtgatcatgacgaaggagtcagagaagatgtcaaggctccagaagatactcacagatcttggggataagccagccattgtgttctgcaacacaaagaaatcagcatatgctcgtgcgaaggatctagacaaggcaggctcccgcgtactaattaaaaaaaattaaataagataagcgactaaagttgagcactaaaatttataattcatagttgcatttaaaataagacagacggagagagtattgtaagtaggggtagccaggtaggtgtgaggaacgggaggaccgtaattggtataggtagtactaatgaaatcgcacattggatttcagctcagcccaggtccaagcaactgtgttttactatatgaatgtgctcttaatttcttaaccctcctaaaaaaagaactatacgaatgcgcagtccagtttagctttctcatcttaatttcctttgtgtttgtgggccagattaatcgatcgagcacaccgaaacacatgaactttaattgcacacttaaaggccctctttgtttaggcttagacttattggcttaaacttttaagtcagcttattggcttatatgatttataagccggtggatttaatgtcctaagtttagtggttgagtcatacatctacctcacataagccaaaaaagcttctccaacctagcttttggcttaatagtgttagagtggcttatggcttcaaaaaagctaaacggaaaagctgcttgtttgtttaggcttagactttttgacttataagttggcttataagcctaaacaaagagggcctaagaactgttgtttaattagctccctgtccccgtgtcgcattaattctagccatacatctgggccctgtttgaaagattagctcatggctaattttgagagctattgtttagtcatgaattggtaggctaaacattagcctagagtggtaagtttggatccatgggctaattcaagactaaaaggtggagagagagagtagaaagagaggtgagagaaggagagagagggctgcctttttatggtccccttacaaaattagccccattagcaccccttggagaggctaatgttttgaggaggctaattcactttagccaaaaattagcccacttgtttggatccttgagggctaattcatggctaaaaggtgggggctaatgtttagcctatggaaccaaacaggaccctggaagcactatatattggcttgatagcgcaccgttttcctcctacttttaggtacctcgtccaaacagttcaacaacaccgttcacatcatcacaggagaaacaccgtctgtattctaatagtctcatatggaagcgtgtcgtcactcgtcacagattcaccgtgtggacagtgtgccacgtcggacggccagagtgcaaatattactccctccgtttcatatcataacactttctaacattg

SEQ ID NO: 31355 - DNA, 735 bp, Oryza sativa
ctgaagaatcaatgttatcaggtcaatgcacgagctgaaatgtgcttaccttgatcgagaccgtggtctggtgatcctcgtaggtcgtgaagacctgcgacttcttcaccgggatcctcgtgttccgggggatcagcttggtcatcacgccgccggcggtctcgatcccgagcgtcaatggcgtcacgtcgagcagcaagatgtctggtcaccaagaacagcaatgtgtgaggaggactcatggcgtgaccagccgaacacgctggtaattcaaacgcatttgcgttacctttggtctcggcgccgccctcgccgctgatgatgctgccctggacggcggcgccataggcgacagcctcgtcggggttgatccccttggttggctccttgccgtcgaacatctccttgaggagctcctgcaccttggggatcctggtgctgccgccgacgaggacgatctcgtcgatgtcggacttcttgagcttggcgtcggcgatggccttccggacaggtcccagcgtcttcttgaacaggtccatgttgagctcctcgaaacttggccctcgtcagcgtctccgagaagtcgacgccgacgaacagcgcctcgatctcgacgcggacctggtgctgtctgctgagcgcgcgcttggcgcgctcgcactcgcggcggagcttgccgagcgcgcggccgtcgccgccgatgtccctgccgtgctgccgcttgacgaggggtac

SEQ ID NO: 31356 - DNA, 1301 bp, Oryza sativa
tcccaggctgttgggcaacttcctggcgcacatggatagccacaatcggggctgttccgatctaattaacacgaacgctccgcacagcgtgagtgcgagagtttccatccaatagagaaaactcacatggtatcagagcgttgatccaatctaccgaaaaatcaatcccttccacctttccctgccatggcgtcttcctctagtaataccggcaattccttcctaggccaccccgtgagtgagaaacttgggaagaacaactacgcgttatggagagtttagatcagcgctgcagttcgtggtgctcgcctccaagggcacctgacaggcgcgacgaagaaacctcaagcgcagatcgtcgtcacaagcagcgacggcaagacaacagagaagaaaaacaatccggagtttgatgattgggaggcctcggatcaacaggtccttggctacctcctgtcgtctctctcacgagatgttctcatgcaagtcgcgacgtgtgaaactgcggcagaagcatggacaatcatcgagcaaatgttctcgacgcaaacgagggcgcgttgcatcaacacaagattcgcgctctccaacaccaagaaaggcaatctctcgctcccggagttcttcgggaagatgagagctctaggagatgagatggccaccgcatccggcaagcggttgacgatgaggaactaatccagtacatcatcactgggttgggcgaagactaaagcgaagtgatctccgccgtgtgcgcacggctagaacccatgacggtgggtgacctctacaatcaagtcctcaattttgaggcccgcaggtctctctatcgggggactcaagaaaacaccgtcaacgtcgccaacaaaggaggtggccgcggcagctttcctggccgcggcggaggagctccacgcggcggtcgtgcctttcctagccgcggcacaagcaatggagcgcgcggtcgaggacgcgcgcaaagtggggcggatcgcagaccgatctgtcaagtttgcttcaagaggggacacaccggcgtagattgctggtacaggtatgacaaggattatattcctgacagtaagaatattgctggagtagcaacaagctcctatggcgttgataccaactggtatatcaacactagagccactgatcacatcacaggagaactggagaaactcactgtgaatgacaagtataatgggggagaacagatccacaccgccagcgaagcaggtatggatcttagtatattggcaatactattgttatacccctagtaatcgggatatccatct

SEQ ID NO: 31357 - DNA, 3590 bp, Oryza sativa
  unsure (1)..(3590): unsure at all n locations
nnnnnnnnnnnnnnnnnnnnnnnnnnnnnnnnnnnnnnnnnnnnnnnnnnnnnnnnnnnnnnaagtgatctccgccgtgtgcgcacggctagaacccatgacggtgggtgacctctacaatcaagtcctcaattttgaggcccgcaggtctctctatcgggggactcaagaaaacaccgtcaacgtcgccaacaaaggaggtggccgcggcagctttcctggccgcggcggaggagctccacgcggcggtcgtgcctttcctagccgcggcacaagcaatggagcgcgcggtcgaggacgcgcgcaaagtggggcggatcgcagaccgatctgtcaagtttgcttcaagaggggacacaccgccgtagattgctggtacaggtatgacaaggattatattcctgacagtaagaatattgctgcagtagcaacaagctcctatggcgttgataccaactggtatatcaacactagagccactgatcacatcacaggagaactggagaaactcactgtgaatgacaagtataatgggggagaacagatccacaccgccagcgaagcaggtatggatctaagtcatattggcaatactattgttcatacccctagtaatcgtgatatccatcttaaaaatgttctatatgttccacaagccaaaaggaatcttatatctgtacaccgtttagttgatgataattctgcttttcttgaacttcaccgtgattatttctttcttaaggatctggcaaccaagagaactcttcttaaaggaacatcacaccgcaggctttatccccttcccaggtcatccttgaagcaagcctgcagtgccactaagttgtccttgactcgatagcatagtcgtcttgggcatccctcctcctcagtcgttagacaagtggtcaataagaataatctcccatgtttagattctattaatgagtcagtttgtaatgcttgccaacaagctaagagtcatcagttaccttttcctgtttcatcaagtgtctctcattatcctttggaacttattttttctgatgtttagggcccagctccagagtctgtaggacgaaagaagtactatgtcagttttattgatgattttagcaagtttacttagatttatctcttgcaaaataaatcccaagtttttgagaaatttaaagagttccaagttatggtagagcgcttgtttgatagaaaaattttagccatgcaaactgactggggaggggagtaccaagctttaaataatttcttctccaaaattggcattgttcatcatgtgtcttgccctcacactcaccaacaaaatgggtctgctgagcgcaaatatagacatattgtagaagttggtctctccttattatctcatgccacaatgccattaaaattttgggatgaagcctttcaagcagcaacctatttgattaatagggttcctagcagagttatacaaaatatcagtcctttggaaaaattattccaacaaaaacctgattattcctctttgcgtatttttgggtgtgcttgttggcccaatttacgtccctataataagcacaagttggaattcatgtctaaacggtgtgttttccttggttttagcaatatgcacaaaggattcaaatgcctataaatttctttaggtcggatctatatttctcgggatgttgtttttgatgaaacggtattccctttctctgagcttcatgcaaatgcaggcgctcggcttcggtctgaaatactcttgtttccgtctttgtttactagtggggatgacaatgtattacaccatttgactaatcctataaatcctgctgctaatgagtttgctgatgcaaatattgagattgatacagcacattccgtggccacagaagatcccgcagggattgattttgatgcagattcggcagaacaggagcctgacaccttcctgtcgccagggtctgttcacacgcattcgcctggacctcaccattcaggcgctgacacgcggcagcatcaggagacacatgctggcgacagaattattcttccaggaacagctcgtcaggaggcacagggggagcagcggtcatctccctccgccgatctgtcctctgctgatccatcatcatcgctgtcaggtactgatgaatattactccctccgtccataataggtgacgtttttgactttttatttgcaacgtttgatcattcgttttatttgaacaattagtataaatataaaaaaagataagtcatatgtaaagtacttttgataatagagcaaatgacaaacaaaataaataataattccaaaattttttaaataagacgaatgatcaaacattgacaaataaaaacttaaaaagacaagtgatatgggacggaggtagtataacactaacagtgatcatcccgagcaggagataacacaggaacaggagcttgcaccgcaagtccgacccagaacaagattacaaagcggcatttggaaggagaagatatatactgatggtacagttaaagtactcttgttttaccaattctggagaacctagtaatctagtaatgatatagaggctcttaaagataaaaattggaaaaatgctatggaatctgaatatgatgccttaatcagaaataatacctggcacttagtcccacctcagagagggaagaatgtcataggatgtaagtgggtctataaaattaaaaggaaagctgatggttctttaggtatgtaatagattatgaggatactttcagtctagtggtcaaggctgctacaattagaatcattttatctatagctgtgtctagaggttggagccttagacagttagatgtgcaaaatgcttttcttcatggtcatctagaagaagaagtttatatggaccaaccaccaggatttgaggatgtcactaagccacactatatatgcaaactagataagtccttatatggtttgaaacaagctccaagagcttggtttgccagattaagcaacaaactgattgatcttgggtttagtgcctcaaaagctgacacatcattattctttctgcataaaggagatattgctatttttatcttggtatatgtagatgatataattgtagtaagttcctcagagagggcaacaacagcattgttacaggatctgaaggtagaatttgctctaaaagatcttggtgagttacactattttcttggcattgaggtaaacaagacacacaatggcattcttcttactcaggataagtatgctactgatttactaaagaaggtagggatgttgaattgtaaacctgctaccactcctttatctgttagtgagaagttgtctttacatgagggatctctcttaggacctaatgatgcaacacagtatataagtatagttggtgcattacagtatttaactctcactaggccagatatagctttttctgttaataaggtgtgttagttccttcatgctcctacaacagtgcattggacagcagttaaaaagaatattgagatatataaaacagtgtactagtatggggcttaatatagacaggtctgggtccacacttgtgagtggat

SEQ ID NO: 31358 - DNA, 3407 bp, Oryza sativa
ctgtctcaaggtcaagtacagagtcagagtacaaagccatagcaaatgcaacagcagaaataatgtgggtacaaaccttattagcagagttggggatcaagagtcctcgagcagcaaagatttgatgtgataatcttggagccaaatacttgtcagcaaattcagtttttcatgctagaacaaagcatatagaggttgattatcactttgtcagagaacgggtgagtcagaaattactagaaattgattttgtttcttcaggtgatcaagttgcagatgggtttactaaaccgttgtcagttcgactactggagaattttaaaagcaatcttaaccttaaacggttatgattgagagagggtgttacactacttctgaagtctatcctatcctccacgtcaatcacatgcaaccacgtgcgatcatgatctgcaggggaaactattctaatccctcgaggggatgttccctcgtttgtttaaaaaccatccaaacggttatgaaaaattctggaaaaatttgacaacattcatacaacacatatatacaactctataaaatcttaagttcaaattcaactcacacgtcgagatataaaaaagacaaattcagcatatgaatagtagcgtactgtttatatctaaatttgtcgtttttgtttctagatgtgtagatcgagtttgaacatgaattttggtggactagtaggtatcattatactctacattattaatttttttcagatttttttacaactatttgtattgaatttggaagaaaaatgtatacgagaggatatcccctcgagggatcagaatccactccctgatctgcagttagagatagagttcctattatctagttaatcttgttttgcatgcgatgtaatctcttccaggttgttaggcagctccctggtgatcgctcccaggttgttgggcaacttcctggcgcacatgtaaagccacgatcggggctgttccgatctaattaacgcgaacgctccgcacagcgtgagtgcgagagtttccatccaatagagaaaactcacaggatggaaccgtggcagagagcacgtccaaggagctgtccgccataagcctgacgcgtgcgtccgtcgaggttgtcgcaacattagtggggagaggagcggatggagcggacaagttaaacatggagacaagaggcattgagggagaagctagcgagttctctagcttgagcggggcaacgatttggagacaacggagctctctagcttgagcggcgtttgtatgcgtcgcgtgaagggggacggcggtcggtggcttcgacaggccaggagcttggcggtgccgcggtggcgcgcgtggatgtagcatctttagcggttctccagtggaacagaagagatgactctaacaacgagatgaacacagcaagcaaaaactccacctccatgcttcagagcctcgatctgccccactgtcgggaagccagctgctccaatcttgttggccacacctgcaccgcttccacccctattgaattcgagctatgcgggaagggaggcagtggcatcggcagtcaacgagcccagtcgaggtcgagctcgccctcccttctatgacggcgcctcgctcagcaagaagagcatgcggcgggcacgccgcggtcatcccctcaaccaccaccgccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgaatagaaagatttctacggatattcttcgtatcaattttataatgcttatcacctccttctgagctattcccacggtgccttcgggtcaaagcttaatccttaatagccaaccgatgcctggcaccaccgctaagcacaagggcaagaaaaagattggctttaaaagatccaaatacttccttgtgggtttataaaaaaccatatcatatcgaagaacttgatggtctttctccacccgttcgattacttcttaaaaggattagatatagaaaaaaagtagtctactcaggagaatgagataatgctcataatatcgctagtaaccaaccacaaaagtaaaccaccgtgcaaaggaaatatgggaaagagtgaagtaaggaaggaaaggagtcactgacatgtggactttatatgttaacttacgtggttggactaggtcaatgaaaaacaccttcaaaaccactgagggagtcattttgcattggttttaaaagtttggggatcaagatatccacggttacggttgagggatataaatagaattggatctatattttgagggattagaagtggactaattctgaaagcaaactagtgtactccgataacaaagttcacacctattttggggaaatctgtgcatctagaaacctattttggtccacacttgagacgccggaaaagctaaatcgcgcacgtttccgggagcagcctaactaattgaattagttttagactcctaactaactgaattagttttagataatgacgataattaagataagatttttcttttttggaagattttttttactaacagattaaaaacttttatgttagatttaaaaactttcgacttaagatttaaactttgaagttgaattttaaaaactttcaactgaaactttgaaaattttcaaatcaaaatttaaatttatacgaaaaattttgaaaactttaaaattagatttgaaaattttcaactcgagatttgaaagtttcttcaaaatgaaaaacttgtaagttaacatttggaaactttcggctcaaatatttttgaaaacacgtgtgctaacgattaaaagtataaggaaaaaaaaggaaatacgcgtgaggggaggaagcgaaaaagatggcaaaaaaatgcgtggggagagtgagctcgagcgccaattagcaacccctagacgctgtgagtaacggcctaaggccattcacagtgcaagcacctcatttgcgttacctcgtatgccacgtaggatagatacacaacgaatccatacctctcacagtgcagggtacgatccccaaaccaaccaccccaacctattctctctcccgctttcccctttctctccttttccctttccctctcctactttcactcccaccgacccgacagagccggagcgcgcggcggtacaggtcgt

SEQ ID NO: 31359 - DNA, 8781 bp, Oryza sativa
gtcatcggagtggtcatggcgggcggcggcggcgcgtcgtcctcggagcggtcatggcgggcggcggtcctcgtgctcgtcgtcgccgtcctcggagcggtcatggcgggcggcggcggcacatcctcgccccgctctcctcaccgcctgccccaacgccaagcggcggcggcatcctcgggacctggcggcgcggatctggagcgttctcgccgtcctcctcaacgacggcggcggtggtggcgcgtcctcgcccgccctcaccggtgacagtggcgcggattggagctggagccggagtcgtcggagtggaaggagttcctgctcgggaatcaaggtcggccttctgcacggcgcgcgttctcgtcctcgcatctctgatcggtgggccccgcgctcgactttttgagcgaggctctcattccttcgctaggaaccgaagaagctagtgaagctatgggccccaccaacttttttcaccacgtaggacgaagtaacgctccagctagatggaggaacgcccactgtgaagggcctaagcaggggagcattcagcccaaagggtggaggggaccagatctttagtgggccaactacgaggccattttagcgcagtagtgtcagacccaaagcccccagatacatctcgaatagccgtaaattgaggccagtattggaattttccgcttcccgtggttgctgaatgcggcatgccgccattgcacagcagcagaggcaggcagcccaagtgccagtatacactctactctgctgagggccacgaacgtagaactgaatttgtatcgggtgggtagtgccattattcttctggtttatatcacaaccgtcgtgaaatgtaagcaagtatttctagctcttcctgtcgcagtgtacaactatacgagcgatttcaatatggagtattctactcagcattagcataatggatgatttggtgcgacacagctgagtagattgtcggggatgcggaatctagatgcatgcagacatgcagtcctccgaaatggaaaaaagttgacacgagaacttccgtgcagaaatcagcctcgtctttgccattaaaatgcgaataggtatgagcttttcttctttcgatggtcatcaacttaccgcgaactttccacttttcctgcgctgcctctgtttttagtgggtttttcattctcagcttgctctgttgtccaattgggtttgctgaaattccgtatcacgtccatttttttatgttcagaatgaactttaaccgaaagcacacggagcgcgtccatggaggacgaagaaaagcaccaattagctggcatcaccaacaccaagtccggagagacggcaatgccatattgctaatcatatattcctacatctcttactataaaccagcggctaaaaacgcagttagcgagcggagcgtaaaggtgggtgtgcctcgcttccgtgcagcgagcgccgtccgccgccgaggcgtcggctgcgcggttgcgtggcgccgtcgcgcctcgcgttctggaagacgtgagctgtggcatgctggcaatcgcccgctatccgtggtaaccccatttcattggtaatctgggcttacggttaccacatgaaagtgagggcccctttgaaacgcaggattgagaaaacacagggatagaaaaaacgtaggaatagaatgtcatgcttattggattcctataggattttgaaaacacaggaaagtctctaaactatcatttgattagcgcacaggaaaaacgcaggaattttagacacatgaagaggaaaacatgaggtgagacctcatgcttattttcctccaaaattgatctagcaagatccattccataggaatttttaaggaattggtaagaaataatcctttgtatcaaaggactctatacaataaaatcctataggataaaatcctctaaaattcttatgatttttcctttgtttaaagggggcctgagtattttcccgcgggggacgcacacgacttgcgacttgacccggagaccagggcaccctgaatccgttgagaaggtcagctttgacatgtggcacatgggctcccaaggtgcgatcgtttcagcttttcaggattagattctcctcgttttccgttagcattgttaaacggtatatttcgtgtgaaaatttttttataacgaagttattaaaaaaatccaacaaatttattcataaaaatattatacattaatacttaattaattatatattaatcgtatttctttctcgttttaagtgataaacacagtgataaaccgttggatctagagatttttagacgcgtgtctgtgctgttcgtggaagggcacgagaagaggcgacctgtacggaccaaagaaacgtgcaattgcgcgtactgcggccattgacatggtaactgatggggaatggtcaggtacacaggtgtgccaactgaacgatcaagtggcgcacggaacaaaccactgtactgtgtcttcgaaagggacacttccgacgcattatttatggatcgatcgctagcgtagccttaactgagttggctcgttttttcaactttgaaaggtaaccaggattgcatatctcatgaagcattcaaaaatgacaatgacattgaaattgaagtagagtttcctaaatagtttagaaaagtagaaatgagtgtgtagcggggacgtgcaatcagttgttcttttcttgactttaatcgatcgccagtgtgcataataacagtcgttcatactgaacaagacgtacttatctgctagtcctggcctcctggcatcgactcgaacaaggagcaaagttaataacaacctccaatttcggggcatacgtgatccgaatcaaaaacctacaggatgctgatgcataactcatcttctgtttgaagtgtctccgtacaaccaagatcatatcaccgatgaaattattcacacgactctaattaagattcgacttatgtattttagttttttttccggtgatgaaaagttgtcatttgaatgtgtaccagtaccaaatcagtcctctaaacattagcatatactccctccttcccaaaatataacaatttatccaccaatattctcttcccaaccaatcacaatcctccaccattcactttttccacctatcttcactactcattcaatcacaatcttccaccactcacttctacctattttttttaataattgtgtataaccctaaaacttcttttatattcgggtaggaagggagtataagcaaatcatcgacgtacgtaacccagacaaacgatttatcccggtcactcaacagcccagtgtgtcatgagtcatgacacagccgtaccccgcgcccttagagtagcaaacacgccagcctcaaattgtactaagtgtaacagcatcaatgacgaagaccgtacgaaacagtagtcatccgttttccctgatgccaaccacaagcagtgctagcatgaatggcgttccaaccacccaaaaaaaaagggtaattacgaatttactactgatttaaattattattgtaagaatatcgctagaaaattacaaaatgcaattagaatggtcattcgattcgagtggcattttacaaatttgcaaatgccccgcaaaaaaagcagtaatagtaacaggaaacgaaccttgctagaccgttgactcccaattttctggcgcgcttttcagatttttcaaccacagccgctccaacgtcgttttccgcccaccagtccgttttactgttgccaatcgatcgattacccggtcaaactcaaaaccgagacgaaggaaatcagaatcacgcgccaccacacgacgtgccggcgcccggcggtttggcgtccggctgcgtcgactcgcgcaccacgcacgcccccaacaccgcacggaccacacggtcacccgaggtcccgagcggctgcctctgacccgcgaaatctccgctcggacaaaacccgcgggccgcgccgcgcgttgcatgcatgcgccccgtgctgcgcgagaccaacgggctggatggcatctcggcatctcctgcgcgcgggaggccgcgtggtgcgagcgagccgcggggacgtggtccatgggagattgtgaaccagttctgtgcgaggacggctgcacctgcagctgcacgggtcatacgactcacgagcgcgagcgggggccgcctggccccagtggccccgcacgcgtcttgcttactcggaacggctttaaatacacgtcgcgctcgacgtcgacgtcgacaccgaaatcggacggacgccttcgccacaaagcaaacccgatctaatcaaccgtgacatcccctcgcctcgggtccttcgttccctcgcattttcccttccattttcacactttcacacacccgcgccacacgagggggtacataagaccgagctcgaagtctcaggagagcgtggaagagaaggcagttgctcgtttttgtgtgtgagaaaggggagaggccggcggcgatggggaggacgctggacgtgttgctggggcggacgacgaagcagacggcgaggctcaagtcgatgctggggctggcggtgacccggctcggcgtgctgcgcgggcacaggcaggtgcggtgcgcgcaggcgcgcgggaacgtggagcagctgctccgcttcggccaccccgaccgcgccatgctccgcgccgagcaggtcatccgcgagcagaacacgctggacgccttcctcatgctcgagtcctactgcaatctcatcaccgagcgcgccgccctcgtggactcgcacaggtgagggacatcaccggaacacgccaaaaaacaaaaaagaaaatcaaacgctagccatgtccgtgatgtcatcgcgtctgttggctatgctttgcgccgtgctgatcaccggtgttttttttgtctctttcgagcagggagtgtcccgaggagctgcgtgaggcggcagcgggtttgatctacgcggcggcgaggtgcggtgacgtgccggagctgcaggaggtgaagcgcctcatggcggccaagttcggcagggagttcgtctcctccgcggccgagctccgcagcggctgcgggatcaatgccaaggtgaggagcacgagactgatcagaattttctgtctgatcctactagccgagtgtaactgacgccctgaacgaacgaacgggttgttgcagatcgtgcagaagctgtcgaccaagcagccgagcctggagagcaggcagatggtgctccaggagatcgcggcggagaaagggatcgccggcgtcgtggtgcacgtcgtccacgagccttcttcccacgacgaggactcgggcctcagccacaggaggcggcggtgcgacggcgagaggcggcacagggtccatcaaccccaggtcgacctggaggaggacggctcttcgaggtacaggaacgtggaggccgcggcgcaggccgcgttcgagtcggcggccaccgcagcggccgccgcgaaggccgccatggagctctcgcgaggcgaatccgggggccgcgacgacgacaggagacggccgggaggcgcgcagttcgacagggccgacgaagagacgctcgccggcggcgaggtttcgggtgatggcaagaaatctggcaggatcagacgtgccagcctcggccggaactacagttcagagatcgaggattcagctgaggatgatgaagtggtccgccatgagatcactgcagagagcgaggtgaaaccgcggggtctgaccaggagcgtgccggtatcagtcagaacaaagagggtgagttagctgcaaccagatggcaacaagagtgatgggagatgatttcttgaattcgtgatattagcagctgctattatatttttgcagattcatcgttcgttagatcctaggcctgtaggccattgcatgcatgtaattaaatggagccaaacaaaaaaaaaggaaaaaaaaacttgattcagattttgttcatcggttagtaggagggagcaaaagtcagcattgtatattgatggcaggtttcatcattgattgtagatatattagaggatggattgattttatattacaacaactgggaccaaaatattcctctaatctcgttacctctggggaaataaactaatgcagcgatactactaacttatatgcattaactagaaatttcaacagcagatatgaccgggtctggactacgagtattcatgaactgtaggcctgtagctggtaaaacttctctcatgtaacctacatttgatttgagaaactcccatgctggatgatcagcgggatactttccttcttttactgagactcgtcagcatgtcactgtaagactgcaagttaacaccgacatcttcatcatactcgagaccaagctcttcctgcacagatacatattattcattaaaatgatgaccgtgctggatgctagcaattggtaacttttcaatctttttttgcagggcagaaatgagaaaatctgacaactaaaaattatctttcctgttgtattaagagaagcatctagtgtgtattaactactaagtgcaggtaaatgtaaaagaaagaagtgcatcaaaaccttaaattccttctggtctttagggctattctcagtgatattatcccatagctccttgaacatcctctttcgctttctccactggttaactttctcagagaagctctcttcaataatcttcttgtcctcaggtttcaccaagataacaccattcctcaatttatttagtttctcttccatttcctggacctgcaaaaatacaagacagccattcttaaaagttaatacaaggaagacattgaaaccataaaagataaaaaaaatcgcatatatacataacggaacacgtttatgcacatacttctctttgcaatttagcttcctttgacttgatctctgctaaagtcaagtttgactgcagacctcgtacctctgcaataggggtttgtattagtcatttccagactatgataatggcactctagcattgaaataaaccaccaataagatcatagcatgaaatggaacctaccagattctacctcactaattgctttcttttgatccgcaagttcttcctgtagcttgatatttgctttcttcatctcctcaagttcttccccatttgggatgttgaattgatcttgacgagcaagatatattttctgcttgccatactccttgaaggaaatctgtccactgtcagccaatgcatccaatgccttttgcactgcggtcttcttgaggctaaacttttgcaacgcatcggctacattctgagaattcaatggcctattttgctgaagagtcaaggcaataatcaacttgacagtatacaaagtttataaagaaacaattggacttattttacaacaatactagaaagagtttgaaatcctctaatttgatcacattgtactcttactcaaatcttcttttttatttcataaagtccaagtgctgcaaacttattagtcatacaagtaaaacagggttaattgtgaacaaatcatggtaagagtggtatacaaaagatgccaaatatagtttctctgtcctatctctactcaaaaggaggaaaaaatctgctgtcctgctcaggaaatggatgatatgttaagcaaacatactggcgatacacagggttattgcttcctaaagcaagtgacaccctgtgaacctgtgacaggaacagtctacatgaggagtgaagactaaaaactcacctaaaaaagctcacatgccagagattcgatttataagcacctcagtgccttctttctatgcacaatcttatacacaacctcgcacaaaagtttccacacaaggatgctgccgagtagagaggatactattgaaaaacttgaacctttttgaaatcaacaaaaaaggaaataaacaaagttggccttatttggtaacaacaaaacattactcttcaatcttatcaaagaacatgcagattttagtcctagcaatgagcatgcgaaccatatcatggctgaacagtggactagttaagttactacgatgtttcacatctgaacacatagtagaaagcagattatcatgggtttcaacaaatccgtactctgaagtagtagatcatcaatttgcatctcacagagctaacatggatcagaagattcagaaccaacatacagtaactcagtagaaacaacccctcaaaacacaaaccaatacggagtatgcgttactctctctgtccctcccaaaacaaaaacgtctccgtcccttccaaaatttagcaacttcttcgcctacttactcatctcaactaatcctaaccatctctcgtttaatttatttatcttactttctcaactcgaccaatcacaaccatccctcatttaacttcacatctccttaatctccacacacacacacacacaaaaaaaaaaaaaacctctagagtgttctattttgggatggaaggtgtagcaatttattaattattattactatcatgcagcgcagggcaccagataaaacttgaaacaaacccatcaccgtcgcataacaatatgacatgttagccgagtccataaaatatctaatcaggcaagggcaagcgcagggcaggaccagagcagccaaattagccggtggtcatgtggggttttggaggaggggggccgttacctcattgacgaagctgaggacgattcctgcaaaggagagaagaggatgaacaggggcgtcagggatcgtcagatgcaatcgat

SEQ ID NO: 31360 - DNA, 1182 bp, Oryza sativa
aaaggatgaacagggcgttagggatcgtcagatgcaatcgatggaattgagcaggcgaaatcgatgcgagttttgttgcaaaatcgggggagctagaactcgagcccgtttcggttagaatggggagatggattgtacgagcggggcacgtaccttcgacgctatcagatttgggaggcatcgccgcctcgctgcgccgccgccgccgccgccgccggcgaagggcgaaaaggtttgggggagaaatgaaaaggagagggtctttgcgactcctttgctattgttgatgagagtcactgcacggtggggcctaccgaaatcggtgaccttggggttttcccgccaaaggacaacgctggtgcgcttgggcgcggcgcggggttccagaagcagctacatttggtgaaagcccatcaaagcccacgcaccatggagcggtccatggtcgacggcccaatgctaacaattttcttaccgttgtgtttcatttagtattttttttaaaacttagtatcaaccgttaacagcttgtttggcaacttaagagaagatgatttttttatacgtaaagtgagtatctttgtattaggattgaggatatgaccagcaaagcgcatatacctatgtattaggattgaagattgaccaatatctcagttatgcacaaacggaatttaaagagagaaagcagatgagagggaggaagagaagggtcaaggggtgctgaaggcaatatctcccaaagtctatgctacttttcatcaatgtcttgttttctcttcccaacaaatcacaattctctatcattcaatttttccacctatctgcacttttcaaccaatcacaaactctctccatttaattttacctactttcttaataatcgtatccactcctaaaacttattatattttaggacggaggtagtagcatttgctcgtctttgtaacatacatgtgtatcaatagtttatggaaaaagtacaaattacccccgaactattatgggcgatcgaattaccccccccccccccaaactcgaatacggatattttacacacttaattatgcaaaccggacaaataacccccccctggctcaatccgggatggtttcagtcctacgtggtagtccagtcagcaatttttttaaaaaaaatagtgtgggcctcacctgtaaggct

SEQ ID NO: 31361 - DNA, 8776 bp, Oryza sativa
  unsure (1)..(8776): unsure at all n locations
ctctactctctcttcctaaatccccatcccctctctctcccctccctccctgctgcagcgagcaacggtgattgcttggttttttcctcgccatggcggtttcttggccatggctgtttgatttcttggttggcccgcgcgtgcgcaccaacttcccccatgacgatgtcaacgaggccgcgcagccgccgtcgcctcctcttcgttcctctccacggcgctcgtcgccaagctccaccgctccaacctcgcctccgtccaagccgcgcagcgcgataacagcaatgactcctccttctcctccctcgcctccaccgggctgccgctcaccgcccatggctgcacaccgtcgtccaccaggcgccgccgctcgctgcatcatgggagggaagagagaggggatggggatttaggaagagagagtagagagagattgagaggttagagggggagagagagagaggagagccttacaggtggggcccgcactatgttttttaaaaaaattgagaagcccacactatttagcccgtggactggcacggcacggcccggcgtgtcggtcaggccgtgccggcccgattagcctcgactcaggcacggccgggcctgggctgtgccgtgccgagcagcccagttggccaactatagtttccagccctgtggtgaccatccaccccgcccgccatcgctacatcactcattcggctacaactggcttcatctggtcacactcgcgcgaggaagaagagcaaagaagaggaggagagaagtccttcctctgatccctaacatgtggacccccacctgctgacttagcaagtcaaccacagtcaacttgcactggtttttgaagatggggagacatatccaattttacggatgagggagacaactagcaactgtgaggaggcaaattagacttgttctaattagagaatatagagaggggtaaccgggaatatgagatgaccatggtcgaggcctccagggccccatgctatgaaatttctcatccttgtgtttcattcagtacgattagttaagaaatattaaaacagaaaaaaaattcgaaagtgaacaatcttattatgtatgtggcataacagagtactgtgggtattgctgctcctgcgccagagggacagtaatgccaacagattagacaagttttaggttataagatccctatttggttaagttaaaaaaaaaggcgcaagaagaacacctagatgtatcataatactaatttcacttgccagtgatgaatggatggctgagtgcttctggcacagtaatcctcttctttggatctagcacaaatattttttccaggagatctttgaagctggaaatgatttttggatcatcgccggggcagcttgaaattgcagaaccaacaccctttggtttaatgttcaaaagcaacctattcacaacctgcaacagataaaggtaaaattaacaattaaatttatttaacagacaattgtaaaaagttatcactgtcagtgtaaataaaaggcgtaccgttttcgtgataggatccttctttctagcaagaaagttcaagttctggtcgaagtgttgcattgtgaaggcaccctgtttaattaggaacacacatcagtatgactgtatgagcagtttaatattctaaaacaaatatgcagactaccatacatattatcttctcggtatacacagaaatccaaataagtaatggaaatctaactttttttaaataaattcttacctttcgaagcatcttcttagggaaggggcccttcaattccatgtgaaggcgaagcatgtcattgttcgttgaaccatcaaataagatttttcctgtttaagttcagataagcagcacccagctgaccacatatccagtggatgatcataaggcaacccaagaactgcaggaagaacaagaaatcactaatctgtctgcaaaccattaagaaaccaagcattgaaaaagaggggatttgttttgagtttgactgcaaaagaaaacagtgtcgaagtcaagaaagatagtcaaataaggaacactgaacaagtatgtaactcacttatttcaggtgcccggtagaagcggctcacaagatacggtgtgatctcattatttccagcagacatagcactaccgaagtcacacagcttcagcaaattgttatctttatttacctacaaaatgacaaacatcaaaaaagctatgctaaataattcttctaccatatatacaaaagaaaagggggtgtaagtcatttttagccttttcctttctcggtcatcaagtacataaaactagtcataatttgtccaggaaaacaataagagtagactatgatactcagcaagattacataccagtatattgtctggtttaatgtcacagtggagaacaccacagtgtcttagatgcttcaacgcgataaaaatatgctttgtgtacgcccttacagcagtcagtttaagcccagtgccatgaccaaatttctttataacctcacgaagattcatatgaagagattcaagaactaaacacagatgattttgatgcataaaactagaaataatccgcacacagtgttgtttgtcttcacgatctgcagttcccaatttttccaatatagaaatttccctcttaccagacctgtacctgtatagtgaatgcccaaggtcagatggtactcttctctctattagatatattgccacaaataatgaataatttcaaagacttacttttcaatattgttgcatataattttgatagctacttctctacatccatccttttgagctttaagatccttcgcatgaacaacagtcgagaaaactcctttcccacggcgtgctgtaatttcataacggccctgtagcacttctccaaaatgataaactgtaaaattgcccccaaaaataagtcaaataatatagaacaaaccagtatataacttgagaagctgcaagattgataaggtataaatagaagtcagtacttactgtaatatccctcttcatcttcccagttgtcatgaagagtgtttttcttggcaagcatactgttttcattgccctacaaaacacaaaatagttgagcacaaaagttaaagtaaatgggataactttggcaataacataaaatacaaagggggcaaatagaaaaaaatatttgaagaattttttgttgaagtaagtagtaacaattgttattattcagaagtacaagtagtaagaacgtaccagcttgcgatcaataggttgttctccatcaataacgttgccaagaataacttgtttacctctctgtggaaatatcaaagattccaagtaaaatttctggatgatctagtgttacgattaccatcagaattctaaacaaacaatcaacttaacgagaaatatcatttaccatgggaataccctcctgaagacctgaagcacttgtcgtccttttattatgtgatatcctcgagcttccctcctgaagacctgaagcacttgtcgcccttttattatctgatgtccctaagctgattgaaattttaggcaaagtaggagacttcctcacattgtagaattttgcaccgacaaatacatttgataattcatgatcatttgtaatatcttccttggctcttaaattgttcgatctctgttttgtagcagcaggatcattgtttatttctgtcattcaaaaaaattggttaacaaaacttgaacaccttttaaacaacagagaaaaactcccactgtttctttttataaggcatatagtttcttcaatctcatttcaaacatacaaggcactgtgtgaatctattacttacattccttgtttacactcatttatcacatattctttattttacattgatcactgaccattatctttcctatttccaagacattcaggtacaaacagcatagtcattcgaatatctctcacatggtttcctctccttaatcattaatcaagataagccttataaaaagaaaagaagggtgtggggcagtaatttaaatccaaatgacagtttagggaaatatgttacctttattgtcaatgtaatgagcagatttttcctgttgcttccgatcctcgatgttctccaggtagttctcttcatcttcctccctgacatagtttgaagatgatttactaaaaaaaataaagcaactaaagttaacaaatatgatatacgagttaatcatatgagggacctcacctgtaaggttctttcttctcttcttcaggtctccttttgcatttggcctttgtatcatccccaccaaagcttgatccatctttgtaaatgccagacataccatagtttgcatgcgtgtagctgatactcccttcgttcccatttactgctctagaccaacaagcatccatttccttacccctaaagcctctcttatctctcttatctatactatcattgagtttctcctctccatatctactgccaactctatctgtttctttgtaactgttcctagccgtatcatttttccgatttctccattcttcgtctttcttccttgtgctactattccatctatccatctccctaccttctccatgcccatgatgtgcactcgccttttgatcaaatctaccatcgccacttcgtctctcatgataagcaaggccatgcaaatcaactttcttttctaccaaactgccatgttttctctcgtccaggtgtttttcctcgctattacagatgtcagtgtgcctaccaatgtgacagccactctttttccttttcttatagcaccctctttcttcagtctcccacctcctgtttgaatacctatccggctcaccatgtctgtcatcaatcccatgttcataatcaagcctcacactgtttcttgagccatcagtttgaaagccagtttctctgctagcatgacaggatcgtaagcagtccttggaatgagcttcattatggtttcttgagccaggagatcttctagaatgatattccacaatggcttcatgagcagcatgatctgactttgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagtaaaaaaggaagcaagggagatctccctccttaacacaatgttcattgattatgatactacaaatttgttcgtaagcagttcaagctttatgtcaggaagcttggagcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattgttcgtcctatgactcgtattcctatcgctaacaacagcataccgccataccctacgcgctttgtgtacgattaagtccagaacaaaacagagcaaaattcgcccaaattcacatgaaaattaagaactccggaacaaaggatcaaggggtaacgaaaataacctataaccaacggcaacaaaatggatggggggcttggaacagaccggagcaggtagaacaccttgcactgagcccgtctcaccggcatcagcatccagccccctccccacacccacacccacggccgcggtggcctggtctagtatctcaccgtcctcggcctcgccctccgccggatccgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctagggctagggtttggtacggaggaggaggggatcccgcgccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacacggatgaggattgaggcggtgaggcctcccttcgagcttacagatttggggagatttcaaatagttcgattcgaaaaatgaaattgggaggttctttgataattgaaacgcagagatccttaagattattttatataaaaatagttcgaatcgtacaaaatccttcaaaaatttcacgttcaaacggacttcttagaaagcaagggaaccattggcttgggccattgtttcctttccggaataagttcactttgggtccctctatttgtcgcccagaccgattttcgtcccttgaccgcaaaactgggtatgacccgtcccccaacttacgaaaaccggggaaacatggtccctcggcggttttaaaggcggttttggctgacgtggcgcatacgtggcttgtttgattaggtctccgtcccacgtagcattgacgtggcgcttacgtggcaactatatctcagcaaaataataaaaagtgtggccccacatgtcagctgcaaaaagaaataactttaaaatggtggggccatgtgggccccatatgtcagcatcactcctctcttcttccctctcccttctctctcttgttccctttcctctctctctcttcttcccgggcagaggacggcgcgggtggacggtggagcaggcgagctccggcagcggcggtgggcgtggtcggcgccctggaagatgccatcgatgccgccgacctccacgcgcgccaggacggcatcgccgagcgcttctacaccgcgcttgtcgtcctcccgccgcgtacgccgcgctagagccatgccgagctccctcctctcccgccagcgagctagaagggcggcggatggctaggcgagctccctggtctaccggcgagcgcgcgtgagtcgctccctcctctcccgccagcgcagagagatggggagttgacttgaacatataataaacattcaatgatgatacaaactgcaaagacagcttgagaggaacactagaacactgaactctgaaccattctgcacgaggtagtacattgtcataaacaaacgtcgcaaacgaccagtctaatgcgtgctctaccactcaaagtggcaaccaaatcgatggcacaaccaatcgaccaaacaaattcatatctcttcctctttgatctcttctccctgctcaatctcaagaacatacattatgtgttcaacaaattttcatcaaaaaatctcaagaacacgtcgtgttcaggcaaaagaacaacagagacaagaggcgatcgatggcaatggccatggcgaagctgttcatcacagggctgagcacggtgatcgcctactcgtccgcggtggtgttcaagggcgccgccatggctgtcgtgctcctgctcatgctggtccagctcccgggctacctcagctgcctcctcctctgcgccatcagagcagccgtcgagagggccgtggcggccaccttcgccgccgccggggacgccgtctcagcggcggcggacgctgcagtggggtagagggacgccgcgtcgtcgaacagcaccgcggcggtggcattcgtgtaggccgccatggggaggcccaaggcgctgcttgccgagatgctcgccatattcggcctcgtcgcctcgctttcgtgcagtccagcgacgacgaggaggaagacttccttgttgggtccgccccgggcgctgccgcggcccgccgccaccttcttctccggcgcagttctcgctatccccttctctctatccctctctctctatcctctctccttcctcttctctctatcccccctctctctccctgagaatggtgagtggcgacggaaggcgcacaggggcggcgacggagctgagacttgagaggcggcaggtagcttgtggagcggcggctggaggacgacgagcgcggcgtagaggcactcggcgatgccgtcccggtgcgcggagggtgtctgggtggtcggcggcggcgacacggatagtggcgaagcgacggagaagaaggtggcggagaagaggagagagagagagaggaaggagagaggatatagagagagagggtagtgaggatgacaggtggggtccacgtgggccccaccattttttttaattattgtgtgtgaaactgtnnnnnnnnnnnnnnnnnnnnnnnnnnnnnnnnnnnnnnnnnnnnnnnnnnnnnnnn

SEQ ID NO: 31362 - DNA, 1771 bp, Oryza sativa
aagcgtcacgtcaatgccacgtcagatgaagaccgagtcaaattagccacgtaggtgccacctcagccaaaaccggggtcaaattcttccgagggaacttatttaaacggtttcgtaagttgggggacctgttgtacccggttttgcgatcaagggacgaaaatcagactgggtgacaaatagagggacccaaagtgaacttatccgacatgcctaggcgtcattcgggtgtcatttcttaaaataggcgtaactttctcatacggactcggaatcaggcaaatgatatatccacggacatctacagaaaatgttacatccgattctcctcagctctctcccaaggggcgacacaacacgagggacgcagtggcgtgagtcaaaagagagagagagagacaaaaagagattccttcctttccacggtctaaaatccttggcccagttaggcagaccatccagccaacccactgaacagcccatgccatgacggagctgagacttgtcggtgactcgcgacacgaacgttctggctagatcgctggacctgaccaaaccaagaccaagaccaccccgctacgtgtccacccacgattggacccctcacgtggaccgttttcacggtgccttgtgatgtggagctcgtacagggccagaacactccggcgagtcctactccgatctcctcaccataatccagaacctatttaagccccccgcatgtacagcaagcatcgaccgatcacgatcattctccaagcctaaggctgtgttcgctatgggttgttcccaatagcacggaaaacggagcgatccattagcacgtgattaattaaatattagctatttttttcaaaaatggattaatttgatttttttaagcaacttttgtatagaaactttttgcaaaaaaaacaccgtttagcagtttaaaaagcgtgcgcgcggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatg

SEQ ID NO: 31363 - DNA, 4006 bp, Oryza sativa
  unsure (1)..(4006): unsure at all n locations
acattgctgttcttggtgaccagacatcttgctgctcgacgtgacgccattgacgctcgggatcgagaccgccggcggcgtgatgaccaagctgatcccccggaacacgaggatcccggtgaagaagtcgcaggtcttcacgacctacgaggatcaccagaccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgcgnnnnnnnnnnnnnnnnnnnnnnnnnnnnnnnnnnnnnnnnnnnnnnnnnnnnnnnnnnnnnnnnnnnngacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgtccgccacttcagaaaggaaagatgttgtgaagtgtaaacggatctcttaatctcttatcattagacactaatcttttttgtgttttaattaccattaatcttatctggaatgcatcaatggacaaattttgaggtatccctatctaagtctctaagctgttcatcagctagaggattaacgaaatgcaagcctcccactacgataactttgtgtttgctcctacacttacacgggcccacgtaatacaattagctaacttgctcgagctaacacgccagcaagttgcaacaatcttggatccgtaatactcgatccgacacacgagatgacgaggacgcactcacgcacaccgacatctacacatatgcatctgcggccgcgtggccaaggcaactcgcgtcgcgtgctcaaccgcacccgtcatggcgcgccaccacgaggacccggcggctcggcggcgggggcgcgcgctcgtcgtcggcctccgggccgaacacgaaccgcgcccactcccttgcccgcgcctccgcctacgcctaggactccttccgttcccgcgcgctcccagcccccgacgccgacgcgagcaccgccgcaacgagcaccacgacgagcaggggagccagcagggacaccacctgcgccgcgctctccgcgatcatcgtcgtcacagcgagcgagcgcgcgcagccgccacagaggagtcgcagcagcgtgtgttcggctgctcttcccgggcgtctcggcggcggcggcggccggcgccccactacatatacaggttcgccacgcgttagctttctcgtgcgcaaccaccgcgccatggatcgcgtgacgcagctagcgcgcgcctcgccgtctttcggcttgccgggtcatgaaaagtaaagccaatagcctgggaatggagaagagcagcgttctcatgcgtgtttgtgtccctcgtcgtcagctttacggttgcctgcgttggcgggaattaactctgctcccggtgatcctcggtctcatggggtaactgggtgatgcaattcattactggttgggagtttggtagtagtcgatacgcgcaatacacgatccgcacggactgaaaactgatgcagttcttgaattcgcaagaattgaaacagaaaccgagactgctttgttgctgtcgccgaaatgttgcattggattctgcaggtgactacagcggctgcggaagcacttcgtatagaaggagatttgccagattctttcgataattagtaggaaattactttgaaaataattgtcttttaaactatattaaacatttaaaaattgtctataaataatatctactttaaaaacataggataatatgtatagattaatcttgaaaattacttcagtataatcatatatatttattaatagccctacatatattcagagtcatttttaggataccgtgttctcgtctaaaacaattttttttttctaaatcgacattttttaaaaaaaatctggagagactacagagtatacatgcttcgttgactgagcccctttcagttgaagtatgcaaatcattcaggcacaacaagcatgaataaaacccactgctgaatttcataccgctatcatctatattcttgttttctgatctccaacataggatcatccaggggaaatttagtacacaataatcgccagctaattatcataaaaactacccctttccagctgagtgaatcttgttcttgtaccatcacgtacatgtcttgctgacttgtagaaccctatagctccaatagccaaccttcatttttccatttccgatgtcttcccgacgtcctactcaagagccggtgccacctcggttgggttaccttcaaacacatcagagcctgatgattctgactcttccgggaactcctgtgtttggaccgattccttgtaggaaggagtttctctgaagtctgtcgctccttcgttatacgttgccacagcgaacccacatgcaaccagctgcaaaagtatgcaaggtcaacagatacaaagtgagaaccaacatacaattgtaattttatcaggtcctcgagagataacatgaatataatcgatcaattgatggtaagaggatggaatggcatgcaaagttatctctgcagatcaggcggagacatgctgagaataatgttgaactgatgcgtgtcaatgaaaaagcaccaggtgctatcatcagtttaactcaattaagaaatgtcagatgatgtcttgctaaatagcatgtaaagaaataacttcatgtattcagcggctgatttatttccactattgaaataaatgtattcagcaaccgagcaacacacactttcttttccatccactagatgactagacactgcaatggaatcacttgtggcaagtaatcagtgtgctaagtgctaacaagcaatgcgatcaaatcctatatatatttttagaaggcgcaaaagctttgtgcgtcaatatattaaagatcaaatcttacatatgaatgaccgtaaatgaatttgaatgagtatgatgtctgatactctatattttagttggaacatcaagctcatacaatcactctaaaatttgaaacttgtaacttcagccccggacagtgccatggcatctcttctcatcacattgaagggcttgtccggaagttgtacttccattatcgaaggttttgtcgcatgcagatttcctttttgcacaattgcacattttgaagtttcagaatagaagcgtatcaattagctgaaatctaagtttcactaactgcaccaagctaaagatttacttctgagcacttgagcatggattattgataacaagttactagtttcccaacagcagtgcacaaaacgcatcaactgcagtaaagcggcaaagtaatggaggaggaggaggaggaggaggaggaggaggtgctcacgccgaagaagacgccgaacgcccacatgtactgcacgaagaagccgagggcgttccactggggcccctcccagaagtcgggcttctccgggtcccggcagctcgggcatcggcgtcgtcgacacctcgaaccccagcggctccccttcccagtccacccctttcccggggggggcggtctcgtccatgtcggg

SEQ ID NO: 31364 - DNA, 3709 bp, Oryza sativa
gtgagagggagatgagataagattttcattttttctttttctccttttgttttctagttccgcttctctatttttcgtttttcatcgtttcagtcgtgtagcaggagcgctaaaagccatgaagaaactcgggtgttactgcattagatttcgccgaaaaaaaatcatgagctagttttgtctggtactccatttcaaaagagacaaaattatatgacattcggtgatttaggtacttgtataattaaagtaccctctctatttcatattataagtcatttttccttatttttaaaccattcttcttaaaacttctaccaggtttatagaatatatatatatatatatatatatatatatatatatatatatatatatatatacaccaccaaatcaattttattaaatctaacattgatcaaagctaaagaaacttgacttttaaaaaaaaagttaaaacgaattataatatgaaacggatgtagcaattttttttatcaaaataggtttgtttaatgcaataagtttgtaagatggcccaatagaaatatttttcaataaacaaatctaacatgttatttttatgtttttaaactactgtaaaattcattagtggttaaaaattttagagtttgactagacctaattcaaaacatcaaggatttatgattggagaggatagatttattaccataatataaatatagtgcttacgttgaagagttcattcttccttccttaaatataccagaaaaactatagaacggtctcccgttctaacggaatgactcaatataatagagcacgactgttttccagatccatttctcagatccgttttcttccccatctttccctgagctgatcgccatcctccacctccctcccttccccgactcctccaacccatatcgatcccatgtccggtcaccggagaaccaattgacgtcgttcctaaccctaaggcgtccttcatcctcctccccccttcatacaccagattggacatcggtgagagagatcggcgaggtcatggggccatcgggaaattggtgacgtcagcaagcggaaggtcattgcgacagcaagatcggcgttgtcttcgttgaggacggagaagaggagagaatgcaaggctgagagtgagggggacgcgcgaggaccagtgcactgacgacaaggtgcttcctacgcgtctcgagcttgccgcactgtgctcctcgctgctcgtctccattgtttgcaggtacgtcatcctcagttgataccgggtaccaggcctgatacctcaggtgtcaggtactaggtatcaagcatgatacctcgggtatcatccttgatacctcgaggtatcaagcctgatacccactggtatcagacttgatagccaggtatcagccgatacccataggtattaggtgccaagtactaggtatcaggtatcatgccacgaggaggaagcgcgggttgtcacttcctaaccagccagtgaaccatttaccaccgatttctcctctcctcttctcactcctctcctgttctccctctctcccctcgacacgctccctcctttactactgttgatgcggcccgcgaggggggtgagggacgtattaaatcgttctaattatatttgtgcttatattttttaaatcatgattggaagaatgattataaaaaattgtgattctaagggctcctttaaattgcaataatttaaaaatgtaggaatagaaagtgataatatatgtaatccacaagaatatgtcgaacatgtattgtaggaattttagaggaagaatattatcaagattagacttgaaaggagagatgatgcattggacttccaaaaggaaaccaaaaccaagaggtttgggctcatgtttgaaattccccaaaatatagaggaaaaaaggattcatatgcaatttttctagcaaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtagcaacacagcaccatttaaaatcacaagaacgcagaaagatcttcacccaaaggagaaatactcatttaaattcctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgcccgtaagctgtcgtagcagcatcatacagcgaacattccctgcagaaaagaaaaaaaatgaatgccagaaaggccgtaagctgtcgtccattagagcagaacagaactacctgtcaactgtgtcttatatgagttacggatgccaactggccaataattctaccaacttagccaccatcggctgaatctgaatgtatatgtagtactaacaattgtcgccggccagccttgcctcagaggaggacaaaaggcacaatgaacaagttgatgaatatttattggtacgagacaagtttcagactgtcctggaatcgcctgatatgcttcagatttcatttcgaattgaaaaaaaatatggtgtgcttgggtgagagggaggcgacgtactgggtggagaggaactgctcgaagagaaccttgatgaggccgaggccgaggcggaccctgcgcaggttgcgggagtggctgccctgcttcttgacgcagtcgttctcgacgtctttgtccaggatgtcgttcagcgtgccgtacgacttcgccgctccgatgaggtcgttcacctgcagcagcagcagcagcaggattggtcattcacaagggaaatcgccgttagtacatttcttgccgccacaagtacatttcttgccgccacaagaattcttcgtggccaatcagaaaaaagaaagaaagaaagacgcaaagtcgcaaacgcgttttcatggagcatcgttgagaagtttcggtttttttttcctttcttggtttgcttttctagcgcaagaaaataacggaaaaggaatattccaaatcgggggtaggaggtgaacgctgcaagatctaatggggaacaggggatcaaacaggaataaatcgaaatttaaccagagtcaaaagcgaaatttcttgatgcgttgtgatgaagagatccaagaaacaaaa

SEQ ID NO: 31365 - DNA, 3260 bp, Oryza sativa
ctcgatctcggcgaacctgaaggccatgccgaggcagctgaagaggacggagacgagcgcgcacgtgtcgccgaagggcccgaggcggagctccccgccgtcggcctccatcctccgggccagctcctcgaacgcctccgccaccgccgtcagcggcgtctccatccccttccgcgccgccaccacggccgccgccgggtcgccgcaaatcggctccgcccccgcccccgaccacggcgtctgcgacctgaacccgagcatcctcttcctcctctccttccctccctccctccccgcgcgcgccgggcaaactagccaaggcaccaccaccaccaccgccccaccaaccgcgcgccaacggacggtgcggtgcgagggtgcccgaaggacgcgcgcgcgcgtggcgcaggtggtgggattgggacgaggctggcaatggcgtacgcggcgacgcctatgtataggaggaggagaagaggaagccgggagaaatggagaatctctttgcccgtgtgggagacgaggaggaatggaacaacagggggtgagctggtcggcagatcggacgcttcctttatataggcatcagcgtcaagattcgtgctgggatataggagtacgtgccacgagcacgagtgcacgaggtggagtcagccagcgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttctttttcgcattattcaaacaattttaaaaatttaaaattaacatgataaataaatattaaatatatcatttcataaatatataagttcagatttacaatatttgagttgtaataaaaagaacaaatttatatgtaaacagtatatacaattttttttatatttttaccttgcatgtttataaagtgatatattatatattaatctattttgtttctttttgcaatttttcatgactgtttgaacgttatgcaaaaaagaggggatatgcattaacaatataaattatagcataaataaaactttcaagaattttagttaatcattttaaatgtattaatggttaaaatcgaaacactaatgttcaatgtaggagagtatatgaccttaatttgttactactgctactcatatttttctacgagtaaagaaaaaactaagggaagcttccgaagatgtttgcattgagccggaatcgaccgttgaataaagcacggagaatcggagatgcatctgggagcttcttcctaaagtgaccttgactagtgtaaccgtgtgagccatgacctgtacccaaagtaatctaggagcatcaaagcgaatatacttctctgattgcgcaaaaacctttatatgtttatggacctgtctagatcctatttcaaatttttttactctatcacatcaaacgtttaaacacctatatgagatattaaacatagattaaaataataactaattgcatagtttactactaatttgtgagacgaatcttttaagcctaattgctccatgatttaataatgttgtgctacagtaaacatttgctaatgatggattaattaggcttaataaatttgtctcgcgatttactgacgaattctgtaattagtttttttattagtgtccgaacaccccatgcagatatgctaaaattttacatcccttatgttcgtgaatgtactcgttcccccaaaaatattaaggaaaaaacaaacaaacaagagtactcgttccagcatgaaagcaatgctaaacaggcagtagacagtactactaatcattatatgtgttacactaaaaatgtagttttatggaaccgtgccagaacttcagaacgggtccggctcctcctgcgcctcgttgtgaagcaccactaaaacagtctggatatatcattgtcgtgtacaaaaatgattacgagtcaagaaaacgacccgaaataatgaaaaacaacatgatataacaggtgaagattcaggcatttcttaatgctcgagagcttcgcaacgacctggatttctttttgctacctatcggtttcggaatgcttaaaaactcttgaacatttcgcatcttcgggcaggcgccgtcgtatgatttttccgacgcaaccgcaacttgcacgctggaatgctcacgcgcgaggcccagtgacaccgcgaaaagcacaaccgtctaaactgtcgatgagctggtagtgtacagctgcacatgctgcgcattattgcgaaaaattctgggcaactgttattgagcggtacgaattcaaatatcgatgaacaggttatttgttctattttttaagtttggtttagctatgaagcaaaattcagaccgcatatgctttttgtttagtggtgattcacatcggggtgctttagacccagtttgaagcaagcaaaataggagcatgaaacaaaatcaggagaagagaatgcctcatcagttccgttttgtaacccttttattagttccgagttgcaaaccggaccacgaatccgagaaccgggtgaaataactgggattatctttagtcccggttggcggttggtggactaaaatggtagcaccacgtgcatattggtggtttttttctttttttattgtttttttttgctgtttccatcgaatgaacatcacaaattcacatatcaagatttcttttcattgttttttcttaaattcacatatcaaattcacaaactcacaaatcgaacatcacatactcaaattcacagatcgaacatcatagttcaaataaaaaaaaattactgatcaaatagacactacaacagattcacagaacatatgaaaaaatgttcatctaaaaacatctaaagtcacaaattcacaggccacctgccgccgcccacccccctcgtgtgccgccgccgccgcggcccgcgagaggggaaggggaggagggtagggggcactgt

SEQ ID NO: 31366 - DNA, 1619 bp, Oryza sativa
  unsure (1)..(1619): unsure at all n locations
nnnnnnnnnnnnnnnnnnnnnnnnnnnnnnnnnnnnnnnnnnnnnnnatgtttaaaaaagttaactacttaggagactgagaaagtatatgcgagcgagatattttttttaatgaagaaatatgtaatttttagattgaggggaatatatacgtacatccacgcgttgccacgcgccccagcgccgtgccgtcgaggcatcgaaattcgaaccacgcaacacggcaagtcggcaaccgaaagtgtcaaactgtcatcaaccacatttacctccccggtcacgatgtatacagtatacgtataggtgctattcgacgctgtttgtttgaaattgaacgctagctagcgcttgcacgttcactgttgtgcacttgtgctcacctgtactccatactttttatataaaaaacaatttcttgtttgacattttttttagaaagttcatcgggggagattttctacctgaattttttttagattggaaaaaatacttgtgcgtcacaacgggtgaaaactattttaatcttattattgttatagttaaggtgaaatatattgtgataactcgtttggatatatatatatatatatatatatatatatatatatatatatatatatatatatatatatatatatatagaaaatcatgagatgtaattaggagtccgatcgtcttaacttagtatgcgagttttttaaaagagattatacgattccttctatatttttaaaagcgaacgaatttaaaaccgatttaaatacggatctgtatttctaaaaacgaacaaacttaaaaaagacttattcacggatggcgtaccaaagtactggcaaaaacatctttaaaggtacttgtttgacgtgttagaagtggtttttatagaatgaagagaatatgcacaaacaatttcatcacactcattattaacattgccttacaaacatgcaagccatataatattactatactataaaaacattttaattggggatactggtcaggatctgaatactttagttggagcattgggagtttgagactatcgtcaagtgtgtccaactcacctcgacaaaatgaggggaattctgctgggagactgggaggtgagccatgccaattgccacggttcttgatagtaagtgctctctctctatctctaatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcataaaaccgaaaaccagagtcctgataatgggactgcatgatgacgctttttgggccatcgacaccctctcgccttgctgcctcctggtgggtttgaaatctagagttgttttctcagaatgggccgagagttgtgcatatgacaatttggcctcaat

SEQ ID NO: 31367 - DNA, 3556 bp, Oryza sativa
  unsure (1)..(3556): unsure at all n locations
nnnnnnnnnnnnnnnnnnnnnnnnnnnnnnnnnnnnnnnnnnnnnnnnnnnnnnnagtttgagactatcgtcaagtgtgtccaactcacctcgacaaaatgaggggaattctgctgggagactgggaggtgagccatgccaattgccacggttcttgatagtaagtgctctctctctatctctaatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcagaaaaccgaaaaccagagtcctgataatgggactgcatgatgacgctttttgggccatcgacaccctctcgcctcgctgcctcctggtgggtttgaaatctagagttgctttctcagattgggccgagagttgtgcatatgacaatttggcctcaatagatctaagcaaccgtttaatagtctaaaaacattctgcatcttcttataaacggatacaaatggtttataagtcagacatactaatgcatataagtatgtactactactagaattatagcacgacagtactaccatgaaaataaaaagaaaaagagaagcacaaattcatgccttctcaaacacgctgccattaattaggaaaaaatattagcatacgaagaatttctcaatactccactgtatggtactctccaaaggttacttctgctacaggtttctttcatttaccgatttcctggcaaactcaaacagaaatctcgttcacaaatttccgcgcctctgattaattacacatgaatgaagtgctgcagattcctgcgacaaaacatttaaaacccttttgttccaaatgagtactatattttgatgacttattttcttcagagttcagacattccatgatcctttgaaatgcaagattgtaaaatcaaaaaaacataaatgcgcatggataaaatgtcatacgcccattgaattcggatatagaaataaaagacaagtgaaagttttcatatgaaatatcctattacatagaaattccaaatgaatctatattcctttgttccaaaggagcatattggaatcaaactcttcaaaaactcttcaaaaaacaatttaattttctctcgttacaaaggtgcacttttacgagtttctcttaacccaaatctaacagtgacaaagtgagcgtagctcgactagttagatccttgttgtggcactagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcagcccccctcttctcctcgcgcggactccccggtttgaccgcgcatcgccacgcgtaggctcaccattggccggggccgcgccaaggagaggccaggcgagcttcccgaggagccgcacccctcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgatctcttctctcccccctttttcttttttttttttgcttgtctcgctttttatttttttgctacctttacggttgctggcatttgggggagttggtggttggttggttggttggtggttgcgtgaatccgaggggtgaggagaaggaggtggagtgttcgttcttgatctttcccgcagttgcacttcgatttgagattgctcggtacggatctgcagctgttgtttttgtttggaatcgtgttagatctagggttggagggtatggctgtgtggggttcgaggtcagatctgatgcgaaagtttagggttcttggtgactgtgagatgtggctgtgtttagttcacgccgaagttgtaagtttggttgaaaattggaacgatgtgattgaaagtttgtgtgtgtatgacaggttgatgtgatgggaaaagttagaagtttggaaaaaaactttggaactaaacacacctcgttttattttcttgccatgtttactggagatcgtgttggggactgtagtgaagactcgagatctgcgtggaggaagcctgtatttgattattcacacgaaatatgcacgcatagctgttcccctttcgagctaattcggttcatcgatctatcgtttttttacctattagatgcagtatgcctccgttgaactgcagatctagtcatttcgctgctgttcatgttgttttgaactgttagtctgtctgcttgctcttctgtggaagaagcagcagtggcgctgtcgttttcttagcttgaggtctggtggtattggactagatcactggtttggcagccactttcttgttgatttgtctgacggaatcactcgaaaagtaagaaaataaaatggagaaagtactctagtgaaagggggatggactagaatatttagttgcctgagaatgattcctttcgttcatggaaaaggcttgcgcttgttgtctaattgggaaaatgatgtgccatccacttggttggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcg

SEQ ID NO: 31368 - DNA, 1377 bp, Oryza sativa
ctccgacgaccactgccgccccggcgacccttccttcctagctccgaccaccgccgccgctccctcctccaactccgacgccgcaccatcgccaccccctccctccccaggatccggctaccaccaccgctgcccctccctccctggctccggccaccgtcaccgttccctccccctactccggtcacctccgcggctctctctttcggctcgggccaccatcgccgccccctccctcggctctctggctccagccaccgctgtctctctctctctcccttggctccggcacccaccgccgccccctccccgggctctctggctccagccaccgccgccgctctccccccaccatcggctcggccgttgtgcctcgtgctcttgcagctgatagaggtggcactacactgatcaggtcatctctgacgggctcatacccttacctgtgacgggttaagcactggtcacagatctgtggtcactgatgactcggagtcacctgtgacgggtaaagacccgttagaggtaaaagttacctttgacggactgaaaactaaaatccgtcgtaggtgaggtcacctgtgacagaggggtccgaattgggacacgtcacaaacctcaaaaatgagggaaaaataatattataagcctagctagtcgcagaccattaggcatcacaaatcacaaaaatgatcacattcacagtcatttcgacacaagacagaatcacaaaaatcatcgcaatcatattcatctggccaaagaacaaaatcacttcacattcacaatcatttgggcacaaaacaaaattacaaaaatcatcacaatcatattcatctggcggtggtgcggtggtggaggaagcggccaacggtcaagagggaggcggtggccggatccgcgcccggatccggcggttggcggtgcggtggcggaggaggaagcggttgacggtcgggggagaggccgcgatggccggcggtcgggaggttgggaggcggcggcgaccgacggtcgggggagaggccgcggcggccggatccgcacctcgtaggccagatccggcgaccggcggtcgggaggcggggaggcggcggcggccgacggtcaggaggcggggacgcgtcagcggccggcgctcgggagacggggaggcggcagcgaccgacggtcgggggagaggccgtggtggcccgatccgcgcctcgtatgctagatccggcgaccggcggtcaggaggcggggaggtagcggcggctgccggtcgggagacggggaggcgtcagcggccggcgctcgggagggcgccatggcccgatctgtgagggagagagtgaggagggagagaaggaagatgaggggggagagagtgagtga

SEQ ID NO: 31369 - DNA, 5395 bp, Oryza sativa
ctatcccgttgggggcaacggtatcccgtcccctcgtattcctgtagatgtaaagatgcttaacgccattcacagttccgattgacaagtcacgttgacaattcaagtcagaaattcgagtcagaactcagaataatcttgcgtgatccaagttatccaactaatcagaaagcagccagattcccccccgagagtattggggaaatcttgatgggcgcacgcacgcacggccgcgcagccagttgaggctgacgagctggcgcactggtccacactattctccacccgcttccttcccctccgggccaaaggattggttcacgacccgcgccgcaagcatggtccagcctcgctggccgcacttcagccgctcgccttttgcttgggccgcgccccgccgcgccggatcggcaggttgacgccgccgtcgaccgaatccaatccaacccgttaattaaaacccccccttcctgtgctcagtaaaacgagcccgattggcagtttggcaccagcaccagcagcaggagcagagacaggtgagaggaggaggataaacggaggaggccgcgatgggaaccgtgctggactcccacttcctggcgctcacggccatcgtcactgtgagcaaatccctcgtcttttcctcttcctctctctcgccggtgcggtgctcatggatgtggttggaggttccaggagacgtgattggtgttcttgggattttttttttaatttcttgttccaatttttgtggtggtggtggtaggtgggatatcagctggtgttcttcatcatcaccgcgctcctgcggttcgataaagtcactgatttcgcaggtaattttggcaattgtttgtgtacaacttttcatgggaaactgcttatattattcttgaatataagttctcctcaacaaggaaattgccttttaaatttttggtaatttctgttactgcgttgttgtcttacaggaagtacgaatttcatcatacttgcaatcctcacgctagctttgaagggagcatggcatttccgtcaggtaaatagttgtctgaagtaaaacgtgcccaccttgttattttcttgttgtaaacatggtcccaatgtcttctcagtcacagcagaatgaaagcaagctgttcatttgagaattaattctcattctgccttcggattattcattctttggacttgccatgattttgttgtttgttcggtttaggatgacataacatcattaatatgttgatgaattaggttgggaatggatgtttctgttgacagatactgtagaatttgcagcaatgttacctgtttatttcttcattgtctattattgagtaatactgttcatgaaacgggataaaaatgcctcacttataacaaaagtgcaaacctgcaaatggtaacatgcctataaaagaaaggatgaaaagaaaatgggtagattagtacgaaaattagtggcatgcatgtgtttttctgataaaatctaatatttccaggttgtagaaaaaaatactgcaaattaacctgaaaaaattcctttcaagtgattttgtttcaagcgatgttgcatcaaagagttaaagataacctcgttccattttacatggaaatctaccgacggatagtagctttagccaactctacagtccatttgtttgtatattcttttataattgtaacaatacatgctttttttaatttgtggatttcttaactttcatccctttatcaggttgtattgactgtgctcgttgtgatttggggtcttcgcttaggactattcttattaatgaggtatattattataaaacagcaaagtttgttcaaatatgaaatgcattactaaactttctactatcttaaatgcttcatgccttcacgcatatattctgtgttgttggtctgatgtaggttattgttatcttttttatgagcaacaaaaggatcttatcagtcaaacctgataattaatattggttccattttggaatttcactatggtgctatctctgaaggctgttgctcagcccatcacataactcatttcacttatgaactggttaatgaatttgatcaataagcatgctcaatatgcaaccaccaaagcacagatgcagatggatactgtgaagagaaggcatttatcatcttcacaatatgcttatgcagatggatgcagatgcagatgcacaatatgcttcttactacttgagtccaggactgatgtggtgtcttgataattctagcagtttctcagttttcaggaaacaagcctggtttttcaaggaaatcaactttattttgacgttattattcatgactatgatgttgtagggctgttacatggcctatatatactttatgtaacttccttacttgctacattgcttatccttagcttgagccaaaacattcgatgttatccaaaatgacttactaatgcttatattgtctaaatttgtctaggattcttcaatggggagaggacaaacggtttgatgaaatgcgcgataacttgggaaaactagcagttttctggattttccaggtaaccttttgtaactttttttgcctgcttaatttgttagtggcttaagagagccttaccgggccttctgtcctgatttgggcaggctgtttgggtatggactgtcagcttgcctgttacaattgtgaacgcaagtgacagcgatccctcaattgaagcccgtgatattattggttggatcatgtggctgatcggggcaggtatggaagcaatagctgatcagcagaagcttacgttcaagaattctccgagcaatcgtggaaggtggtgtaatgtgggtctttggagttatactcgccatccaaattactttggcgaggttagtcagtttattttgcacgaacaagcttggttttcactaacctgtaagcgaaaagtatttgcctatgcagtttgaccttgaaaaataaagtaaaacataggtcaatagtttgctaaaaaaaactgttgaaaacttggaccttctcattctctgccattcatcttgcatagctatctgtttctaccaattgcagatattttgttgtgcactgctggttatatatattctgcacacactttatatgatataatctatttaattttacagtgttttgaacaaatactgacatttgtttgacaatttaattcgacacagatattcctttggtggggaatatttgtagcatctactccagttctctcaggagctgaatggctcgtgatcctcggacctgtattcctgacgctcttgcttctcttcgttagtggaatcccacttctggaggttaacaaccacaacttctctttgaaattatatactttgttacttgcaaaaatgctaacacatcacaccattttatgctcctgttttgaaggcttctgctgataagcgctttggacagaacgaagaataccgcacgtacaagaacactacaaggtaaggaagaactcctagacatgacacttttcatggggaaattttgggaaatacaatcgcagagatttctgagttgtaaagtaccatcctacatgagaatgacatatgggacttggacccgtatatcaatgacacatatgatagtattttctaactctgtgatttttgcgattgtattaagcaaattggcccgttttcatatccccactccaagggtccaagcatttctttgcagatttcaacagcaaagggtgactagcttatgcatttgtattttttatctgcagtcctcttatcccactaccaccagctgtgtatggagccctgcctggatggttcaagatgggcttcctcttcgagctcccgctctacaatcgtgtaccgcaacgtgatcctgtcagctgatgatatcagtgatctctagcgattgttgtgtacaatgtgtgtagtataagatacttcctccgtttcacaatggaagtcattttagcattttccacattcatattgatgttaatgaatttagatagatatatatgtctagatatattaacatcaatatgaatatgaaaaatgctagaatgacttatattgtaaaacggagggaggacattgttattgtcgataagtgatttcttttcgctttggttattagggcagtgaaattgtatccacgtgaaaacattacgttcccttcagctctgtttctaagctatccttttggtccctttttaaaatttccatgatataaacagccaacagccattgactatggttatttgtctgagcaaaacacctgatatgattgacaatggggtcagcactaaacgaagtttgtactcctacacattttgacaattatttgtacagagtagctactccctccgtttcaggttataagacattttgactttagtcaaaattaaattgttttgagtttgattaagtttgtagaaaaaagtaataacatttttaacccaagacaaatttattatgaaaatatattcaattattaatttgatgaaactaatttaatattataaatattactatatttatctatagacaattatttgtacagagtagctactagctactccctccgtttcaggttataagacattttgactttagtcaaagtcaaattgttttaagtttgattaagcttgtagaaaaaagtaataacatttttaacccaagacaaaattattatgaaaatatattcaattattaatttgatgaaactaatttaatattataaatattactatatttatctataaacttagtcaaacttaaaaaagtttaactttaaccaaagtcaaaatgtcttatgacatgaaacagagggagtatatttaaagcccgacgtgcattttaacattgaaaaaaaaacatcagaaagtatatgttaatctttgcagttttaactgaaaatggagcaaacaggccatcctgtcgctagattacgacggccaaatagctgtagagacaatagaacttaaactagggccaaaaatcaaaacattctctttcaaacaaaatatgaaatcgctgtgcaagttttaaaccctttcgagagattttcgctgcagggggttgtctccaggcagcagctacgtatacggagtctacacgtcgcgtcgatcacgctcacgccggcgcgatggacaccttgtcgacctccacgacgtactcgagcgtggccccgggcgggacctgcgcggcggcgtcgccgaagtcggcgccgtcgtcgccgaagccgagcgccggcgggacgaccacccgccgcttgccgccggccctcatggaccgcagcacgtactccaccccctcgcacattcccctcgtgtacggcctcgaccccatcaccagcgccagcggccgcttcccgtcgccgaacgtgtccacgaacgcct

SEQ ID NO: 31370 - DNA, 2563 bp, Oryza sativa
  unsure (1)..(2563): unsure at all n locations
nnnnnnnnnnnnnnnnnnnnnnnnnnnnnnnnnnnnnnnnnnnnnnnnnnnnnnnattgtaaatgaatgaactattactacaaaacctgaaaactgggtattatgtatgtcacctaaaacttatgcaatttttcatttgtatcctaaccacctgtttatatcactgaccaagtttttacggatagaaactatctcatcaaggactcttaacgtagtatagtaacccactatgacaggttaaaacagagtaatagaacctgaaaactgggtattatatatgccacctaaaacagagtaatagaacctaacgaggatttttctggagatttttcctcgcttttttttaaaacagagtaacagaccgaattttaatttataataaactttatcaactcaaggacaattcaatagccagacgcaacggttgaaagtatagtaacccactatgacaagttaaaacagagtaacagaccgaattttaatttataataaactttatcaactcaaggacaattcaatagccagacgcaacggttgaaagtattaagagagaaacaatgatgataacacaaaccaataattggatggtcaaatttctcatcagctagaacacaatctgtggtatttaaaattcttgaaaatttcaacctttctacaattataaactaaatccacggtatttaaaatacttgaaaataccaacctttctacagttctaaatcctcattgtattgtggattctgatacacaagacaagcattcaagtataaaaaagcaagacctgcccttattttttttttcatatgggtatagaaaatttattaggataaactttggagaagcaagcacgagagtcgttatacagaaataatagtgcacacctgcatgccacatacaaaacaagccttcaaaactaccttgtatgttattcagacggttttagatagttcaggggttatttaggcagtttaacagttcaggaggtggaggtgacagatttctccgttttgaataccaagccaaacggtgtacaaaaacatatgaaagaagaaagaaaattagcacctctttggactcaaatattcaatgttgctagaccacataaaatctccacaatgaagatcagatacaatatatgccctctgcaaaaatgatagaagaacaaatctgaagcaatacgctactgtaaacaacaaacataacaaaatatgatatatatttaggcggtaaaataatgcactacatgggccatagtagagtttgcattgatcaccaacaataagaaaagatacataagtccagaactaaaccatcataaacatatcctaaattcatgacaatatagggcatagttttcagacatataataaaaaacgagtaatcatcataatgtttgtacctcgaagtactaatctagaattagatccttctgtttccaaaagttcccttgtaatactggaggatctttggcccattctgcagtagatgcttcagtgagttgcatagactgtgtcatttcgtcttggaggtctatcaggaactgagcctggcttaaatttggatgcttcatgccttgcaagttcaggtggcacaggactgttgctctgtataagcatctgtttcagatcaaagaaaatgtcagtgttctccagagttaaaaacgaagttgccaatcccttctttcctgcacgtccagttcttccaatacgatgtgtgtatgtatcgattgaactaggcatctcatagttgatgacatgagcaacatcgggaatatcaataccacgcccggcaacatcagttgccacaagaacagtgaaccgccggtttctaaatccatcaaggctcgtctctctctgctcctgtgacttcccaccatgtagtgttgtgacgcggaagcctgccttgtctagatccttcgcacgagcatctgctgatttctttgtgttgcagaacacaatggctggcttatccccaagatctgtgagtatcttctggagccttgacatcttctctgactccttcgtcatgatcacgttctgtgtgatgagatctgtggccttgccagctgtaccaattgtgacaacgactgggttccgcaggtacttcctagcaagccgctccacagcaggtggcatagtggcgctgaacatataggtagtcctatagatcgtttttgcatcaagctcctcatcctcattctcaggtttcaagttactcgatggcatagcatcaaggactccaacaacctgcggctcgaagcccatatcaatcatcctatcagcctcatccagaaccacatagttgcactggttgagcacagcatacctcctctccaagcaatcaagaagccgaccaggagttgcaataacaacctcacagccctgcctaatcttaaaaccctgctcttcaatggattgaccaccaacgatagacacaaccttaatgccaagataggtcgcaaatttcacagtctttttctcaatctgttgagcaagctcacgagtaggtgccataacaacagcataaggacccttagcctcattttccttacttatgggtggga

SEQ ID NO: 31371 - DNA, 4313 bp, Oryza sativa
  unsure (1)..(4313): unsure at all n locations
cggcgctcccggtcacggtcccggtccctgtcccgatcccggtcccggtcacggtcacggtcacggtcggaggagtcgcggtggtgggaggaggaggagtcgcgaggggggttggaaaggggaggcggcggcgccgaaggggggcgggggagcgactggagcaggtcgagggcggagcggcgctggtcggtgacggcggcctggcggcgctcgagcgccagcttctcccgctcctcccgcgtgaggaacttgggcttctccatcccgtcggcggcgcgcttcatggcggcggcggcggcggcgggattcgtggagttggggagggtttgtgtggaggacgagacgacgggttcgggaatgggcgaacagatgggcgctactacttgtctacttgggccgtgcaggccgcaccgacctagtgaatttgggccgtgaaatgagcccagatgcgtcggaatcccggaattcggagtggattcgtggatttgggggtttgggcttgaaaatttgccccaaatgtacaggaagggaagtgctcccagtgatgatgaggatgaaccttatacttgttttccttcaagatccatatgaaatggtgcgttgattaggaatttgaaaagaatttggaagaatcgttcctttgttccaaaggaccaaatagttttttttatctataggtatccaatcctacaatatttctccagttttcatttgttgctaaggggtcctaaagaatgatttccctctaaggcccagtttagattttaacttttttcttcaaactttcaactttttcgtcacatcgaactttcatacacacaaactttcaacttttccatcacatcgttctaatttcttcaaacttccaattttagcgtggaactaacacaacgtaaattactgcactccaatatagggcagctaaaagcctaaatttcaaattgtcactttcacgatgaaatttgatctaacttaactagagatgcttaactaattaaacagcatagcgtgtgctgcttgcaaggtttacaaaaccatgttgctatcgcggttattacatacagtaaccttctcagtttttaaaattacggtatacttcacggtaatcgcacggttgtgctgtaaccgccaaaccagtgacacccaaaacagtctagggaacctttgttgcttgcgcctacactctacacagtgaacagggagaagcagcggggcccatgtatcagtctaacagggcttgctctaatcaacccatgcttaacgccaaagcaaacaatcactgtcggatcagttgggtagatgcgacgcagctcgcaaacctgtccgccccttatctatcagaacgaaccctctcaattacatgtgggccccacaacgagaaaaaaaaacctgtacgagcgtgccgacacatctagcctacaacgacactgtccaggctagcttagtggcttgtcaagaatcaagcagctactagctttcaatgcaagaggcagcagcagctgatcttgtcaagctagcagaggaattgcaaagaacgatggatgatactaacatggtagggcagaagcagagctggcaggtccacccaacaacagatttttttggtgaccaaatggtccatccatctcatgatttctttgacagctaaaccaaatcatgcaagacctgttgctttccataaccataattaattagcacttcgtgtttgtattttgcattttgtatatgaagaaacgagagagaagaaagggaacagataagcaaaaccataaccgtacgtgttacagccaatgctcatcagacaatgatgctatgcacaatgcactcaagagcaacccacattccaaaagcattacatacaacttagaaaatttacagggggaaaaaaacagaacaactaagaaaggcactgaggccctttttctttagccttttttttatactcactctacctggcatcaaagctggcagaggcatatgtttcgtgttaatgaattccaaggctttttcacaagccatggtttttgccacaaaacacaactcatggagggggcagctcaccaacccctcttgttcttgagtaaaagtttggaacccccccccaatcccctcatataatgaaaccaaacgaaaaaggacgtggaaagcggtccgcgaaaaaaaacctggacctttggaaggcagaattgctccatgatctgccatccagacggcaatgccgaaccaacttgagaattcgagcaccaggtggatctcctttccctcctggtctgcgccaaacttctggcatgacaatactagttagtcagcaatcttttttcgttgttttatagctttcatcttcaatgcattttcctcgaacatgatcataacgctctgcagatgatctggaaccagcaagaaagaatcaaggttctgacagaattcagtttggatataatgtggtattgttaggcaggaacatttggtgaacatttagtatttgtataaaaaggagtttggggggttgcacatcttcttttagtaaagtggtattttgtctattcaatgttctggaactaaagagtttgtactaaagtaatatccatgtggaataaatagaaccaactattgtactatacatgtggaaaagaaaattcgtcaagtaatcatgaatatgaactgcacctttttaccttcaatccgtgtaagggtgcagataatgcggtgagagctctccagagttccttgtacgctgctcgatccttctcaggtccctaagatgctgcaagatctcctgaagaagatcaaaccccttgtctcctttcttcaaagacctcacacactgttttataaattccttgtctgcctctagagcatgcagccgctcatggacttgatcaatttcatgcgctattgcaagtttatcttgctcattagctggttccaacacaacattttctgtagaatggtctgcctcaggatcttgccttgttaggaggtcgttcccatcttccacggtagtgtcatcaaataatgggagcagcttttttcccctatagcttacaccttttcttttgtcatgaagtttgaagttgctatcatcatcagagaaaccatttgaggcacccatcaaatggttttcttctgataatcgcttgtccatcttaacactatctgaatcttcatcttcgaggtcaaatagcctctcctctagcaatttgagctgctccagtatggagagtctttcttcctcaaaatctgcgagtgagcaaccaagtgtccccagatgcctagcagtttcttgtaacacagcatcagtagggatactaccattgcttccattaagaccatgggcagattcatcgccttcatagaaactttgggaatggtcatcgctgtcctcagcactggatgatgctgaggatgacccattgtggtcatcagccttgtgcctggacatttttctcctttccttcacctcaaagagatgaaccttgcgtctgtacaactcgagctctctctccagatcttgtttctccttctctctcttcacaactagttcattcaacctctctagcgcatcttgatcatactccgattgttcttccataagtcgctggtactggattgcctccatctgcattgccgccttttgttcttgcaagcgatttatcattgccatagtctcatcagcagcgatagcagctgcactcctctcattttcaagctcagtatatagggtgctcaaagatttatgtgcagatgccaaagcagattttaactgatcaacactaaccagttcaatactttccagatcaactgacttggtatcagaagtcattgctttatggtctggcaactcatgtaaaccatcgatatcttcaatgtgaattggtgtatccggagcactctctgattcaacatcattatagtcaggacataatttgtttaagcttgttgatggtccataagagaattgatgtaagcttggtagagcagcctctgttggattaactggatcaatttgaaaaaaaaaagatgatcagttgatcacactagagaagtcaacaaaagatacaaaccaaatgattaaaatcttatttcttaccgttgcctgcactgatgttagcatcaaacaagtctgttacatactcaatagcacgtactgtcataaaagttgattgatgattcagctcaggctgttcagcctgattctctttggtgccatcatttgaaatcaaatgaacttcttcccaagaatcaattgtcacagannnnnnnnnnnnnnnnnnnnnnnnnnnnnnnnnnnnnnnnnnnnnnnnnnnnnnnnn

SEQ ID NO: 31372 - DNA, 752 bp, Oryza sativa
  unsure (1)..(752): unsure at all n locations
gtttggatggtttttaacaaacgagggaacatcccctcgagggattagaatagtttccctggcagatcatgatcgcacgtggttgcatgtgattgacgtggaggataggatagacttcagaagtagtgtaacaccctctctcaatcataaccgtttaaggttaagattgcttttaaaattctccagtagtcgaactgacaacggtttagtaaacccatctgcaacttgatcacctgaagaaacaaaatcaatttctagtaatttctgactcacccgttctctgacaaagtgataatcaacctctatatgctttgttctagcatgaaaaactgaatttgctgacaagtatttggctccaagattatcacatcaaatctttgctgctcgaggactcttgatccccaactctgctaataaggtttgtacccacattatttctgctgttgcatttgctatggctttgtactctgactctgtacttgaccttgagacagtggcttgttttctagcattccatgacactagatttgagcctatgaacacagcaaaacctccagtggactttctgtcatctacactgccagcccaatctgcatctgagaatccactcacaagtgtggacccagacctgtctatattaagccccatactagtacactgttttatatatctcaatattctttttactgctnnnnnnnnnnnnnnnnnnnnnnnnnnnnnnnnnnnnnnnnnnnnnnnnnnnnnnnnnnnnn

SEQ ID NO: 31373 - DNA, 584 bp, Oryza sativa
  unsure (1)..(584): unsure at all n locations
aattcgagctcggtaccccagatcatgatcgcacgtggttgcatgtgattgacgtggaggataggatagacttcagaagtagtgtaacacatccggcggcatggaggtggccaccacggcgttcaccagccttgttgtcgctgtgttgtccgacgatggccaccacgggtcggacctaagctgtgccaggtgtggagtggttggagaaaaaggatagagagaggagaagggcactgcaagtaggccctacattttttcttatttttcccatcacttacatgtgggccgaacttctattttgtgattgggctaccacgtcaacacatgcggaccaagtcaacacgtcacgtcagtgaaaactgctgatgcgggagtccaattatacatgttttaggccctgtttctttcagcttgggattattataatctagattattgagtcagattagtataagctagattgttataatctgtagtagaataagtggttagttgtttcttttctagattattagagcctagattattannnnnnnnnnnnnnnnnnnnnnnnnnnnnnnnnnnnnnnnnnnnnnnnnnnnnnn

SEQ ID NO: 31374 - DNA, 1393 bp, Oryza sativa
  unsure (1)..(1393): unsure at all n locations
atttatgcagcgttacatgaacttgaccctgtgttcaaaaagttctcttttggagcgaatgtttccagcctgttctcttctttacgctacaagagacctgcagttattcaatctatgtacatctttaaggtaccttgtgcagtctctagtttcttgttggcattgactataacttttattccttattgggttaatttctccacaactcagcaaccaggcattggtggcgaggtggtaccacaccaggataatacattcctatatacagaccctccatcgtgcacagggctgtggcttgcactcgaagatgcgacaaaaacgaatggttgcctttgggcaattcctggatcacataaaagtagattttcgcatcaaattattttatttcaagaatcctcttgtgtttatctgagcttctgatttgtttatcatttacattgctttgtaccagatggcctgaaaaggcgaatgatcagagatgaaatcgatactcattttgatcatccttcgccaacctatgatctgaaagaatttgtgcccttagaagtaaagtcaggtgatttggtggttattcatggagatcttatacaccagaggtgaagttatcctgttatattgcgtatgcttgcaatcaactgcttcatttttttactaatatgttttaactttctttgccagctttgaaaatctttctccggtgtcaagacatgcactgagcttacatgtaattgataccgaaggatgtgaatggtccaagcaaaactggttagtttattttaacacttttggagaattctaaagttaaaattctatcttctatatttgctcttggtggtctttgcataacttactgtcgcgcagtagaagtctagaattgcctagaaacaagctattctacttccaagcttgtcctaaactgctcaaaccaagctaatccctccatttcacaatgtaagactttctagcattacccacattcatatagatgttaatgaatctagatacatatatgtctagatttattaatatttatatgaatatagacaatactagaaagtcttacattgcgaaacggaggaagtacttgttttagactgtataatcttatactgcataatcttgtacttgatactgtatagttttgccgtagcctgtaacacaggacacatattggttacttgtacctgtatatattgaaacaaggtattgtgccgctgtttgtatttttacaaatgggaatgatgttttactttatctttcatgtcaatcacttgaaaactccgaaggcagaaatttattagtgtccttgtttaagtcactgttagcagaaattttgtannnnnnnnnnnnnnnnnnnnnnnnnnnnnnnnnnnnnnnnnnnnnnnnnnnnnnn

SEQ ID NO: 31375 - DNA, 560 bp, Oryza sativa
  unsure (1)..(560): unsure at all n locations
ccattcactttttccacctatcttgactactcattcaatcacaatcttccaccactcacttctacctattttttttaataattgtgtataaccctaaaacttcttttatattcgggtaggaagggagtataagcaaatcatcgacgtacgtaacccagacaaacgatttatcccggtcactcaacagcccagtgtgtcatgagtcatgacacagccgtaccccgcgcccttagagtagcaaacacgccagcctcaaattgtactaagtgtaacagcatcaatgacgaagaccgtacgaaacagtagtcatccgttttccctgatgccaaccacaagcagtgctagcatgaatggcgttccaaccacccaaaaaaaaagggtaattacgaatttactactgatttaaattattattgtaagaatatcgctagaaaattacaaaatgcaattagaatggtcattcgattcgagtggcattttacaaatttgcaaatgcnnnnnnnnnnnnnnnnnnnnnnnnnnnnnnnnnnnnnnnnnnnnnnnnnnnnnnnnnnnnnnnn

SEQ ID NO: 31376 - DNA, 696 bp, Oryza sativa
  unsure (1)..(696): unsure at all n locations
nnnnnnnnnnnnnnnnnnnnnnnnnnnnnnnnnnatttgttttagaatattaaactgctcatacagtcatactgatgtgtgttcctaattaaacagggtgccttcacaatgcaacacttcgaccagaacttgaactttcttgctagaaagaaggatcctatcacgaaaacggtacgccttttatttacactgacagtgataactttttacaattgtctgttaaataaatttaattgttaattttacctttatctgttgcaggttgtgaataggttgcttttgaacattaaaccaaagggtgttggttctgcaatttcaagctgccccggcgatgatccaaaaatgatttccagcttcaaagatctcctggaaaaaatatttgtgctagatccaaagaagaggattactgtgccagaagcactcagccatccattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31377 - DNA, 727 bp, Oryza sativa
  unsure (1)..(727): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtgatctcgattgggtgcgtgtgcagcgccgccgttgctgcgctacggcaagtactgcggcatcctgtacagcggctgccccggcgagcagccgtgcgacgagctcgacgcctgctgcatgcaccacgacaactgcgtccaggccaagagtacgtcacagaactaatccatcataattaccaactactgtcccgtatttgcatagcatatgctgcttagttttctatgtgtatatatatttttttttctttcgttcatatcatcagatgactacctgagcacggcgtgcaacgaggagttgctggagtgcctggcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31378 - DNA, 637 bp, Oryza sativa
  unsure (1)..(637): unsure at all n locations
actatagggcgaattcgagctcggtacccatctcctcaacacgctaactagacatcatctcctcctatagatgcagctttgtgaactttcgacgcaacaaggtctgcttgaagtgcaagcatgaaggccccgaaaatgatacccatgacagccagcacggacacaataggtggaggaacacgagaggggctgacagaagtagaagttttgatgactctttcgatcgggaggacgatggctctgatccagacgaaggcgagcgcagacgtgccaaagtgcgcactagggcagcatcaaccctggggagatccactggcaagagcaaaatttttgactcgattcatgaggatggtaacggtagggaggatgacagcgaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31379 - DNA, 539 bp, Oryza sativa
gtcgtcggagtacgtcgggtatatatcgcgtgatacctggcacgtgatacctacctgataggtatcacttgacacctggtaggtgtcacctgatacatcgcaagtatcaccttctatgtggtaagaatcacatgatacctgataggtatcacctgatacctcgcaagtatcacctgaaacgtggtaaaatcgcctgatatctgatagttatcacccgataccgaacctgatgttaggtatcatcccgttcgaaaacgagatttcattatatagcatccctcttacatctacttcctccgtccaaaaaaaaaagctaacctaggagaggacctggatagacctttatccagatttgttgtactagaaagggcacatcggcagagggagtatagtagtagtatctcgctgtagctcgcattaataaaggagattcttacgaccgtataaaagagaatttgttggtacatttgggataaacgacacaatcgccggggactcaaaagttgctgacatttgggatgaaccttcatatatatgac

SEQ ID NO: 31380 - DNA, 702 bp, Oryza sativa
  unsure (1)..(702): unsure at all n locations
nnnnnnnnnnnnnnnnnnnnnnnnnnnnnnnnnnnnnnnnnnnnnnnnnnnnnnnatattgctatttttatcttggtatatgtagatgatataattgtagtaagttcctcagagagggcaacaacagcattgttacaggatctgaaggtagaatttgctctaaaagatcttggtgagttacactattttcttggcattgaggtaaacaagacacacaatggcattgttcttactcaggataagtatgctactgatttactaaagaaggtagggatgttgaattgtaaacctgctaccactcctttatctgttagtgagaagttgtctttacatgagggatctctcttaggacctaatgatgcaacacagtatataagtatagttggtgcattacagtatttaactctcactaggccagatatagctttctctgttaataaggtgtgttagttccttcatgctcctacaacagtgcattggacagcagtaaaaagaatattgagatatataaaacagtgtactagtatggggcttaatatagacaggtctgggtccacacttgtgagtggattctcagatgcagattgggctggcagtgtagatgacagaaagtccactggaggttttgctgtgttcataggctcaaatctagtgtcatggaatgctagaaaacaaaccactgtctcaaggtcaagttcagag

SEQ ID NO: 31381 - DNA, 723 bp, Oryza sativa
cgaattcgagctcggtacccgatttggtactggtacacattcaaatgacaacttttcatcaccggaaaaaaaactaaaatacataagtcgaatcttaattagagtcgtgtgaataatttcatcggtgatatgatcttggttgtacggagacacttcaaacagaagatgagttatgcatcagcatcctgtaggtttttgattcggatcacgtatgccccgaaattggaggttgttattaactttgctccttgttcgagtcgatgccaggaggccaggactagcagataagtacgtcttgttcagtatgaacgactgttattatgcacactggcgatcgattaaagtcaagaaaagaacaactgattgcacgtccccgctacacactcatttctacttttctaaactatttaggaaactctacttcaatttcaatgtcattgtcatttttgaatgcttcatgagatatgcaatcctggttacctttcaaagttgaaaaaacgagccaactcagttaaggctacgctagcgatcgatccataaataatgcgtcggaagtgtccctttcgaagacacagtacaagggtttgttccgtgcgccacttgatcgttcacttggcacacctgtgtacctgaccatttcccatcagttaccatgtcaatggccgcagtacgcgcaaatgcacgtttcttttgtccgtacaggtcgccttttgtcgtgccctt

SEQ ID NO: 31382 - DNA, 17704 bp, Oryza sativa
gaatatcagcccagtcaagaagtacaatgggcatcgtattgcccgaacagataaagctagcatgccacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagggtaaagtatgcttcccatggtagaattggcgccaattcttacctccctctcagatttttccctccaaaacacatctgctggaatcagagagtaggtgaaaagctgggggaaattaagcaacgaatctagaccatcccttatgtactcgatggttggatgatggatactgttaaagttgcagtcactactgatttgaatcctcgtgagagatgatgtgattacattacagacgcaaaatccagatttcttaatcgcgaatcatcaaaccgaaaccaactccaaaactctaatttcggccaaagagattccgcagaacagttcgagttgaccaatattatatagtttatttccccccttttttgttattactattccaactcgattatccaaacaaagtccatgttggatggatccagatcgccacaacactcccttgtcagttgtctgatcgactgatcgtctcatccctccctaacccgtctacttggccgataacccgtctcaccgccaaatcgccaatctcccacctcgtcacgcatgcgtgttcaaacgtgaactaatcaactctccgcgactccgcctccggccgtcccgtccccgtctccgggattttaatttcttggcacctcgcctcagcatattccatgtcccctctccatccgccccacgcgcccactttgaccgacccatcgatcgatcacgatatttagtagtagtagtagtattacaaatccagcaagcgatcccaatatcccattcccaaaaccccaatccatcctcggagcacgccaccttcacgaggaagagagaatcgaggaagcagagcgctcggaccagaggaggaggaggaggtgccagccatggtggaccggatcggcgccgcgtggtggtgcgcgtgcgccgtggggatgctggtggtgggggcgtgcctcgccggggagaccagcgagtaccggcgccagctcggctccgccgtcgacatgccgctcgacgccgacgtcttccgcgccccgcccggccgcaatgcgccccagcaggtaacccgctgcactctgcactgcatgttcttttctgcatcgcggaaggaaggcatcgatactcgatagactcctccgagggtatcgggtttcgaagccctcgatttgttttcagcatctgtgcagcttcggaggaatcaaatgttcctcttgttccttttgtgatcgatgcttgagatagtagcgtcctgcatctgttcgtgattcgtcactcgtgagccgcacttcgattactgtagattgtataatatactagtactagtactacggagtattttgctgttcgttttgtactcgcgctggtcctgctgagtgctgagtggtggtcatccatttgcatatgcttgtctcatggtgtctccatgctgatgaaacaagcaaggaattttcggtttcgatggtcccgaagttgactgcttgtctctcttcagaaattgtctcctctttaatcacactgtttgtgtttaattcgatcgtttcaatcggataaactgttgtgtttctggttggtagacctgaatttagcgtggcataaatgtttctagctacttgtgttacagggtttctgtcattagtctatcgatgagcatttggcttattcagagtcgtcacctggggtgctttttgcacttagcttaatcccagtccacaaacttggtgtgttcatgaattaaaatactgcttccgtaccaccgcttgctctgcttcactcatttctaaagttaacaccaacttttagggaagtgttccaacttctatcatacactatctgcttgaccatttactagtactaattggttgcagggcccttttacgaacccttttgttgtcttttggaactttcttattcttagggcacccgcaatggttatctataggctctctacaagagatccatgtcagcatatttttctacttggaagaattaaatgtagagagagagcaaagctatctactaacctgaagatagtctatagagaaaaacgaggcaatggattagagagctatagatacccatgtagacataccattaaagtggtttactattaatctagtctattgctgagatgtacatgttttatagatagcaccttactttaccattgcgggtgctcttatagagtcttactcccttgaattaagtattaggatgccttttactgagattgatgtccattcctttttcaatatgccgttagcataaaaaattatatgcaagatgtgctggggtatggtcattggtgtattctccactctgatgcttattgatattgttctctgaaaggttcatatcacacaaggaaatcatgatggcactgccatgataatctcatgggtgacaacaattgagccaggctcaagcactgtgctctatgggacttcggaggataatcttaatttctctgcagatggaaaacacactcagtatacgttctacaactacacctcaggatacattcatcactgtacaataaaaaagttggaggtattagttctttgcaaaagtcgtctttagtgtttggactgtaaattaaagattgactattggctttgttgcagtttgacacaaaatactactatgctgttgggattggacaaaccgtgaggaagttttggttcagaacccctccaaaaagtggcccagatgttccatatacatttggtctcataggtagtattcaatattcctaaattcatttttgctatgtcaggatacacattcaccaaatctataaacgatctatatcactgaaaacaacatctgtattcaggtgatcttggtcagagctacgactcgaatattacgctggcccattatgagtccaattcaaaggcgcaagcagtacttttcgttggggatctgtgttatgcagataactacccataccatgacaatgtgaggtgggatacatgggcaagatttgtagagaggaatgttgcctaccagccttggatctggacagctggaaatcatgagatagattttgccccagaacttgtaagtgtagtactccatttaactttatttgtgtaatgatcttcagtggatgcatatacagttcagtactagataatcagtggagcttatgttataagcatttacattctgttgaacatttgcagggtgaaacgaagccattcaagccatacagctataggtaccccacaccttataaggcttccggtagcacggcacctttctggtattctgtcaaaagagcatctgcttatattattgtcttggcatcatattcatcatatggtatgtaatatgatctagttgcgttttcttttgcatctgtattcaaagtacttagtaacaagcttcacaagtaaaattaaacacccacatgagcaacattgtgaataagtagtcagtcttacatgctttgggcaaacagaaacacacactgtacataacaatgaacttattaacttatactccatttgttgattgctaatagatggaataagataatttatcagttcttctgtttctttcccaggaaagtatactcctcagtacaagtggcttgaagctgagtttcccaaggttaacaggagtgaaacgccatggttgatagtgctattgcatgctccgtggtacaacagctataactatcactacatggaaggtgaaagcatgagagttatgtatgagccgtggttcgtcaagtacaaagttgacctcgtgtttgcaggacatgttcatgcctatgaacggacagtaagcacttacagttttttttcccctgaaaaatagttaaaactttgcatggggaatcaaatggaaatttcttgcaacttcattaggaactttagcacgcacttctttgtcgtctttatatttattagtatatacttgcatctagtaaaattaagttcaacgtgcttgtcgttttctttaaacaaaggagtgcttggttttactacttttttttaaactggtacggagcatgtatagctttactactgatactctgcttagagtagtactagtaccttaatcttgagctgctgacatagacttattttctctgattgcagcacaggatatcaaatgtcgcgtacaacattgtgaatggccagtgcactccagtccatgatcagtctgctccagtctacataaccatcggagatggaggaaaccaggaaggactggccaccaagtaagaatccttttttcgcttccaccaaccgttttcagttcctgaacgctgacaagatatcatgtgcaattgctgggaaaaaaaaacaaatataatgcagcatgacggcgccgcagcctggctactcggccttcagggagtcgagcttcgggcacgccatcctggacatcaagaacaggacgcacgcgtactacacgtggcaccgcaaccaggacggcaacgctgtggcggctgactccatgtggttcaccaacagatactggcagccgacggatgaatctttggacgactcccagtgatctgagtcgttcgtacatggtttactcacacctgctcctcctccctagtttgtgttgtggttcttctacgtgaataagcactggctcgatttgaacacacaggacggactcacggacgcctccggttcaggcgtcgtgatctaggtggttctttctccgctccagctccctcgtggccgtgtgctgcttgtgtatagaagaagcgcagctcacgtgcagcgagaggaaaagaaagctgagaaattgcgagttgatacttgataggcttgtgtacgttcgtactcgtctagatgttgaataaacacattggtttcgtggcgttgcgacttgcatttgacaatccgagtgggagtaacatgggcttctggcaagctgtggcttgtgccaaatcctaggaatccgttattatcagtcttttcgaatacttcaaatgtcgacaacaaactgataataacatcaattcagacttatcagtaaatcccctgaataatactactctaaatatgactgtatctagttctaaatcccctaaattgtaaatataacgatgcaaacattcagtagtaggtggcgtctatcccagccctatctagattggtttttttttttaaggacggagggagtacgaaaaagcactgggtcgacagcagctcactaatgttgagagattaaatacaccttaataagattagtaagcaaaggctctggtaactgccgtttgggccagagattagatagcctcaagttaagcaacgcagcagtccacagcaccaaaatgaacatttgtacatacatataaattgtcaagacaagcacaagtcgtcagattcccttgccaagacataaacatagcaattcaaaatggcagaaccaagcatatgacttcttgtacaggttaagtagcaaattttcaacgaaacagaactaagccctaacacatgtacttgaacttctgtccattgtagtatccgtatttgtggcgagtccgggtttcattacggggcagatcgtccggatgacaccaaaatggcttgggcacgggccagctgttataaaaaaaatgtatagggtacaataatgctatcaacaaacaaatcaacaaccaaatgcaaaacattgtaatttaactgcgatatgaggtgcaccagaatacctatttggccgaacactacgatctccagtcatagtccaatcaagcacaccagatgaagtgtcaccattgccaactttattgatagtcctgccaagcacaccaatggatagttttaacacatttgtgcttcggactgaagtaccgaaccagattcatcaagacgagcgcacaaacacatgcacatacgaacacaaattctaggagtacctttcttcatcaaaacgtgacagaacgtggaggataacggtgcatgataggaatggggttcctactatgtcatcaaagaagttgataccaacatatctcccatcaaaatcaataagaggccctccaatcccagcctaaccaggttacatggacaagttaatcatagtaccaacaaatgagactacatgcaactatttacttccaccatgtaaaagtaggcaacaaaaagtctcctcccataccttggtgattttaaaattggcgtaccgaagcattctgcaatcaagtgtgcctgaccagccaaccaaatgaccacttgcagccattaatatgtctgattcgaagcagcgccccacagctaatacatcctcacatacactttcctgctcatgatgaagatttgcagggcaaagagcacggaaatccttcacactgacaatagcaacattgtaatgtaaattacagtgctctagtgtcccttctgtacgttttttgtttggaagcaacacttcaatctgcaaatgacaaagtaagacttaagaagtaccttagaagaacaaggatcacagaataatatgagcacaacgttagctaccctcaaattttcaacaatcttgctacgatcgccagattttctaactaagctcgctgaagtcagaatagatgtacatccgttccattcaataaaaaaacctgtgcatgcaaaatatcttgtttctcctgcatataccgtaattttgattattagtgaaacaaatacaaatatgaaagtgaatagcaaatgtaaacttaccattgaatgaagcaagcgagacaacatttcgagatattcttgaagaaacatttttgctgagctcactccagacaccttcatcatacaagtcgccaaaagtctcttcaaaagtgttgaccaaaaccatgccatctggttatagatacacaaccatcagagggtagctaatgttgtgctcatattatgtaggaaagatctgcagattaatttacaagcaccgattcaccgttggccatacttattgatggcatgggataacccatggagtctagacactcaaattgatcctcatcacaaacatctgcaacaaaggtaaagttagcattggcatatggatgaatgacattcacgtaaaattatgcacataataatcaaatgttagattatataatgagaacttgggcaacaactcatattagaatggctcagtttgcatgcccatgagcataatctaagactaactgattagcactaaaactaggatagtgcaactgcaagacactatagcatatagtatgtattgtgaatatcaaatgagagctaaatttgcacttgtgaggataaaataaaaaatgatgatgaattgcatacaagagaaatatttgggggtggctttgtgctcaccttctagaagggacttaggcatctcaattaagagtcttcctccaaccgtgggaaagagcatcaacatgagtacttctccaaaggaaaaaagggatcaaaaccagggcatcaatatgcaacatctgcatttacacaaaatgtaggaataaatatgacgtgagtacaatggatatgattattttaataaaacaaaagataattgaaaggatgtttatacagaacctcagtgccacgaaacaacacaatcttttttaatgtgcacgtctatctattaacttattaaaggaatagaaaacgaaggctccacgttcgctctaatagcctagaaattctcatattaatcggagaaaaagaaaaaaacggagtccacaaaggaatacaatttaaaatagctgaaattcggaattaaaaataacgaatataggaagagaagactagagtccatcctggtatacaatttagaactaattgaatttcggaattaaaaataagaaaattaaaagcagagattctgtccatatagaaatatttataattaaaatttgaaattagaaaataaggaatattgaaagaaaagtgtagaatccatatagatatacaatttagaaacaataaaaattcaaaatttttaaaaataaggaatattacaagaatagtctagagtccacatagtaatttagaactaattgaaattcagaataaaaataataaattaaaagttgagtttagagtccatatagaaattcaatttataaataattaaaatccaaaattttaaaaaaagaaatattggaagaatattatagagtccatatgggaatacaatttagaaataactaaaattcggattaaaaaaaaggaatattgaaagacgagtttagattccatgtagacatataataataaatatcagaaattcggaatttaaaaataaaaaatattgaaagaagggtttaaagtatatataggtgtaagatttataaataatgaaaaatttagaattaaaaaaaataaaagaatattgaaagaagagtcatgatcatataaaaatacaaaataactaaagtttagaattaaacaaataattaataactattgcgtatatagaatacaatatgaatattacacattggttagtttggtcaagttagtacacaatttaaaataaaattatattataattttaatatattttaataatgaaatgtaaaatatatatgctattatgtgagaaaaaaatataaggatgctagccgcgcaatctgcgcgcgccatcatgctagttctaatatgaacaaaatgccttttaattagaaaaatatattgccttcaacaattgattcaagaaatataagaatgaattcatagtcacaattgcaaatctagtttgctatagagaaaccgtgaaacatgctaataggacaactagtgtaaccctaatatcttggtagaggtagcaaagaatcaagttgttattattcaatacctacatgccttataagtggttgaaaagttcaaaatagattttttttttcggaaaatgtataaagcatacctgattgccttcaattttgttgccaatgcaaaaaatttcctccttcggtaggatgtccgaaaatactccaaccgttcaataattatactgatcggcaggaaaagggatcttcccacaagaaataaaaggttcatgccaataaggttcccatcagaatcaaacagtgccccaccttcccaaccctagcatgtaaacaaaatggcaggcaacaagggttacataggaactaatcaacaaaatagagttatacagaacacgggttgcatacaaatgatgcctacaagtgcatttagtaatagagatagatcgaagaacttctgtttaaagtatacctcagagattttacatgtggacaacataaactcttcagcatcttcagatccatttgaatcgctaattagcatcccatctgtggtgattaatttgccagagatatcacgtcctacagctactaccttactcccggacagatatttcatcacgtgattgggaagcacctcgtgaacattaaggaaggtcatgactttgacaaaagcaatttcgtgatctaaatcatattcatccaaacaccctacgacaaaattgccttcacagcgcacttcgatctataattatactgcgatgttatcgaatgatcgcaattatatcttatgtaaacagcaaaaaatagtaaaggatggttagcaacaccacctttaagttatcacggtcttttgttttatcattgaaagctttaaccaaacttgctgaagtcaaaaaccttgtgaagttacgcttgtgttctatagttatgcctgagcatgcaaacaacacagagtgtcctacacaagaagagtaacttagatcatttatacctagcaacgttaataaatatatatttggcaaaccaagaagagtataacaacgtaatcaccatcagataaagcaagtgatacgacattactaaaattggatgggacctcttcaatgagttcacctaattaaacaaacatagcacaactgagtactcaaatagagctacaagaaacatgaacacacacgcgtgtgcgcgcacacacacagagagagcaaaccagatatctcctctccattgcaagatcttttactcgtacttgggcttatggtgatatcatcaagaccccttttcaatgtcagcatctttccaacactgacacagaaacaataaaaaaaatgccaaatgtgggtcaataaccagtaaaaaccgttgtaaaaccatcacagtttcatagccctatatgtgcctttaagcagttgcggaggacgaaaaaaaaaaagtgtgcctcatgaaacattatctccatgcaaagagttagcatcaattacacaatcacaaatttgtacatttttaaatttgcaatgctctggaattctaaaccatcgaacaaatatatcacctcttcgtgatgccaagaccttcctctgcctctctctttctaaccattttcttgttttgttgccttgctccttagctccttggcttccccttctgcctaggcctgcggcgcagactgccggcctcccgcgccgtcgagccgtcgagccgtccgtcgccgctcgccagccgccacgagatgacagagttggaagaggctagggaatttttatctagggttcagtgaagaagcccaatgggccttttacgaagtgtcggggggatcatcagaagatgggccttttatgaagacgtcaggagactcaggacgagaaccggacacaagtcgtcacggggaaaagaaaaagggaaaaaaaagagaaagaaacggtgacttttgccaactaattctcccgtacgcccgagatccgaagcggctcgcgcggccgccacatcttccgatcctctcgccggcgggcgcgcgcgcgcggcggcggcggggcaaaaatggaggcaacggccggcggctccaccgcctccgcggcggcgtgcccgcccgccccatcccggccgacggacccggacttcctcagctgcgtgctccagcccccgacaccctcctcctcctcctcccgccccgaagaagaatacgccgccctccgccgcctcctcctccgccgcaagcccccctcggcgctccaacaccgtatggtacgcccttcctctcgttcttctcagatccctcattggcgcgcgtagtgttttttttttggccatggggaatgaatgaattgggttggattgggtgggtgggtggtgatgcaggagtggcggtgcaacgggaagggctacgtcgcctaccgcaacttcctcctccgccgcatcgacggtggcgccgcctccagctgcgccagcacgtccagcaacaggtgcgtcttgattttgtttcgttttttttttcttccgcacctcgtcgccctgcccttacctaacgaaacgagaacaaaaaaaatgtagccaggctcgctacctttgtgtgtctctgagcttttcttatgctcatccactagttttctcttaagattaatcatttgaatatgtagtatgattttggaggtgaattctaacactgtggatattgcaatttaccagtggaaggtgggctccttctcctgcctatgctgcattctccgaggcggatagctggagttctagcaaggttggtatcttttattgtttgctgcattagccacattgtaaattatcgttgatacaccattacatttgtgcggatacctttgtggagtgatcacaacttgttgtgaattgtcatgtacttgtttgctgcaggacttgagaaggaacagcggaccattgctccgcaatcttagtatcagctcaaagcagagtgatcctgagcgtcatgtcagatttgccgagcctgcatactcatttgttggaatgcattgcatctttgacgactgcaaagcatcaggtttgttgccttatagtcatggtgcacaatttcaaaatttcatctctgacggtaataaattattgttgttttagtgatctggataatatattaacgaaagtttgattttactcccggcagttacaatattgaaatttggtcgtgcaagttcagatctacttacatatggtgcttctgatggcagtttaacagtctgccaggtttctgacccaccaactgttcttcaaaaattaatagggcattctaaagatattacaggttagagtacaatcattacttgtttatatggttttatttatgtacctacgtggctcaggaaaagtgcttagcttctagtacaagggtgttactagggatgatcaaattgcatatgaagctaagtgcaaaaatcagcattgcaatgtaccctcaatgttactgggatcttattcgatgcttatcttaataatatagaatgatagttcagttaattgtgacttcccaatattttaaatgcctatcatgctgtttgtaacatcaatagtatctcctagtgctgagcatttacaattgctgcacatgtagtttttgtttgttatagccacaaaaaagttgcatgaataatttatggatttggatggatgctaattaaaacagaataattgagttgtacttatctattatttcaatgtttagtatttagtgagcttcgaattctaactgcattacagattttgatttttcatctaataaccagtacatagcttcgtgctccatggataaaactatgagagtatgggagatctcaaaaggcacttgtatcagggttgtatatggggtttcttcccagctatgtatctgctttcatcctgtaagtcccgcctttgcagaatgcatacttatcccattcgcttgttggcaccaatcttatttgcacttcgcattcataaaaattatttgtgtagtaaccaggatggatggtctactttatcatatgtttactgggttttctttcttctttttttttttgcaggtgaataataatttactgttagttggcaatgcaaacagggaaatcaatgtacgattcctgaccttttgctcccagcaattcatatactccaatattttgcctgctgattaatctgcgccttcccttgaatgttctgttttgtgatagtaatggaaaaatgaatgtgttattcttattctggttatttattcactaaagatgattttcttctgattaaattagaaaatatatcacctaatgactaccatttcccctttacattcttttgcttgtaccttttaatgtcgatggttgtgatccatatctctatctattataggccattaattttagcactgggagaatagtcagcaagcttacctttgatgatgcggttacagctttggatgttgatcacactggacaacttatttttgctggggacgctcaggtatccattgatttggtttgtttttactgctaaaatgaatatacgatgttcataattttcaattggtaattgaaatgtgtagggttgcatatatactgttagtgtgaattcacacacgggttcattatctagaactcataagaacaagagcaataaaagcaaatctcctgttacaaccatccaataccgcaccttctctctggtggcacgttgcccagtcctcctttcttgtgttcaaaatggaaacttgtttttcttcaggtgcgtgatcattactgtatgttatgctgttaactctacttttttgtaactatttgtgttgttggtcatttcagcattgcaacagattccaagggatacttgaccctaatatgctccctaaaattggcgtcaccggtgcagagcatccgtgcttctttctgtccactcctttccctcgaaaaaggagaattcattggtgagtaaaaataaaacctttttttttccttttcagttgttgcttgttggttacctcaatcttaaagctgttgataatccaaactctcatttctgatactgttcatgtcagccagcactcaattgctactgcaaattttgtgtattgcctgccctcacatgttgtgttagcattatcctttgtaaacttgtcttttagttcaatgaagtagcaagccgacaatgacacttgacacaagttatcattacaaattttgttaattaattattttacaattttaattgaacttagtgagacaatgtatgatgactggctttggcaaataggtggaccattttgtaccctatgttctgttctttgtaatgcatagctgggtttttgtttaaatctgattcctttttcctcctgaatgtaaagtcacgggcagtgaggatgcaaatgtttacttctacgatttgacacggccaaagaactcgtgtgtaaataaacttcaggtatgttcagtgcttcttctatttttggaatcttaaactttggttccatggcaaaggtaccgatgaaactattttcattcgtgaagggacatggttctccagtaattggagtggcctggagtcatggggaaaatttgcttgcctcatctgattcagatggtacagttattgtatggaagcgggcataaactaattagagcggattccacaaaacgaaagttgcttgtataatgaaggcatttttggcgcatgttgtacctcccatcatatattgtttgtaagacacagaagatgaatcagccttcaattgtatttctacaaaagtatagttctccatagagtgtacagcggttcttcaggtacatcttacatatatttttgttcaatactaaaggggtaggaggtacagtataattctctttttgtaaactaaatttcatgagtttaaatggagtagttgcaccctgggtcagattctgtaaggtgaagaaggtttgtgtttgttataatccttcgttttttccgtctacgaatgagccattactgacttttgtattagacttcctgtcttgagaattggcgttttaccggttgaccgaagatctgccaaagaactttttctgcctttctcagctgtatgtgttttacagcggcaatgcgggaaaccatgtattgcaaacctaaaaaccactgtagtataaaaagaatgagcgtctgagatttatcgacactgtaagtaaaattcggggatgacatggacaaatctcatatgtttacttttcgttcctacagtaatttctaagtgtttacattacatacgtggtttgcgccatatattttccccagcaatgcaatggaacacatagctctatctagttcccgaggtgacaatatggcatatattcagctagctgagcatagcattgcaaatcacaaagaagcacacaaccggctagaatagtgtcactgaaagcactagaaacatggtactactaagttgctaacatcaggcaaccattctacccccccagacagacattatttctaccactccaagcaccatgactccatcaagctgctatagcgatggttactgcaaattgaacgtgaatgacaggattattcctagtgctactccgaaggcgagggctaacagcttgcaagtcccatcacaggtgtctgacgtccgaggcgctggcgaagaagtcatgtcgaaacgcaggacgcagtcgtcgctcaccacgacgccgacgccctctccctgctcctcccgacgtgcctcccggaagcatctcggtatctttcgcgccgcgcccttcaggcactgcacgcagtccgccggcgcgacgcccgcgggcactgcgccaccacgcgcccggccagccccgtcctcgtcgggctgttccgacgtcgatcgccagcatccgcgccgccacgccgttgctcatgtcgaggaacgtcgcgtacaggttgtcgctgaaccgcaggacgtcttccggtgaccgacccaccggtgggaactcgcccccccgctgggcttgggcgacaatcgtcgtgttgggtgtcggcggcgtaagcggcgaggtagctgcggtagcacccgtcgagccaggcgccggcgcgggcgccgcagcccgcgacgacgtccgcgacggcggcggcgaagctctcgcggtacagcgccggcgtagagtcgccgaggcagacgctgagagcgagcgcgcggtcgccgccgccggcctgcgtggaggcgaacctcgtcgccgcggcctgggcggggaggtcgtctgtgggcagcgcgaggaggttcgcgcggaacgccgtgccgttgctgctggtggacgtcggcgccggcgaacagtcgatctgtgggaagtacctggctccggtggccgtcgacgtcacgcagacgagaaggaggcaagaaagcttggtgagcgccataagcgatggattgcacgacaccaaggtcgccaggcccgatacgaactgcatgccgtagctcgaagctacaccgctctttatgaaggcgatcgagtgagctcaatgccaccacactgtgcagctattaggcctttcacagcgctccaccctggaccggtgctatggggcgacacattggatttttgctgccgtggcgctcgaacccgcgtctcaagttggaacctcatctccatgttgagcgacgcaggacttcgtcataacgatgccgcgagcagaggagaagactgtaggcgcgcgcgctgtgagcgttgtggcttcgcccacgcgtgccctcgtggcgaaatccaagggcgaaatccccgatacgccctccaaatccactcccacccaagcaaaatccagggcggcctcgccatctcgtcggacggcgccgcagttgccaccggggtgtccgacgagcaggaaggcgcctagcacacttccagcgtgcatgacgccaaatccaaaatcaaaaaccaaatcagaacaaatgaagccaaatcaaagaacaccaaatcgagggcaaggaaacaaaaatcaaacataaatcaacaaatctgaacacaccaccaacacacataccacgtcaccggcgagctcccaagaaacaaaaatggcggcggcggcgagatagatggacatacgtgtcgccggaggcagaagcgatcgaagcaagggagtggggaaggaaaagggaagggccgccggacagatccaccgccgccgctgtcgccacgacgacctccatggcgacgacggcctcctgcgccgcagaggtgtagaagccgtccgctcctgccgccgaccgcccgtcggcgccgtcttgtccactcccgctgctcccaccgtcggcgtcgcgccgtccactacagccgcccccaccgctcccgagtccgagctagagaaggagcgggcggagcgggcggcccggtcgacggcaaggcgaggcgcacgcgccggtgtccccggcgtctggtccactcccgccgctcccaccgtcggcggcgcgccgtccactacagccgcccccacagctcttgagtccgagcgggaggaggagcgagcggcgtagccagcgcgggcggagcgggcggcgcggtcgatggcgaggcgaggcgcacggcgacggtgtccccggcgtccgccgcgagggaggagagggaggagaaggcgaggcgaaggaggagacgt

SEQ ID NO: 31383 - DNA, 738 bp, Oryza sativa
ctgtgactctgattcccacgacggtatcaacacaaatgctgaaggaaaatttggatgcaatgtcgcccatgtaaataaatacagtggcattgcagagaaatcaatggataagtttgctgcgctgatatcatctttcagatacgcaggctctcgtgccagtggtcttcgcgctcctttaaaggatgtgaagaacactcttcctgtcaggtctgcagcttcagaaaatttcaattgcaccaagttcacacaatttacttatcagaacttaagagggggacacagttgtcccaatgagttgatatattttataacattaattgcagatctgttctcagacctccagaacagagattcggttgtacggctaagaagactactagagtgcctctacaaagcagattctcaagtgatgctacaaacagcactgacgttcctgatctgagcacatttgcatacaggcctacaactgcttttgctcattctgatcaggggaagatcacaagcaaagctacagatgctgctgctggacctcctgacctgagaacatttgcttatgcaccaacaagatctaccaccagccgttttgatcagagtgaaaacacgcgcaaagctatgtgcactgcggacagccctcctgatattagcacattcgaatataaacccatgaaaagcgccgtcagacgttcagatgggagcaagttttcaggtgcagcactaaaagcagctagacgaacctct

SEQ ID NO: 31384 - DNA, 767 bp, Oryza sativa
atgcactctttttcctttctagggttttctcacgaggtgtgagtttttacctagaaaggtttttaatgaggcaccattgcactacacagctactattatttttgaaagtgtttgtgactgatcacttgagtttgaactgtgatttgtgaactgttagacttagtatttgaaagtgttttgtgattgtggatttgtgacttgagttgtgaactgtgagacttagaagttgagttagtgaattgaattgtcatactgcacatactatataacttgtgaattgtgatattgtaatctgagacttgtgatattgtgatctgttaacttgtgaattggatggttttgtgctgatttttgtgatggacatggcattttcgatatgtatgtgcaaaactgaagtgaacaagtggcagttagtgtttggcgtgcctgggctggcccgggcacggtgggctcagcgtgccgtcgggccgacacgacccggcacgactgctgtcgggccgtgcctgggcctgaggttcagcccgtgggcaggcacggcatggcacgaagtgccaggcgtgccgtgccggcccgatcgcctcgggccgtgcctaggccgggcctgggccgggccgtgccgggtgggccatatggccatctatatgcacaccctttctcccctcccgtgcctgaaggcacgggtatgtgacaaatgaggtgccggatcggtatagcggaggcggtacgtcggcgacgcggcgtcgctgggcagggagtagcctcgtgcc

SEQ ID NO: 31385 - DNA, 541 bp, Oryza sativa
tctcagcagtgtgcttcacatcaatcagcaccaaacccaaaatccttttctctaattgccaatcagaattaacaaaatgagcaacaacacttaaataatcctccttagcattaccagaccatatatcagatgtcaaagcaacagagttaacagacttgaacctctcaataagcatagcacgactcttgtcaaagtacttaaaaacatctctactaatagtttgcctagagacagcttggaatctagggttatgaacattctgaatgtactcctcaaaagtaggagattgaccaaaattcagtggtagatcctctacagcaatcaatttaaccaactcagttctagcataatcaggatcatattcccatggacgaacagtaccatcagcattgagcttaagcatagactgtgacaaattactagcagttctaggtttgccatgacttgagatgcctaagcaaatgaccagtgccaccagatgaatgagcagacaaagttttttttgcagtgattgcatttagcagaaatgcgaaccttcgcg

SEQ ID NO: 31386 - DNA, 1066 bp, Oryza sativa
ctgagggatgggggtagcacgcgccattgcaccagctgcaagcgagcacagcgtgcgaatggcaaccggcaattgccgcgaaaggctcacgccgattcgagaatcaggagggggcgcgttacgttctactgatccctagctcgctgcagacgacgacgcggccggtcaccacccgttgctcgaattggccctctctccccttactcgcttgtattttggtgagcttatgtttatgctaggtatagcagagaggtgccattcctggttgatctgatccgctcggcacgaaacttcgacgcaagtccatcctctggtggcttagcagagttaccatttcttcatgggccattattggcgcttttcccgttccgagtattgctagcaatagcttgcgttgcacatgtcagtggcaaaaggaaaacttgcctgttgagaggcaatatcgctgaagccacgcctctcgatcgaatcgaaaccatccaaagaacaaggcgattagagattcaaattttaaatagaaattcaaaatttgaaaatccgtttttttcttcaaaattttatactcaaatttgcaaaacccaaatcacaataagaaactttaagcgctctgcattgaaagcttaaaaaaactattcccaaatttaaaacatttaactcaaattttgaaattttcaactaaaaattaaaaaacatctacccggatctgaaaaactttcaaattctgaaatgcccaactaaaaatttaacttttattgaaaaaacaaaaaactctacccaagatttaaaacttccagcacaaattttataactttcaaccctatcatttaggtatttcattatacgcgttggcataaactgaaagaaaagactgttgttaggcttgtattgtgtcgtctagttgcaactctcatgtgtacaagaagggcgaagacgacttctattgctagcccaacggtgccaactagctgctccgcatcagggtttacaaaaccaatgaattcgattggattttgctaaaaaccaacgtttctacgtgactcggcaatagttctcctctaaatcgatg

SEQ ID NO: 31387 - DNA, 2911 bp, Oryza sativa
tactattcatgacctgtaagttcaagtgtcttaatttagttttggtgattaatgacaaatctaataatatgagactaacgtttttatgagcttctctttaactagtctcgtttagatatgaaaataaaaatgatgagaggtatgtattaaacttcacatattctaacttggtctctcttgtggatccaaaatatagtgtgagctccgtcattaatcttgattgattatgtgcatatgtattcctttatatccatatgtatgcacatcttgagggggagcttattatatattttgtttattataagatctctaccttgatttgaaatcatctttcatcccatctctctatattgtttatatcgggttattatctatcaccaaaaagagaaaagattgaaagatcttggattaaacaatttgtgtaattgttgctttgatgatagatgataaaccgatgtttatgggattaacctctctttttcataagttgttaactaggttatttcccgatgatgagatgtggtagatatgcattctttagtgatggaccttaatcatgataaggatgaaatgcatggagataaaacgatatgtaccacttcttatctcctactttttgataggttcatatatatgatttccatgttattgttatataagtgtgagactaatgtttactcgagtcgtatcttatttagtctcatttacattaagaacatggagatcatgaatgtatatgttttatgttggtctacatctttactacatatgccttctctatgtgtataggataaacccccattggtcattctctaattatgcatacacttgcatctcttgtatatttatttgtatgcatatatttagggggggcaaatcctatacatttattgtgcatgttctagatccatgttattcacctattatttatatcggatctttgcacttaaggttgcatacgagtatatgacacttgtgatgttaatgaatactcaagaaacatatccatatctttcatatgcaaccggttggtcatcaagtgaaggatgacaaccgatttgttgagactaatgttctcctttgagatgtgaaaaggaataggtcccactatgatgaggctgatggatgacaccatgggttaatggtcaccaagccaaggacatcgccatgttggtaagaatgaaatcaagcttgtaatgagaagaaagtcttgacaaatgatggtaaataccttggtataaacatggttgaatcaaatggtcacaagtgttgatctcgactcaagcttgaccccaagatggattttgcaaggcaaaggtataatgtagctaagaatgttttcttagccttttcccggtcttgatgtttggtgtagaccggatttgctagataggcgccgtactatcaagaggggtctatgaagcgagcttgtggatgatcttgtgccttattagttcatatgcatgtaggtgtatttggtgggcttgtctagccaagtgtggtgagttttctcaagtcctaaacaaagagatatgtgggcaaatcctataggtttgggtagcctcatgtggttatgtccggtggagtatcctttggagtgtgagccctttctccctgagaaaatttgtgtttcttggatggattgttcatgggttggatagccctttgaataagctttccataaagtccaagaacgccaaattccgagacccgagtcaagagatatcgtcgttttactaacggtcggttgagctgaaaagtgaattgcggtatgaccgtgggccttaagccggtctgaccggccccacaggtctggtttttggtggcgatacagagccgccagagccgcaaccagtcagaccgagccgacggcggtctgaccgagccgtggacggtctgaccggccactacactgtggtcagaccgaccaggttgagtaggctcaatgattgccctgtacgggctagtttcttagccgttacaaagtagtccggtctgaccagcctcacacagcgggtctgaccgacagagcacagagttggggatttcggttccaacggctagttttggtggttgggggtatatatatacccactccccagcagcaagggtaaagttttggcactccattgcattatcttgaacccttgcaagagctctcacacccttgtgcacttagtttttctagtgaggtgttagagagtgagttaagccaatccaagtgcattgcttcattgttatagctagtgtggcacttgatcatcctcggcaagcatcctagacttgttactcttggaggttgccgcctcctagacggcttgtgtaggtgttgcccggtgacctctccgaggagattgtggaggaggcccggcgccgtttgtgagttgtttggagttcaccaccttcggagtgaaggaagaactaccccgagtgatcgaggcttgggtagtcctctccgtgggccagctcccgccttgcccaccccttgacaaaggaggcgtgcggtggcttcgtggttgagcggtggagttgggctcgcctcaacagggattaggaaaccggcgagtttccgaacctcagtgaaaaattccttgtctattggctcatttatttgttgcatttacatttgtgctatttacattcatagagacatatttgagcctatatcacctaggtttacaaaacttaacttagttgcttagttaaccttgcaccttaccttgcctagcaacttaggttagttttgcttaagtgccattaagttttaaaaccgcctattcaccccccctctagtcggcctccttgatcctacataacccctatgtacgagcaacactaacgcgtactatgattctaaggtcctgtttgatacagctccaacttctaaatttagctccaagagttgagtctg

SEQ ID NO: 31388 - DNA, 777 bp, Oryza sativa
gtttaggatattgaagtcatcgtcgaattggttgacagtgtcactatcaagataggcagacaactcagaggcattcaagttagcattagaagaaccagcttgaatcaaagcagtagcagaagttctcctgaaaaatggaccagcaccaagtccagaacctggactggcactagcaccaagtccagcaccaagtccagaacctggactggcaccagcaccatgtccaagtgcatcactggcaccaaaaatctttccccaggctatctttttcttaccagcagtacaacctggggttattctttgcaatctcacagcaccaaacttactttcatactaagagaaaatgtcagacaatgcagccctaacctcagttaaataagtagagtaatcagaggtcaaaatttgtgacataatttgtagaacattgctaaaacctctgatcttagccctaggatccaagataaaagcaaatgaatacagaaatggaatctcagaccagtatgccaagaacttacttttcatgggaacaacaacatttctaaagttattatcattctcataagtgttaagatgtccagcaatctcaagaatgtgatgcataattaatggagatgttggataataaacaccagacaaaataacagttgaatcataaaattgttcaaggaataaaagcacagtttcaacaattgtccagtgcaaatcagtaagcaatagtctaccattttccctaggataatgagtttcaataaacaatgaaaaaagctccttatgtgg

SEQ ID NO: 31389 - DNA, 2288 bp, Oryza sativa
ctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtactttacctcctactgctgcacatcacatgaaattaatttggatattatcttttttcctagggttctattaatgttgaagatatcatcttatcttaaaagttcatttgaagaggtcaatagaacttagaaggcatcgtgctgattttggaagcagatgatgatctacttttgtatcatgaaagcttttgtaacggggttaatctagcagtagcatagctagttgattttgaaagcttttgtgccagtggatgcatgatacccaatttcagcgaaaatagttagggtgtgtttagttcgcgaaaagaaaatttttgggtgtcatatcggacgtttgaccagatgtcggaaggagttttcggacacgaatgaaaaaactcaaattttataactcacctggaaaccgcgagacggatttattaagcctaattaatccgtgattagcacatatgggttactgtagcactttatagctatcatgtactccatccggttccatattattttacgttttagataaggccgaggccaaacttttataactttgaccatcaataattttaaaaatatttagtttaaaggacaacgtatatatatatttgtctttcaaagcactataataaaagtaaatatgcatttatttattttatatgttataatagaaaaataaggtcaaagatatattttgtataccgtgtcattaaaatgaaaccggagggagtactaattaggctcaaaagattcgtctcacattttctatgcaaattgtgcaattagtttttttatttatctatatttaatgctccatacatgtttacaaagattcgatgtgatgtttttggaaaaaatattttgggaactaaacaagggcttaaactctagctcattttgtcaattatgcgtgcaagatattatgaagttcaatataatgaaatgaagtatgtgtctagttttctttaa

SEQ ID NO: 31390 - DNA, 3157 bp, Oryza sativa
aaatcgtccaggactgcaatagtggccagtggcacgccggccattaccacgctatgcgaatgacatgcatgcgcgcgcccgagctagctcactgctcttgctcttgcttgagtttggacgagcggggactactgactgaagccctcctccctccctcctgtacacacgccctctccgtgttgcaatgcaaggccgaatcgccgtgcgtgaagtgtctcgtcgcgcgtggtggcggcttcaggcaccgggacgggcgagcggttttgccgtgcgctccaggaagagaggagcctctctcattgacaccgttgtgtggtgtgggcgaccaggcgtgcggcgtgcccatgagtccttgatggagactccactgtttcgttaagcaatcgagaatccacgcttggcggcttggcatcttgcagatgtcgcgatccgaaatctcgcatacggatgatagagctccaatcggaggagcgcgctctatcaatagaatcctcacggtgacaacagtaatcgccaatccggaccaggcaatgaacagcacgcttcaccatacgtgagtaccccgaaacacaggttatacaaatacagtactttacgggttaacaaatagtagtataaatgagggcctggggcgcgcacaagaaattttgatgagaattcaccatcagatattcgcatgtggcctgcagccgagaataacccaatacagaaacaaaaagaatggtattttgtatgattttttttcttcgttttccttgcaactcagcattatattctcaagtcacaaccgttacatgaatacaataaacgcataacacgtagactaactcggtggaggcagccctggatccatacatagtagtactagctaatcgttactgtgttctcggcgctatatcttgttccatcaagtgatgcgactcaagataagcaagaatgtggtttctctccatgggctcttcaagttttgtacctttctggtcctgtaacttcagcaagagccgtggatacagcattggctagtaatggagggaactaatcagccatgcgcctacttatttgacatagatgagtccataacgctgcatgacttgtccatgaactgcacaaggaatgtacgatatagtaactacaccataaaaatcatgtctgttctaaacaaactaggcgtgataagttatcattctaatggagcagtagaaggtaattataaactaatgccaatgtagtcctaaacagatcttaggagacaaaaccatattttacatttgcatttcgactagcagatagttgtacaaaaatgttatgtatctgctctggcaattatggttcaggagaccaccatttagtttgtaggaaatgacaacagaccactactgaaagaaagaaagaaagaaagaagtgaacatatatgtggtgttattaaccatgatcactagaaagcatgaagaacgttctatcatgactttatttgggtctattgccttcaacctgccattgaaatgttaggaatcccagggcatacatgggtggactcttctggtcacaatatacaggtcattggaagcaagtgcatgttacccagcagcactaatgttgaaagtgaaaaaaggcaacaggcttggatgactttaagagtgtctacaggaagtcctacggataggatagcaaacacaacgcctatctttctccgggacattgtaatttccaaacaggtcttaaggatggctaaagactgattaagtattactagcacacaaggcttgagttggtttcaagtactttatacttcaaaccaatcgtgcagctgcaacagaacaacagatggaaagcctcaagcttgcattacctttttcatggaatgtagttcccgtccaaatggctccaggaacttcatctctatatcaaggggccaaacctacatagaaatgacaaaaaggataaatttaagactgaaaaatttgggtgtttcacagttcacaatatttcatactagccatgttaattggctggggttttcattcacttcagttgacaatttgtgatatcatttactattgtagtaattcaatctagtggtgctgtgtccaaatagtgagcatgcaaagaccgcaacgcatacatgcacagaaatcaattactgcaagtaaatacagagattgaaaagacatgatttattgaagtactcaaacaccataatgtgcaaggtacataatttattctcaagcttttaagcaattcatgatattctacttaaacaaaggaaaaagttttgagctatattatgcctagcaatggcaaactttcataatgaataccacgagagcacgaaatgaatagtaccacagcatcagagtagcctcaaaggctcaaccttaacctagtatcccttgtatttcctattttttgacaaaagataaagctgaaacactattggacaacacgaaaaatataatacaaatcattgctgcgcaattgcgtaactgtttaatcgactatccctaatcccatggataaaattttgttttctgtaatttgtatgactacgaaattgacaaaaccaacccactaaacctggcaattaacaagcatagcccaatgaatatttaatgatcaagaaaagctcaaaccaatcacaggcaccgcgcaccgaattaccaaccataaagcataattgagcgagcctcaggcaccaagcaccgaattaccaaccataacaaaactatccaaccaagatacatgattaacccaaaatcaggcatacatcccctcacaagtaacatctaataacgttcaatttaactaagggctatatcgatcacatgtgcgtaacgattggattgcaaaaatacactgcgatcgagagatcggttcgtaccttgaggcccagcagccgcagcggcgcctgctgcccgggcacgatgcactccggcccggccgcctccaccatagcctccatggccaacccctcccctatcggatccggatgctgcaaagcaagcccagaattagaattacccccttcccccaccaaccaaaccgaaccgagaaaagggaacgcaccttcatgacggcgagggcgtaggcggaataatcgtcctgcgcgacgcggaggacgggggcgtggtggatgcgcgggacggggcggatccccgcg

SEQ ID NO: 31391 - DNA, 5408 bp, Oryza sativa
  unsure (1)..(5408): unsure at all n locations
ctttgcgtgtccgagttaaccaatgggatgtcaagacggctatgggactgtttagtggatgaaataaaaatttttaaatgtcacatcatacgtttgaccggatgttggtaggggtttcagatacgaatgaaaaaactaatttcataattcgtctggaaacgcaggatgaatctttcgagcctaattaaaccatcattagcacatacgggttattgtagcaattatggctaatcctggactaattagactcaaaagattcgtctcgtgatttacatacaaattgagcaattaatttttctttttatttatatttaatgctttatatatgtgttaaatattcgatgtgatgtttttacaaaaagtttatgggaactaaataaggcatatgtttcttaatccagaaaggtgagccgagggtggttgaggctgcttgtatttgatctgaaagggggaaatatgggttttactagcagttgtcaattcccgtagaaaagttaagatagccacttgtttatctctattttacgagctcagacattctctttttagcattttattatacaatgatttaatttgcttgatttcatgattcaccgtactattgtcttatttaattaaaaatcacgtggacgggttgtatagtgctattgatgaataatagggtgaggggacacggtgtaaattcggtgctcatgtgggggtttaatttttttcctctaataaccttgatttcctataaatttaaaattaatcatttttaatggaagttgcttttgacttattagcttgtttccggtaattataacaaatggtaaaaaaaacaatggcatggcaaaagatcatattaaatttgtttccacccccgaacattataaaactatcgtagccttttgttttataggcatacctgatgttgaagttaggaactaatctctcgcgcacgcaagaacggaacgactcattagcgtatgattaattaaatattatctatttttaaaaaatattaatatatatttttttaaaacaactttcttgtaggattttttttttaaaaaaagtatcatttagtagtgtgggatgcatacgtatgaaaaaaaatgaggtgggttgggaacctcaagcaaagaactcagcctataggaccaatgaacttgacctaccaagcattttctatcctatgcataccaactactatataaacttttctcaaaaaaaaaaagaacccttgtatagaaaatagacgatataacggcaattgatctttattttctctgaccgggagtaatattcaatcactggaaggttacagacttgcaatcatactatgcggcaaacattgccatgcaaactattggacttgtttagttaacattgccatatacgggtcttgtttagttgtttggtaggccatgtttgaaacattttttttgcgcagattattgagatggattgtccacttcattaacatgataaatttatattttatttagaaatgaaactcacaaatggtttagaataagtggtctaaacaagataaaatatttttaataaaacatatttttagaagtataaagcaaataatccatggtaataaaaaaagtaaataagacacatggccatttcataatttattcccacttgacaaggccggcatcgcttggttgattagatctcaaactgcgctcataagtatcacgtaggatgaagatcatgtcaaacacctccacgtagtctccacgttcagaaccaccgggagaaaaattgtacatgttttaatagttggaaagtcaacatatcttatatcgtggttaaacgagatgaataagattcggctactagttaggcactcaaagtaaacttattcctattgtgtgagctataacaatgttgtggttttagcccatgtgaagactcgagaccacatgtagtagcgtctttgttgtacgtgctgttgatggttaccgcacacgagtgacgtggagaaaaatgtccttcgtgaaccctagactcttgtccccaaaagttaaattggatctgattgatttgtttaaggaaaccacccgcccatgaaggtccagcccggttacccactaattaggtccgtcactaaatatgaaaagcactcatggctatgcctatatattgaggggaggaggtgctattgtattgcacaagttaatgaataaataagaagagtcttacctctacatctttgtgtctccaattctggtagaattatgcaatctctcttagactaacttggtagaggaggggtggcacaataatttagttctcctatgtccttgtttagttgctaatttttcctaaaaggtcacatcaaatctttggacatatgcatggagcattaaatatagataaaaaaactaattgcatagtttgcatagaaatcagaattagtgttaatgatgaatagctaaatattatagaaacctataagtgttaatgatgaataaataaggtttaataaattcgtctcgtggttttcagatgagttataaaattagttttttttaagtcaaaaaccccgtcccacattcggttcctccctgcgattggatctgttatccttcgcttgtccatggacatggctgccccgactgttccctacaggaccacggctcctccccttccagagtccaacggccatgaagacggctcatcagggggcatggtcctcctcgacaggtggtgcctcatcgctgacctgcccaacgccagcaccggcgtgggcaccacgagcaccggcttgcgcatccaggggaccttccaccccgcccgcccgccgcttctctcccgcttctgcgtccactgccccggcctcgacttccgccgcgtggtgcctaagatcatcgcctccgacgccgatctcgtcctcctctgcgtccccgtcaaccccgacagcatcgccaacgcacgaggtttggactactttgtctacaggccgcgcgcccatcggctagatctgctcccgaacccgcaccccgtgtacctccacgactctatgactgccctcctcagccgccaagacggcgcctggtatgcagtcgccgccctgggtcttggccccccggtgtacaaaggcggtgcgcccgttagctgggatttctacctccacctctacagatccacctccagttccaaaggttggacctccaagcggttatcggtgaccgagttcatcagagacaagtttatccctatacctgcctctgtcgacaggctgtaccacgagacaggaaaaaccatcacggtcgccggcgagggtggcaccgtcgcctgggtggacctctggcgtggcatcttcctttgcgacgtgctcgatgagttccntgcgctccgggacatccatctgccgtgcctagcgaggagcacaagggatctctcttgatacaatatgacccagctatttcggnatgtgacatcagcgaaacagagactctatcaagtatattgagatgaaaatgtggtcaccaaaagagccgatgaataccaccagcactcctgtttcttatgtggattgcgtgctcaataacacaaggaaatcccaggtaatctgtgacgactgnaaggccacaacatggagcatgccaatgccggtgattggttcttggtgcgagcactggcaccgtgactgtgaggttggtgttaaagacatcaccttgggggccagcaacccatgtcgttctaacttgagcttcagctagatcgtggaaatgttcaaggaacttccaatggtaaaccccaccataagcatggatgatgatgttgttttcttgctttctagaaccagtcccagtcccatggacaagttgcatttggtgtttgctattgatgtgaggaagaggacgctgcaaggattaaccaagcttgatgtccagccgcagaactccgtttgcatggtcaccttatgcaccagtgagatttgcaggtatctgaggaatattacaggtaacttctctacactggcaattcatcaccttgtgtttttacatgtgaccatatgtatgaatgcaatgcttgccatttttaagatctagggaattattgtttttgtacctttcttgtttcggtagggtctagagctaaattcaggaggcatgccttgtcgccttgatgacagtgtgatgcatggaagactattgatatcagttgttttgtacattgttgtcaaagttatatatcagttaattaaacaaatcatggcaattcaatagaaataagtttgtgaattgtgttgagctgaatctgtgtttgtgcgcaacccatcctttaaaatgacagcaaaactattatggtactattagataattccacagcttagttttcttttattgtggtggaattctgtcaagttggtagtgaacagtactttcaaaacaaatgctcgttgattgagtgaattgcaagcttggctcaacattttagtggcagaagatacgcagccaagaaattgtgttcagcgtgttcttgccataagcggcattttatggtacatgatattggggttttgcgtttatgatagaaaaagtccgtctggattttaacttcaataataatatattcgacgaaagcaacctggatactagtaattgtttcttgctttaaacgcctgtctttctttgtgctagttactgacaatcatgacttgttcttgttgattgaaaaatgcaattattgctgtttcttgttgattttctttggtgcagtcacaggcgaagcacttaatgaactggaaattagctcttaaattggccaggacaaagaagcgtgtcagatgatgcaacttgagcttgttgatttatgaaaattggccgtgtttagtttcacgcccaattttttttatacggacacacatttgaaatattaaacgtagtctaataataaaacaaattacataatcatccgcctataaaatgcgagacgaatctattaagtctaattaatccgtcattagcaaatgtttactgtagcaccacattgtcaaatcatggcataattaggctcaaaagattcgtctcgcaatttacatgtaaactgtgcaattgttttttttttcgtccacatttaatgctctgtgcatgtgtccaaatatttgatgtgacggaatttttgaaagtttaaaagtaagtaagtgtttggttgcaaggatgggatgggatgggatgaacccacttttagaggtgttttgttgagaggtgagtgggatgggatggtccctggagaggaatattcctcttagatccgtgacgagatggtccgccgaaatcggccggaccaatccatcccacttcgacggacagaacggcgtcaactcccgcagcctcccgctcggctctgccgcggcgccgccacggccgctcgtccctcatcccactgctccctccccc

SEQ ID NO: 31392 - DNA, 2353 bp, Oryza sativa
cccaaaaaactgggatgggtctagcccatcccacttggtcccaaaccaaacacaccctaactaaacacggccattgtgtaaaacaattatctggagggtgtagcttgcaacatgcggacatacgtactttatttatgattgaacttgtgtgcctatatctcagctagtagaagctgttgagtggtcaaagtgttgaggctgcttgtatttgatctgaaaggggaaatatgggttttactagtactagttgtcaattcccgcagaaaagttaagatagggtgtgtttagatctagggtaaaattttttgccgtgtcacatcagatatatggacacacatttgaaatattaaacgtagtctaataaaaaaactaattacataatccatcagtaaaccagaagacgaatttattaagcctaattaatccgtcattagcaaatgtttattgtagcaccacattgtcaaatcatgaaacaattaggcttaaaaaatttgtctcgcaaattagtcacaaaccgtgcaattagttattttttatcctatatttaatacttcatacaggtgttcaaacgttcaatgtgatgaggtgtaaaattttaggatgggatctaaacacccccataggccttgtttaaatcagtgttgtggaaaacggtgttaatggccgttaatacgtccgataatacgaatacggagatcagaccgtcacatcacgtcgatgcggtcataattagtcggtaacgaacgcataaatccgatcattaccgattaaatcgtccatctccgtctaatcaaccgtataatcgtcggcgtgatgatggttgttagctgtgccctttactactactgactacaagctcttccgaaattttcacaaggcaacaagatgtaaaatgacaaggaactgacttcctctaaagtttgaacatgggttccttgattttgatgataatcacgttattggagtttgtatttgatgaagctcttcgaggtaaccgatacatatgttatttgggaccttgattacggtcatctatgctatgtaacattctcttgattatcatttcaagcattatgaacaaaacccattactacgtgagaattgagatatacagtaacagctatccattatgaacttatttaaatgtcatacatggttattctatttaaggatatatagaaggaatatatttagttatatgcatttgtttatcaaaaagggaaaactattatcaactatgtacatatattttcaaaacgttatatttccgccaaattccgattaatcgtttggcggtaccctctccgtccgatatccgtataccgtcttccacaacactggtttaaatcccaccccaaattttttcaccctgtcatatggaacgtttgaacacctgcatgaagtattaaatataggctaaaaaataactaattgcacatattacgactaatttgcgagacaaatcttctaagcttaattgctccatgatttgacaaatatggtgctacagcaaacattcgctaatgacggattaattaggcttaataaattcgtctcatagtttacatgcggattctataatttgttttgttattagacaacgtttgatacttcaaatgtgtatccgtatatctaatgtgacatgccaaaactttataccctggatctaagcaccccatagtagggttgaaactggttcggatagtttccgtccgcccggaccttttttcggattcggacagtttcggtcggaactatccggaaattctcggattcggaaacgaattcggattttttttctcggaaacgaaaacgaatacggtaagggtactatccgtcggaatcggaaaacggtcggaaactatccgtattttttttcggatatccgcacacattgagcaaattttagaaaaaataagtgtatatatatatatataaataactttttcatacgaaatcagatgaagacaaactttatatcaacattgtagagctcgatgagatctacaactttcttattgactattttattatttgaggtcatttaagggtctaaatattcattataatataccatattaatttttacaaaatctcagatctacaattcaaacgacatctgatggagatgtgttccatatcaaagttatagagctcaacgggatctactactttgtagtttataacatttgtatttgaaagcatttaaagtataaaacaaatattacaagtttcgaagatgtgaagtaaaataaataacatctccaatttataaagggtaaataagttatatatctagtaaaaggtcttggggaatagaaaatgataatcatatttgcatatggatctctta

SEQ ID NO: 31393 - DNA, 3646 bp, Oryza sativa
atattcgctccgtatctatattcgataatattcgatttcatttccgtatccgagttttcgattccgattctgattccgaaaaaaaatatgaaaacgaatatgataaagctagtttccgtccgtttccgatccgttttcatgcctaccccatagtcacttgtttatctctatttacaagctcagacattccctttttagcattttattatactatgatttgatttgcttgatttcatgattcatcgtactattgtcttatttaattaaaaatcatgtactccctttgtccatgaaaaaccaacctaatactggatgtgacatatcctaatacaatgaatctagacatacctctgtccagattcgttgtactagaatatgtcatatccagtactagattcgtttttttcgagacgaagggagtagacagattctatactgctttgggatatgtatgcgtgaaaaagaatgaggtgagttaggaacctcaaggaaagaactcagcctaaaggaccaatgatatttgacctaccaagcatttcctatcctatgcataccaactgctatatgggtgtgttcggtggtgggtgttgggaacccatcacacacacggaaaacggagcgatctattagtgcctaattatttaaatattagcttttttaaaaaaaattgtatatatatgatttttttaagcaactttcgtatataatatttttgaaaaaaaacacaccgtttactaatttgaaaagcgtgcgtgcggaaaacgaaagggaggagttgggaactcctgtatcaaacacagcatataaacttttctaaaaaaaaaaagaactactgtatagacaatagacgatataacggcaattgatctttattttgtctgaccaggagtaatattcgttcaatgcaaggttacagacttgcaatcatactatgcggcaaacattgccatgcaaactattggacttgtttagttaacattgccatatacgggtcttgtttagttgtttggtgggccatgtttgaaacaattttttgcgcagattattcagatggattgtccacttcattaacacgaaacatttatattttatttagaaatgaaactcacaaatagattagaataagtggtctaaacaaatacactatataaaatatttttaataaagcatatttttattagaagtataaagcaaataacctgtgataataaaaaaaagtaaataagacacatggccatttcatattttatccccacttgacaaggccggcatcgtttggttgattagacctcagactgggcccaataagagttttgacctgggcttagtcagaagtgaatcaggcttttttctggttaggacatgctttgtctatttgtcaccccccatgcatgagtcaaggctgtcaagcacaactgcctaatgcaagtattgcatggataccatgtactactacttcttctaccactgagtatgtagataatgatcatgcagaggtatcacttaacaatgaaggtgcttaagtcttaagttgtcaaccaaagtgacttaaactatcaacattacaagaatatttcaaatagacctatggactactatgcatcaagcattcacaacagtctaactatgtacctccatcctaaaaaataaacaaatataatatgggacgtgatacatcttgttctagatttgtttaatttaagccaagaaaatatggacatttagcaactttgctaacgccgtgtttagttccaaaatatttcttcaaacttcaaacttcttcatcacataaaaactttcatacatacataaacttttaacttttccgttacatcgttctaatttcaatcaaacttccaattttaacgttaagggggtgtttggttgattgcttcactttgccatgccacacttcagtcatgccacagtttctaggcgtgtgtttgttttaatgccacaattgtgtcatgccacactttcctacccttaggtcccacatgtcatattcagataactagagctaacattgccacacttgtgattaactatttcttggccatacttttgccacatgccacaacttacctaagcttagttatgataagcttacgcatcaaccaaacaacccctaaatacaacctaaacccacgggccacaactcgcaacaattatctcacaagatcactcccagaacccggtgtactgtttgtcgggtctctgacttactgggcccaccctctgacgacccctcggtccacctgcacccaccgctctcagtcacctcctctacccaactcaaacgaacgtgcatctcctagtacacacagtctcctccctacctcctcctcaatcccgatcgcttccttcctggatctcgccgcgagctccaaggtctaggcggcgatgcctgccgcggcagtctccggcggcggcgcggccgacgccgaggagctgttccgcacgagacgcatcccggagatccgcgcggcggagggcgccacgcgccgcgagatctccgccaaggaggaggagctccgccagctcgtcggccgcagctaccgcgacctcctcgactccgcggactcgatactcctcatcaagcagtcctccgacgccgtctccggcaacctctcccgcatctccgactccctcgcgtcgctcgcgccgccccccgaggctccccccgccgcatcgccctccccgtccggcgggcgggtccggctctacgcgtcggcggcgcgcgccaagtacctcgtcgacacccccgagcacatctgggggcggctcgacgagggcctgctcctggaggccgcggggcggtacgtgcgggcgcaggtggtgcacggcgtgctctcccgcgacgccgcggcggccgcgcggttcccgctgctcgcgcaccaggcgcagctggtggaggcgttccggccccagatcgcgcagcgcgctcgcgagcgcctcgccgaccgccgcctctccgtcgccgcccacgccgacgcgctcgcggccgctgcctcaatcgacgcaccgtcgctcaccccgacccaggcactccaactcttcctctcctcccgccgcgcctggatctcccaagccctaaccacccttgcctccgatctgacctcctactcctccgtgctgtgcgatgtcgccaagatcgtgcgtgtcacgctgggccatgtcgggcagttgtttgtgcttgcgctcaatgatttgccactgtttttcaagacggtgctcgatttgccgcccccttcacagctgttcggtggcattccagaccctgtggaagagacacggttgtggaaagaacactgggatcaacttgaggccaccatggtgctacttgagccagatgctgttgcaaggacttgtacagattggctgaagggatgctgtgatgagatttttggtgtgattgctggagggcaaagactagttgatgccattgagagtggggaagggcttggatcagtgcaaagacttgtgcgggaggcattagatgggagggaaggactggaagggactctgaagcaatggctgaagagtgtgtttggatcagagattgaatcaccatgggatcagatccgtggcctcatcttgaaggaagggaaggacatttttgaggattggatggaagaagcctttg

SEQ ID NO: 31394 - DNA, 18100 bp, Oryza sativa
atactgaatggattggaagctgagcttggaaaattgtctgcttccttgagaaccaaaaaaggggagagcaatatgcttgcagcatctgttatcggggagagatctctcttcattggccgcctcatgtttgcattgagataccactcgagtcatgtacccttgatcctaggatccccaaggcagtgggtaaaggaggctggtggtgcagcatttatgagattatcgtcgccctcaccaagacattcaagagcatcgtttgatacagcgatgccttttacccccaggaggcacacacagtcaagcccaaggagtcctggaaggcaattttctgacaaccccagaagacaaactattgctgctgctgcttccctatttggtgctgatgatagctccaatcccagacttgatgaactaaacaagaccttacaggcactctgcattgcagcccatggattgtggatagcatggttgtccactgaattatcacagcttctctcatatgacctcaacaaagatgattcattgtccttatcaacccctttacgggtacgctccatgtccctcttatctttccaattgttatctttccaacccctttacgggtaaaaggcattctaagtatatttcttactgctgtttctgattctgtccatgttattcatactatcaatcggggatgcttttgtttgctaggtaacaaagacatctgctatatacagcaatattagtaacataatgatgaaatctgtaataattttggatcatgttggacatgactgagcagctagaagacatttctcttttattaagtgcccttatgatttacaaagaacttgttgaataaaatcgtgggcctgtagagtttgtttttgcctattggaatgccaattttgaagttatctattataggatattcgatagagctatacttactggctcaccttttctagggttgaccaagcagctaaccccaagttttgattctagtttttgtgcttcgatttttgtctatattcaaatattaaattctgactatgtgtttcaacgttgatttctagtcctatcatgctattttaatgccaaaataaacatggcatgctgattgtcatagacatgatatatgtgccttgtcagggatgggaagtcacagtcatcaaacaagaggaatccactgagggccccttggagatgcaaatagcacttccatcaatgccttcactgtacattatatcctttctttatcaagcatgtttggagattcataaaattggagggcacatcctggacaaatctatattgcaaaactttgcatgggacttgttacagaaggtaatgttctttcatgacaaccttttcttctttgagggggtgacgagaagtaattgtggtgcatgttataggctaaaacattggcctggaacttctagcaaagaatggaagaaccaaagaatgttttatcatgctatctgcatgaaacacaactagctatagttcactttcatgtgtttttgcctttgtataaatttgaccataccgtaatgatgatcaacaatagatactacgagggaaccatttgtttatgttatatgtgcaatagttgctattggcaaaatgtaatgactgttctacaattcattactactatgattgatagtaattatagagttataagttaatcaagcttttcagcttttgttgtttttcttataatcaagcattgattaagctgggcactatagtcttcagtttacctgcacacgcctacaaaaattaataccgtgccctaataatataatgtcatggaccttattaacctgaatgcctcgcccttccaactgtcatcaatatttcaattttgagaacctccgaggaactagctgttgtatgtgttgctttattaacaattatctgttttgtctacctgcattgatgaagattaggagaaaatgttcagtgtatgatttaaaagccaatataatcactgaacctaacagctacttaaattcgtgcaggttattgatatctatgaaagctttttggtatcaatcgagtctggtaaatctctggtttcagaaaagggggttctgcaaatactgctcgatttgcgcttcattggcgatgttctgtcaggaggcaaaagttcttccaccaaaactactgaaacacagagaacacatgactcttcgccaagcgccattgctaagacttccttcaggagaaaacagtcacaattgcaggcagattcagctaccatagagcctataaacaagctgatcaataagttctcacagagattggatccgatagactgggctacgtaagcactatcctctgttttactttgttatacatatcaccacataattcaatagctgaatgcatgatcaatagtctttatagacaaaaacccatgctccatatttgtccatgatgaagcatttgcttattttgaaacaggtacgaaccttatctgtgggagaatgagaagcaatcttacaagcgctatgttgttcttttcggcttcttggttcaactgaatcacatgtatactggaactgtgcaaaagttaccgactaaatcaaatacagattcaaacattatgaggtgctcccaagtcccaagattcaaatacctaccgatcaggtaaataattcttcagactgagtacacatacattttatcgtcgtataatgcatatttctgtaattaatccattaaggtcattagttttagacagctatagtgtttaaattcatgcttaaaatacttgatgagatgatattattggacagccatatgtgatgttttttagcctggtgtgaaagttgattttcaaagaaacctttgtaagtagcgttggctggttctgatgaaaaattacactagtttgtagatctaataggtctcatgttcatatgtttcacttgtagtgccccagctctatcatcaagagcacacaaatcatcattacagtcaacatccgatgattccacatctagaagcccttggaaatcatattcaaatggagaaagatctacggcatcagaatttgatgataatgttagccttggaggtgctgctccattgctcaagtcatttgttacccaggtgagtaacctactgcatatttttagtttactagtaatagtgcacgtgcaaggcacattcttgcaagggcatgttcatacatacactgagttcagaaacatggcaagggtatgtccaacactaaattcagatgcattccatatccacgttcagacaataatatggatcttacctggcaatccaagccggttaagtatgaacttatataatatgaattcagtatgaacttgcagatatccaatcctaaccatgaatggtaataggagtatattgtttacacaaattgcaatgaccatggtcagacactaaactcaggaaaacctctgcatcctttggtgaatttgtgaagttataatacttgagctacaagaatccataacattaatcagctcacagcattattaaaacattgaacatcatttagatgcttgtccaagttcagattctgaattcagatactcctacaccacaagggcaagccagaaactaatgtgccaaatgctcagacaataatataggaaatgttcaaacactaatctggcaaatgttcagacatctatggttcacacatattgcaaggacaagttaagacaccatacataacatgtataccaggtttgagatctcctttgtataaaaaaaatagtacttgtcatcagcacggcagaaaagcataacataatttcttttgatttttggaccacacaacatgagatatgtttggctattttttgctcccaggaaatttgtacagaaattataaacatttggcagtcaaccagcaacaaaaccaaaataaaaaaattacaattctaaaggctgtcaggaattattaactcggtaccttaccaataactcacaaggaaaatatgcatgtttatgttctgaatagaaacagtacattacattacacaggtttgcacataatgcaagaccaaattctattttcagtaagttgtcaaccaagttcttacgcaatgcgagcccaagttcaagccatgtaaaactaaattcaaatcaaatacaaaagttgtatgccacacaacagccgtagagcctcattttggttagagcaacagcaaacatggctaggtagatcttcagatagcaggcaagatgaacttgatacagtaattggttcagtggcagacatggtcttttgttggagcaacagcatagttgggtatgacagtagtaaattataacaataattatttttttaaaaaagacatgtatttctgataagtatgatctagcagagggaacgatcaatgtacttatttagaatgcaaagttcatatggttcagatatggtcattgtcactttttattacatgtagcatatattgcaaatctaaatatggttatgtacttgtcagtggaaaaatagaacagagagttcacgcaatctgtaaatatgtagacattaccaatttaccattacattatttccagactgtagttgaagtctctaagaccatgcaaaaatctgagatacaatccaatgggcaaatcttagatttttaaaaaggaaattgaacaaagcacattatccatgttcaaactattgaataaatcatgtgtgtgaaatctgtacagcaacaatttagactttttttatacatataaaggcaaatattctgtaggaacttagcagtagattataaggaaaatgacttataaccctttgaattgagattgggcagagggaaccatcagcatacacaagtaaaatgtgaatttcagataattcataaatagtcaatagtactgtggtgtgcatgtggcaaaccagaacattcaggtagataattttgggatgttataggtgtacaaacatatggatgccaaatattattatgacagaaaaatatgcttaagtaatggcgtcctccaaacctgcaattgtgattaacttgctccacttacgtcatgtgcatcaccttaccaatgccatatccaaacctgcaatcacgattaacttgttccactgtagtcatgtgtgtcacattgcctaattccatcctccaaacctgtggtcggtgcaaagaaggaaaaggaacgcctattagcagcttgtaagaatggctaggataatcccagatcaattccaacataaaaaaaacatgtgctgaaattctagaacatcatggaatgcattttggtcgtgtgcccctgggcagaggttggggatctagcacatcttgtgcttcagaataaaataccttctgtatctaaaaaaagttcatctctttggagaatatatttgtccttggatcaacccataccaaaattcgaagattttaatttagacagttacactgtgaggcaagtgaggagaaaatcaccaaaatactatcaattcaccagtggctctgcagctaccagctgggagcatttaacccttggtaattaaaaggtaaacactcaaattcctagacaagaaaaatggatatcctattcataatcagatctgttccattcctttacccttgcatacactaagttgagtatatctaataggtttatactatgcaaatatatgcctttacccttgtttgaccagtgaccagtaatcatagtaaaaaatagtaaaaactaaaagtaaagaaataatcccgcatatatggatgtccttttttgttgtgcctatggagtacatgaaattaggatatatatcaaccaaaggtcgatcaatgttaaataaaagaacaaaatctccttgaccctcctcatagagaatcttaaagccaaaagccatctgataaggcccttgcctatttctcttccaatatattcattccatctccagcatatctgcataagcttgtataggcaatgtactgtcaattatggcaggtttttagcatgcctagtaccaaaatcaaatggtggattgcagtatcacattaaatcagaaattcacatttactttttttagattactgaaacaaaatatagacctttcatgtggatatttctaaatatggattctatatattaattcttgattggctgaacatctttttttttttggcataagcatggtattggtaggaagtactcaaaagtttacttcaatttaacacagaaaaaataagactttacttcattttaacacagaaaaaataactatggactgaatataggtggttccatgtcttgattagtatcacttatcactactgcataacatttgtttcaagtcaaccaaatccttatcggttatctagaagtttgatttttgttatagtctttcattgagcaggtggcactgaaaacatatatactctatttgtttctttatagtccttcattgagcagctttgtgatgcgtttttttccctaattcagtagcaatgctcagctccatgttgcatcatttatcaggttgggagcaaatttggggagaacacttcaagatgggggtccataatctctgatgggcaggttggcaaactcagcgacattcttcctggaccagcagctgggttcttctcatctttcacatctggggctcgatatgatccatagtcactgtttaatccttgatcttcaccccatcctatatgttaatacaaattgacatgcgtgaatggctaaactgtcgagggacaacatgatctgcgccattggatatctgttgcttacagaagtatgccacagctgggaacctgggactgcataacttggctcgacctacagcgccccttaacattttacgtgattgatcttcaatggtgaagctcaattggcgactcgctagttctgcctatgtacactacagatatggaagttgtcgcgatttggagattaaggtgcagttttggtgtgcttcatgattgcagttttacagggtatataggggaagcaagtgcaacttactactgatgttagtacgctctttgtgggggctcgatcaagttgtggataggccacatgtattcgtgcaaaagaattttggagtccattcattctttttcttaatttctcttttttttttttggctcggaggtttggaagatgttttagatttgaacagtcctgaaccgcagcgatcatggctttcaaagcttgagggtaaattcacacatctgtacacttgaaaatatcaataaagcgtgtatcttttcccttaaaccacagatgtttagcgttccattttctgtgcctgtctacatggtaaccccaaacttctttctgtacatcacacggttactgattctgtgtactgtacctaattgaactaaaaggcagaaggatcatgctaatacggtacgtaggaccatgaagaaaaatgcagtgcagccagcgtcagaaatgaagtgtgctcagcatcattgcgttgatatggtggctgagatgttcatgttacaaaaccttttttgaggaggatgagatgttactcgtaataataagtgcgcgatggtctcgcctgacatgggccgttgtcaaggacggcgaagtctttggatcggaaagagtttgccctttacctggtgtgtgcggtgatccatggaccatggcacacaatgatagcgaaccgcgaaccactcgccccaactgtttcgaaaacgagcgaatacccacgtttgagtcactaccggttagtcgaatgtatatcgattaatctcctgttagaattctccccaaaatttacaccaccaagatgcctctagagtctagacaggagctcagtcgattgttttttttaaccattttcaatcaagattcaagaagatccattattttactccctgatcacctcatcaagcatcacgtcgtaccaaacccgaaatgatatattcccatccagcgaacggagcccccgggtctcgtcctcacgttgttgattctcttgcgtgggctaccatgactttcagctgcttctgcttctagacgaaccttttacgtgccgtgcctcgcctcgactacatcgccccgccgccatctcccccgccaggacgcacgcacgcgaacgcaaccgcgcccacgccacgcacgctcccaaactcgtatcgcggcattccgcgggagccggggggagagagagagagagagagtgtgtgtactgcaaccgcgtggacggaagaatcgcggacgtccgcggcgttccacccacgacccacccgtgcgtttaccgggctgcggctgcggctgcggctgccgatgcggatgcgaatgcggctgcgtacgcgaccccgacccggctgctgcgttcaccatgtgcgacggccgttgaaaggagggggaaagcggggaaagcgcgggcgccgtttccgcagactcggagggctcttctgtttctccactggtggaaacagaaaaaaatgttcggtaggagtgttatttaattgacttgactacgcgatgaccctgtcatatatgaagttggaactatcacgattaccgggcggtaccgatagtgataggatacggtaatggtaagaacttgatgaccgacaaaattcggaagaatatttgaatcgggcgcccgatcttttttttaaaaaaattcggtcggtcaaatattataattgaccaccaataaaacattgagttatatatgataaaaaaatcaatcgttgaaacatttagtaacatttttgtgaaatacggtaaagacatacattgaaacatgtcattatcacgtataaaacattgcgtgttaacggactgaaacttatgtttttcttttatcagaatataatcatatgttatcttattgtaaaaatttaattgcaacgaatataatggtgtgatcggatcacgtattagataaatagttttagcgaaaaaacgttttgaaggtcattaaatgtatgcatgcatgcatgaataaaggtggagagagagtggtggcaggtagtttgaaattttatgaaatacactcaagacatgcattgaaacatattactatcacatataaaacattgagttttaacaacttgaaacacatgtttttctcttgacataatataatcatatgatatcttgtcataaagatttaattacaccggatataatggtttggtcagataagtagtttagtagaaaaaatatttaaggagaagaaccaatattttcggagagggttcgtctgaaacgtcggcatcccgattcgtagcattcccaacaaaattcaaaagaatatttccaaaataaattttgtttgttttttttttactatttactgagatgaatgtgcttattgtcggagagtggcaacctcttgttctggtaaaataaatctttgggttgggtcggtggtcggttgcctgcctcacgagtggatgcagtgagttcgggcctcctggctattcggtttgagagctagtggagggagggagtgcaagttgctgtccaaacaaaacttcaaaaagggaagcgcacgaatgaactctttttgaagagccaaaagagggtgaagagggtgcaagtagagtgtggagtagctaggacctaggagagctgctactaggctggggatcttaacctatgggctattgggtgagtgttatgccactcgcgtatggcatgtacctttgtttatctcctgttgctatcgttttatgcaccataacagtgtcgtggataatcatcgaagttattctaattatcatgagaattgaactttcctacatttgaaacatcactggtccagttctaaagtgctcactgatgatggatgaaattgagggtataataattttctgagggcacaaacaaataagttagatattagaaagccaaaaaaatgatgaaaaaaatctaaaaaaatgttgattattttttttttagaaaaaacattgggtttgttcagcaatcgtggttgcggttgcggcgcaaccaacatcaatagtgccacaagtagtagaggaactatggttattgccgccgcagccacaaactcgtctttccgaacacactcattgtttaggagcttgagcaagccacgataatccatcatatttagcatgagtcttaatatactatatctatgccatcgaggagataccacggttaaactatttttaaatataaatttggtatctcctaatacctctatagggttaagatctaaaattacgatatatcaaattatgacaccttaccaatgatactctatttttaagtgtgaatttgagaactaacacctctctaatgttaattaatatcccctaaagctatcatatcccagcatcttctcacaaggacatagaatctctctccaagtatacatcatgatacatattcatgccaccacacgtgatgcattttatagtacacgatacacacatctctcctccttctacaccacaagatctagcattgaacatgtgctgccgatccttgccggtctccgaattcgtaacacatctttgcaacacacagccgtaccaaagtaccgctgctatacctctccgtaccttttgatttttacctctttttttttcttcccctctccctgtggggtatgcagcgtgagagtgtgaggggacaccttttgttgggtgattggctgcaggcgctctgatgggttcttgtttgtgttaaaaggcggtagtgataggtctacatctctggccaggttttagttttttttttctcttgtgggtgctccctttctgggatctttcctttttccaaaccattgtcccccctcaggttacttaagggcaaagctaattgtttaacttgaggttagtcttatctactgaaatactccatccattctaaaaatatatagcacaactactttttaaaggtgtttcataatataaggcatgcatgcatgcatggcaattaattagcatctcttctctcctaaattattattttttaaatcatacactcactagatgtttaattctattgggtgcatgtattgtattaattggattgattcaaacaaagagatgataataattgtttcttgatctttgggttaaaggtggttatgccttatattttggaattgaaagagtatagtcttatagtgtgtgtgttttttttccttataatacgctttatattagatgccgatatggtttgagaaatagcagcgcagacaaaatagttgtaaaagaaagagcagctatctattctaggtaccaaattatacaatacttcctctgtcaaaaaaactcatacaatgaatctggacaaaggatagtccagatttgtcgaggaatgaccctctctagcgggagatcgtgagatcccccttttgtgagttcggccgggggaaaaggctcgcgtgtcgagatcgtgtatccgccctgagtgcttctagatcgcacgtggaagctgggattatacaggttcgggccactatcgagcgtaataccatactcctgtgtgtgggatttaagattgagggttacaaaggttcctaagctctaggaggaattccctcttcttcccctggggcttaggctaactgagagtcgtcccttttctcggtgggcaaggtcctccttttatagttcaaggggataccacatgcaccgcttctacctactctttcacgggagggggacccactttaccttgaccggaccacgatccttgccttcgcccggaagtcaagcagcagtccgtccttgagtgggacccaacgccgccccccactcaacatgggggacagccctgtcattccctcttaaatgagtagaggctttcggcggttcatctcgcatggagggagctgcagatgatggtttgatgggacggggcatacctgcctccactccgctgggtacaggggcgaacgtgggggcacggtcgcccgtccgatcagacgtgaccggcaacaggccggtcacagtctggttacgcccgattgacgtgggtcaatcggaccgcaccacacgtccgcccctaccgcatttagacggttagggtgttgcgcattgatggcggctcagcctgggcctcctccccgctcgctcccctcgccacatggcggctgcccgagggcctcggggcgaggcagcgcgagggcccgaggggtgtgacttggcaccccgaggcctcctagctgcttccgcaacttccgaggtgtgggaggaggaccaggctgtagggccacgtggctaaatgggaaggtaactcccccacgcttcacataccccgggcccatatcacagacaagattcattgtactaggaactaggttaagttttctttgggacgaatgcagtacttatataacacccatacctccttaaggatcaaggcagtaaaatcactctttaagagtgtgtgtgtgtgtgtttgtgtactaaaaatgttgtttattgtgcgtggtacaacatgatacattcccttcagataaagattgattgtttgatctatagctcgttaaaataaattaagcaaccaaaaatatattcgtagatataatttatttcatgtttaaaaactaatgctggaaagtaaattttgatgaacgaaatcctctaaactaactccaaaactaaatattaaaattcgaacttttttgactgtgggtgataggacaacaagtagataaaatgagaggcatcaagaaaaaaacaaaacaaatttacagcatattggaccagaacaagttgccttacatttgagggagataatagtattttaaacctgccttgaaaatatgttcatggaaaaaaattaagtggagaacgacagattgagcaagcaacacacttttttgtttacataaaaagttcaacaagcaacattagtgggcacaactattctaggggctgctggacagtgatactctgttgtctgttccaagttttgagttgaatggcttaagattcatttcattattaccagttagattcctcgcgacaagatggtcctagtaaacagctgaactgaacagacattcatgttgattaactagtcaagctcgttgttgctagacaccttagcttgttcaagcacggtatctgaatgcgtcaaaactcaaaaccaattggtagaccaagcaatataaatagtacagtatacagttcaaccgaacagtaatgacattgaaccagtactttacttgatcatcataatcattatatcattataaaacaaacagtacaatactagtaaaggcctaaagggaatctctgaagggaatttgtcatgctgtaccacacacaataaacaacatctgtgctaaaggcagagagagatcaaaagattggatctttttgtcaactctttatcctaaccaatctaatcaactaccccaatgaaccagaggctttgtgctatcacaatattaaagattttaataggatgtcgcattggcattaggcaattgcaggagagatctgtgttggcgacgacgcaaggcaacaggcactagctaggtgccgtgtaggcagcaaagctggattagctgattgcttgacctacttatctggccaatcttctgatgaggttgttgttctttgctccgattagtaaggcacatgacacaagaaatgtgaaccttggggggagtcatttggcatcttttgataagggaattcttgacattgataccaccattatctgcttgttttttgctaatcacatgtggccgtgccagaaagcagacagacaggcttctccaaaagtagtactcgtattttggatgcattgaattatgctcccaagaaaattcctgttgaatttcataaatacactatgaaaatcattgcatttgtgctaccaaggacagtgacgccaaatacctcacgcaaaactgaacttaagcaaaaaaaaaagtttacaactatagagaaaccagtgatatatgaaacgccaaatctatgtacctgagccaggactgggccacataattaatttccctttattcatatcaaaatcaatggcgtacctacacatttggtgcaggaaatatttttggacaagatcataccaatgcgcgtgcaatatcaaggatgacactgacactccctttgcaaagcaccaattacatcagtagcatgggaaaagcattttcccaaatttattcagcctgaaccacttgatcatccagcaagggggagtagcttcccaacaaaggcatgccacctaactggatgaagatttctacctgccccatcaatggagaaggaaaagatgcccttgatcgagtcattgttcagacatgaaggttttctttctgatatgttatgatcattgggtaggaacattcgtagctcaggggagaagtttctctcccactcactcatgcacgtttttctattattgctgctgtatagttcctgctgatgagcacacgttgaaagattcagaaattgttttcaagatatggcttgtcaaacggtctagagaaaatgattggtcccatccagattgttaggtaggagtactctacattacattagaggttgcatacttgcaactggagtataatttagcgagatgcagggcatatactgtatccatgaagcttactgtagttgttaggtacagtatagatagattagcatgttcagaattcacaaaatgaatgtcccatgtcaggtggcagtgctctactgttttctgatgttcttcttactgtgattgtccacgatagaggccgagtttagggtgtgtttatttcacactaaaattgaaagtttggttgaaattggaacaatgtgatggaaaagttggaagtttatgtgtgtagaaaaatttttatgtgatagaaaagctggaagtttgaagaaaaagtttggaactaaacaaggccttaggttgtgtttagttcctgaaattggtgggaagtttggggaaagttggtagtttggaaaaaaagttaggagtttatgtgtgtaggaaagttttggatgtgatgtgatgtgatgaaaagttgaaagtttgggggaagtttggtgtgaactaaacagggccttagttctaaacttttttttttcaaacttccaacttttccatcacatcaaaactttcttacacacataaactttaaacttttccgtgacatcgttccaatttaaccaaatttctaattttagcgtgaactaaatacacccattaaattacatcaaatttggctgcgtaaatccgctttggatgcatagaatgggttttactccattttctaagaaaaaagaaattattatcaaaatattgtatttatagaagtccattgttgatttgtttctttctttgtagatcgttgttgaaacttgacaaattgaatggcagatttggctgctagtatttttttttgaacgccaatttagctgctactattggacgcaggagaaatgctaaaggcaaagatgcaagagaatacttttataaactaggtggagtatctagtaatcttattcccctctttggctctttccccaaatgcaatttttgcacaattgtactaatgaaaagcatcattagactagcagtgggacccatagtatgtgcaacaagaattttcttagatatctcaatatatcatcatccatcatatccaatcaagaaaatggaacacacaaggaagaacaaaagagctctcactactgacatcatcatcaaattaggggacaattggaattctatttttcttttgccatggtttatgcaggagttgaacttatttccccaaaattcatgtggaatttggcatggcagcctctgtttgaataaactaagccaaaccaaacccatcactttgggtcaaaggcagcaaagaagcaaaggaaaaccaagaaaggaaaaccccaagaggaggagagaaaaggaggaaaaaatgctggacacgctataaagcggcggagcagaagagtggcaaccgcagagcccacacgtaatcctttgcccgtccccccgcgttttcacctctcacccctgaaactttctttatttacaatccaggacaagttggaggggggtatatatgctggcaagctaaatcctggttatttcgagtccctaaacgcaaaaaaaaagttgctgctacgcgcacacgcgcagcggcgcagcctccgcgccacccctccgcctcgccgtgtcggcgactgcgaggcggcgtgccggatgaggaggccgccggagttcgcggcggtggcggcggtggcggtcgtccccgcgctggtgctggcggctggggccggcgcggccccgttgccgccggcgctgaggctggagcgcgcgctgccgcacaagggggtggcggtggagcacctgagggagcgggacagggcgcggcacggaaggagggggctgctcggggaaggaggagaaggggtccccggcgtggtggacttccccgtggagggctccgccaacccgttcatggtcgggtgggtgagctgcctctcgctttcttttccctgtgttttgtatgggtgtggttgtgtgtgatcgagaaatttgggagttcttttcttcttctgggtttgttcgtctcggcgttgatctgaggttgttgcttctgctaaggtagattggtctcacgtatcgacaatggtagttcgttttcagggtggtggatggctgggttgttcgtgggcttttgttgcttcagttctttctgtttctcggatgaaggttcaaccctgatgaagtgtttatgcccttactcgacggtttcttgctgatgtttttttgtgtgcattctgaaaagtatcttctcgttctgttttgttcgaagttttggctttcttttttttttttttggccgaattgttcgtcgtagatggcggcggcttgttttctttcggattcttagattcgtttttgtccctttttcgatgcgacgattctgacttcgctctttctttatatgcattcaattgcttctcttgtttcaatgtcgatgctcaattgcttgttcattcgggagcccaattctgatgcagtgatgcgtttgcttgctccaattaaaataaaataaatgcattcatatgtaaagaaagagttcatttttcctttctgaaagaagaaagaattcatttattagcccgtaccttgcttctactggatcgagtgtttacagagatttggttgcccgtcacagtttcacttggccgcaatacctgctttctttcattttcctcgattgcttttacttaaggtcaattcctcttaggaaaaaaaagatatttatttgtcttagctgcggttaggaatttgtcaccctcagctatgatttaacttttgtttgtgtaatcaattcaaatttgtgcaacaccagttgtaagcttagtgacagggttatttagagatatcttagcaatagggagcgatatattatggactgctagacggaactttttaattgccccttgcgagccttaaaaggggagcaattatgtttcaccaatacctgtaggctttatatgctatcacaccttccatcatgctgaattccacttcatggttttgtgccataggctatagttagttagttaccatctgcaatctgtggtgttgatgaactcccttgaggtattggagtatcatgtgtttaaacctttactgatgggcggcaatttgtaaacatgctcatctttaagtgaatccttgaatttgttaggatgaacgtttcagtttgtttccaaatttagaaatgttatgtgattgcccaacctccgttttggaactatccttcaactagtagtggatactactttgtagagggaatttgagggatgcaatttttccataattatggatataatataacatctatacatgtattaacaatggttttgttaaaaatgacaaacatgactataactagttactactgatgggcagggtggattagtgtcatgctaatgtaaagatgatatcatatcatgattagggaagcatgctcgccaatgcagatagcaaaaaggggacgttcagcagggatggaaggactgaaaggatacatgtccttttgttgggttgggggattgtcagctgatggatataattttgaagatgacgtgactcaaccttggataatacatagagttatcaattg

SEQ ID NO: 31395 - DNA, 9541 bp, Oryza sativa
cttcaagtgggctcaatgtgagacatctcattctttgcgctcttatctttatctctatgacatgcatacaacagcattgttatcccttaagatggacttacctatcagttgagattcattctgattggattattactttatatgtttttcagatccagttggagttcttcaatcctgacacttcatcaacatcatccaaaataccatgctcagatgataggtgtacagctgcccttcaaacaagcgaagcagtctgccagacttcagacaacagcccatgtggttacactttcacgtatggtgatggaagtggcacatcaggttattacgtgtctgacacaatgtattttgacactgtcatgggaaatgagcaaactgccaattcttcagcctctattgtttttgggtacagttcccttgaagccctgtatctttctaaattttacattagttaattttaaactgcaatcgacaactaaactgtgctttaaggatagtaagataccattagaaaccttgttagtgatgtggtccatttacatgttgacagtttgttgcacatgtgtgacaaagttggctctttttgctgattgagttggtacaaatgatggacctaatggcaacaaactcccaatgtccttaaaccaacagtcttcttgtacttttgcaagcaaacttcctttcaatatccttaatagtcaatctgaataaagttcttgtcatccctgaaaacagttgccaccagaaaaagttgtcaatatccttaatggtcaacctgaataaaattatatttatattttgctttccatgccattctggagcaaaagaaattcagcatgcttctagactactatcctctggcatgcatgcttcatcctgttaatggccttgttgttatgttaacaaaagcttagccttatgtggatcttttagcagtagaagcctggtgacactttgctgtaaagtttaactgtgcatttttttattttcattaccctaacagtgaactttgttgcttcgcatgatcagtattattcattgtctgatgaatatgttaattcttttgaaacagatgtagcaactcacagtcaggagacttgacaaagacagacagggcagttgatgggatttttgggtttggacagcatcagctgtctgttgtctcacaactgaattctcttggggtatccccaaaggtgttctctcattgcctgaaaggttcagataatggtggtggtattctcgttcttggtgaaattgtcgagccaggattagtctatactccactcgtcccatcacagtgagtctcttactagaattacttattgtataacttcagaattctgctgattttttgtttgtagaaaagttttcaaccaataagtgtatgcacattcattaaccttgcgtgagaggctaacaatattgctgcatgagtaacttgatattcttcctcctaatttctttctatggacgtcagtttatgatttatttttcaatgaaatataggcctcattacaatttgaatctggaaagtatcgttgtcatggacaaaagctgccaattgattcctccttgtttacgacatcaaatacacaaggaacaattgtggacttaagaacaactttagcatatcttgcagatggggcatatgatccatttgttaatgcggtgagcttcatagggcccacttatagttctattttctggaattccccatatatgataagcctacgatagtaattaatcttgtacatgattgttagtcctcatattttgtttttgcagataactgctgcagtctctccatctgtgcgctctcttgtcagcaaggggaaccaatgctttgtaacttccagcaggttagcttcttgtttcagtgaaggaaattagcagctcatgttcttcagtatgtcaaattacttacagatattttcgcttttcaaccagcgttgactcgtcgtttcctaccgtgtcactatattttatgggtggtgttgcaatgacggtgaagccagagaactatcttttgcagcaggcttctattgtaagcctgcattttttttaatatatttggtttctggccttggtaacagttgtatatctgcctaaccgtttctgaaaagacttgttcctgcccatattaataccatatcatgcttttcaggacaacaatgtattgtggtgtattggttggcaaaggaaccagggtcaacaaataaccatactcggaggttagttaactagctctgattgaattagctaattatggttgcacgtctaagtctaacccgcaactactattaagacttgagacaaccatcacatcacaccactgatgtctgaaaaatttcaatgattaacaacattctcaataatcacatcgatgcacattaatctgcaagttctttcaagggtattgaggccttgacagattaatcctacgttttgaccccatatgtttttccttgaccctgaacacttcaatttccataaaaaaaaaacagtcgatctattagtcctatgctgatgattgaagcacacatttctccatgttgatgctttgttgctaactatttggtcccactttgacgcagatctagttttgaaggacaagatttttgtgtatgacttggcgaacatgcgcatgggctggactgactacgactgtaagctcacccgaattttcagattttgtccatggattcatcacgttttccgattcttcttcttcgtcgtcgttgtgacaaacaagtgaacaactaacgaatgcctgtttttctttcttttggtaggttcgacgtcggtgaacgtgacgacgtcgtcggggaagaaccagtacgtgaacacgggccagttcgacgtgaacggagcgtcgccgcggccgccgtacagcggcctggtacctgccgtagcggtcgccgtcgcgctcatttttggcggcttctcacgtagatagcagacgggctaaccgatatcgatctcccgacatgtgacattgtgattccattctttgttggtgcattcaggcgttcggttcccccccacgagcgaatgagcatgacccattcttactgtacatacagatagggaaaaggagaaaaaaaaatgaaatgtcaagagttcattgctcatggagcagcctcttttttgtcgctctcactgtctcacacctacacgttggaagggaaaaatgtcgtgcaatctccatatatcgtagcatatacaaattgatttttgagatttgttcacgttagcattagtaaaaagttataaatcttatatgtccattcttttgtactaccggtagtttctggatttacaccacacgtggattttcacggtatatttttccgtattgggatgacgatgtaactgtctggttttggtgggcgccgtctctggcggtcagagtggcggggcaagcggctgtcaggatctttgcagtcgactgcaccccacctttatcacttataggtgggtctgaaaattataaattatcgctaaaatttatgtcggaaagtttttgaaatttgatttgaaaatttgaaatttgatatgaaagtattcaatttttagatgaaaagtttgaaatttgagttaaaggtattaaaattcaaatgaaaaattaattttctcgaattagtccgcccccacccccctcccccacacgttggcggaaatcccgttacggcccaaaaccaacggcccgcacgttggcggaaatcctgttacggcccaacttaaatgggctgcaagcccatgggaattccgttccggcctaacacggacaggccgcacgtagctgtaaggaaccccgttagggcccaactaatgttggacactcacaatcgcggatctggaacccactcaggctgtggcctactcgcacggagcaaaacactgtagcacagccgttggatggcgagaccgacggttcggatagatttatggtggggaccgccggaagagaaaaaacgagaggccgtccgccaatttcactcggctccctccctccaacccctcgcttcccgcccttcacttctccccttccaagaaaaaacctacaagtagagagagagagcgagagagagaggagagagagagagagagagagagagagagagagaggcggcaatggggatccagggattgctgccgcagctgaagtcgatcatggcgcccatcggggtggaggcgctcaagggccagacggtggccgtcgacacctactcctggctccacaagggcgccctctcctgcggcgaccgcctctgcaagggcctacccaccaccaggttcggctccggtgacctccccccttttcttggaacccagggtttcttaatccatttcgccgattggtgagacctaaatcgacggatccgggaaatctacttcttccccacgagcgtattgacagctgctggtcctaccaggggtttcttccgattttgttttcttggtcccgactggtgaaatccatttcggaggaggggtaaaaggcacgtcttgcttcggatgagagatttccgcattttttaggtgggtgtaggaaggggggggggatttcttgtttgttcagtctctctcaggattaaggtaataaatgtgcggcatttgttttcgcccccttccaggggcagtacatttactgaaatttgttatccgcctcagtgcccagattcttgtatgtctaggttgcattgaataaaatacacacttgggagagatccgctgcttggcatctggtgccgctttagttcagagaattcaccattttagtttgtggaatttttattggaaatagcttagacatgaatagttcaataaacgttaacaatagcttagcattgttagtagtatctttttactgtatgggatatcttctaacattgctgcatttttgatgtcgtgaactcataatgcggagggccatagatttgcaactccagtttttatcatcatttatcaccgttgtagttgagcaccataacttacaccttgtgtttcccctcctgaatctgaaccaggcatattgagtattgcatgcatagggttaacatgttgcggcaccatggcgtgaaaccaatccttgtatttgacggaggtcatctgccgatgaagggtgatcaagagactaaacgtgaaaggtatgttctttcttagggctccagaaagagcctaacatgtttcagttgccaaggaacatttacattacccttacagaacattaaaaaaaattgtgatttgacattttacatacggctatagttatggacaactgtggctttaggctgatatagagcagtcgcattattagtacagactagtggataagctaaaggcctccagccattctttgctatgtgatgtttcttgagtcattggatgctaagcaagtaagcatgacatcctgtaggtcacgaaaggaaaatcttgagcgtgccaaggagcatgaatctgctgggaattcacgtgctgcttttgagtgttatcagaaagctgttgacattacacctaggattgcttttgaactgatccaggtaaaggagcaaattccatgtatttttaccaaatatttaccacctatttgaagcagttctagtcaggagtaggaacatttggcttgtcttaactgattattgttccaaaacttgcaatgcaggtattgaagcaagaaaaggttgattatattgttgcgccttatgaagcagatgcacaaatgacattcttgtctgtgaacaaacttgttgatgccgttatcacagaggattctgatctgataccatttggctgttctagagtaagcacagtgttaaaacgctttatctttgtcctccacgtaccccatagtattttgctgctcagctagattagtgttcatagtttgttgtaacttctctaattaaaatgcatcttattccattgtgcagattattttcaagatggacaagtttggacaaggtgttgaatttcatattacacgattgcagcgatgcagggagcttgatcttaatggattcactatgcaaatgctactagagatgtgtattttaagtggctgtgattatcttccatcattgcctggaatgggtgtgaaacgagctcatgcacttatccaaaagctcaagggtcatgaaaaggtaaaccctgtatctgttgtatcaaatactaactttaggcctagttggaattggaaagaactgattcatgaactaacatgaacgatgcctgagatagtgttcaagacctacaaagcatggtaagaaaaggctggatagtagaaccagaatgcagttctacttagacataactacagaaggcaaggcctcaacacaaaattgattgcttcaacttttatgaggccaccgtcttgtacttaggtcattagccaatccatagcctgtcatacatgcaggacatgatttgagttactactgagcttgtagggcaacgatgtgcaatcactttcttgcttagcaaattagaaaaaaaaataatgagcaaatgatgcgtataatttcaggtaatcaagcacctgaggtacagtgctgtttctgttccacctcaatatgaagaaaacttcagaaaggcgatctgggcatttcagttccaaagagtttatgaccctgtgacggaagatattgttcatttgtcaggcattccccatggcagtagtgaagacttggactttttgggcccatatccttgccaaacttatatttgtacaatagatgctaaagctcattcatatgataacctgttgttttatccaccataagtccataaggatgaatttccacttttgtttggtcatgtctaatggccattatacaagttgcgttagaaagtaagctaacggcctttcaatgccaccatttctcagtaataccgaattgtgttacttgaagaaaatctcaacttgcatgcattggatcttttccttaattggtttatacatggctaccacagactgttgctaaaggcattgcccaagggaatatcgatccgattaccaaggaaccatttgaggtactaccgatcttccctcggttgttttggtttcttggtgctttgtttccttgaatgtaatttcatcctactctgattctgtgcactgcatatgtataaacatacccaagcatcaatatgcaaatacaaacgaggggctcttgaaaatggttgtaagctcactgaaatatccaatcagaggctacagagcattacagaagctcattagagaaaaacagataaaaatccataaaatattttgtaagaaaaaaatgtagggtcctcactgaaataagaaagtacattgtaagtgatcatggttttactgatgtactctgttttattaaagatcaccagtatgcaagcatttgctttgctgacatgcgaataccaacattcaattttatcttttgtggattgtcttactaagaagttatatatgttttatttgtatatgtgacttgcagggcaaaacagagagtagcgcactcgcttttgataaagtgcatctgaacagagagtccagtgctccttcaaatggaaagaaaaagcttgatctacctgtccaaagaaacgtattgacaaattacttctgtatcctctcaacacattttaatttaattgagagaacaatatatataccaatcaactttattatatgaactacttgttgcagcttatattatgggaatgccttggataagatagttcagttattgtgctttctcgttcccaaacatgtttaggatcaaatgaagaactaataatttccccataaacttatttacgaagtctaaggtgatgtgcgattcttagcatggtattttgcttgttttgtaaacaatacttcaactgtccattggatgaatccttgacttttagaaggcttagcatcgcttgaggcaaaacggaagttcagagcacctaaggttacacctaagcaacaagtacttaatgggtctttgcccagtcccagaattgaagactctggtacccctgatttaattgaagatactagcttgccatcaaataacattcaagtttatcagtgtagttctgagcattttagctcaggaacccctctagatgattcaatcaataccgcctctcaatgtagttctgagcgtgtccgctgtgacatccctcgggatgattcagccagtgtttcaccccagtgttctcatgatattggtagtgatcctgctgaggacccagacattgaaggcaacaaggtatttcacgtttctttattgccttattttcagtgttctcgtagtcctacctttctacaacaatatcgtatttccgtcattcttatagttttacttctgctatacaggtgaaagtcaacttctgcaacagaagtacaataccgacaggctctttcttagagggtaagagctctacctttttgtagttgatgcatgacttgatctgcaaatcatgtactggtatatctaattaaaatgaaaataatcttggtttctgttttgtatgcatttattttcgttttctagggactttgcctgggatatcagatccatttttagattcacacaacacagagccatccagagctgcaccacgttatgctgaaaaaagcaatgtggtctctgccaatagaaatattactgtgaggagttcatatttcaaaacagtaaataaaagagtttgcacaaatcaaggagaagatgagtgccatgatgaagataactgcgagactggtaattacactctttctggagatcaacaaaaaagctctggaggtatattgaagagaagaaaatttagtgatccccaaaattttgaagatgtaagcaatttttttttgagttgttattctatcatcatatcgcagtgacctgtctgtatcattctactatctggtcttgaatgtactatttgtgcagggaatgtttcaacccactagtcctcatgaaagtccaccggttgctgataaaggtaatagttccacctagttgtctgttcttattctctgtgagaatgtgcacctttccttgttccatttctctatagataaacttgtgacgattacaagaaattcagttttccaaaaacaacagaaggttctgccaatgtttgagtgtgcgtagttccctttttttttgttgctgagggaaatcttctgaatgtctgatactaatgcaggctgtgactctgattcccacgacggtatcaacacaaattctgaaggaaaatttggatgcaatgttcgcccatgtaaatgaatacagtggcattgcagagaaatcaatggataagtttggtgcgctgatatcatctttcagatacgcaggctctcgtgccagtggtcttcgcgctcctttaaaggatgtgaagaacactcttcctgtcaggtctgcagcttcagaaaatttcaattgcaccaaggtcacacaatttacttatcagaacttaagagggggacacagttgtcccaatgagttgatatattttataacattaattgcagatctgttctcagacctccagaacagagattcgg

SEQ ID NO: 31396 - DNA, 24648 bp, Oryza sativa
  unsure (1)..(24648): unsure at all n locations
aggggaagatcacaagcaaagctacagatgctgctgctggacctcctgacctgagaacatttgcttatgcaccaacaagatctaccaccagccgttttgatcagagtgaaaacacgcgcaaagctatgtgcactgcggacagccctcctgatattagcacattcgaatataaacccatgaaaagcgccgtcagacgttcagatgggagcaagttttcaggtgcagcactaaaagcagctagacgaacctctcggagctgattctcacaaaattgtggatgcacctgccagcttccttatctgagcatgtttggatttgcgtatgccttctgtctgcgttcatgatctgagttcaacagaatcatccagcaacaaatgctctcaataaaagtgcattccattttgcccaaagtgcaagcacggctgaggtagctgccattcactactactagctgcagggcttatcagttcagacttcagagctcatccgtatctgcgcaatcagaagcacacatgttctgaagggaagtgctttatcttctcggtttccagagccaattatgtggcattttgcgagccaaatgtatgtgctcgtttttgccttgtccaatgaggttcttgtatgaacagcagtcgaatttgcgatgctatttaagccgcaaatgaggatactgttgtattgttcctttttgagaagatactgctgtatgttcattcttatacaagtgtgagcattccttcagaattcagatagcattactcttgtcaactattgatcaagatgttggaaagactttgaaaccggctgtttaagcacttgccagcattctaccagtctttctgaaagattataataagagtaaattgcatattgggaacaaatttttatctagtttgcagattttcactttaaaccggcaaacttcacaatagttgcaaaatggaccggtgttcttttccaatctaaaattccagtggctagtcttaaaataacggtggccaaactctgggattacaaccgaaatgaagctaatgcaaacatggaatgaaaaaaaaaacgatactatatagttttcaaagtattccctccgtcccataatataagggattttgagtttttgtttgctttgatgactcgtcttatttaaaaatgtttggaattattatttattttttttgacttactttattattcaaagtattttaaacacgaatttttttggaaataatacgattttaatgaaaaattgtaaaaatataggtcgattaggcgaaatcgcatgtttagcaccctgtcgaacaaccgtggttcgacagccatctgtcgaactgggtagttggtctaaaaaaatataaaaaagtacggctacaggaatcagcaggaacatgtcgaactgacaaagttagatagggtcacgtgaacagtcaggaatcagcaggaacatgtcgaactgacaaagttagatagggtcacgtgaacagtgccgctacaggacatatcgaactttcaaagttcgacaggttgcggctacaggtggctgtcgaactacggttgttcgacagatacctctgtcgaaccacggttgttcgacagggtgctaaacatgcgatttcgcctaaccgatctatatttttgcgatttttcattaaaatcgtattattttcaaaaaaaatttcctttaagcacaacttttcgttttttatatttgcataaatttttttaataagacaggtggtcgtaagcaaaagctcaaaatcccttatattatgggacggagggagtaattaatattcaatttcttacttatccattgaaatatactccatataacaattgaagatactgcacgaatctccgcgcaatcagccgtgcagattcccctactatcccggccagggagtacacttcggtggacatcatcatgacccgtcaccgcagaggcaagcgcgggcgcgcgagccccgaccctccggcgaagcgccgccgccgcggccgcggccacggccacggccctggcccgccggagttagaggccgacgagctggaggctcctccggcgccggtacaggctccatcggcggcggcggcggcggcttcggagccgttgctagtgatggtcgcggggctgccgcccgggtgcggcgtgatggagctcaagtcgcggctcggggcgtacggccccatcgcgcgcacccgcatagacgccgcctcggccaccgggtacgtcaccttccgctccgccgcggccgccatggccgccattgctgcctccctcgaccccgacggtggcgtcaccgtcggatccaagaaggtaaggagatctgcgtgctgcagttggatgagctcgatttcaacttgctgtgcgtgtagaggaatgcagtacagcctgtacagggtcaagctttgctgagaattgtttgaaggcgctgctagatttgagaattttatagattggcatcacatccggccttttatctcgactttaaagttctgatggatgatggattatggatcaaacagagtttatgaaaattatttgagggcacagacgagagaatttagtattagaaagttgaaaggttgactttaaaaagttctctaagaaatgccgatgaagaaagtttatgcaaaaatcataccgtttgggagtttgggaagtgcgcccgcaataatcaaaaatccgtgagaggaaaagaatgctttttttaattatttttcatctcattttatactctgcatttgctgtttcattctagcattttggatttaattaatgtgctagttattcaattaacttacacatttgctgggctctacaaaacctactcaattccgtgatgaactggctaccttaaattcagtccaaggttacagtcaaccattttatctggtacaagtctataagatagtaaattatattcaatattgatcttgtttacatccagactgtgctggtatcttcgctgtcacaatttgttcatgttaacggtcgtttaaaaccaagtagaatacagatttagtttagaaaaaataaacaataaacttattttgcactttattttagtcgaaatgcatctgcactttggttgtgcagcaggcacaaaataaacagaacaaaatttctaacagattcaggggaagctatagcatgctacacatgttttgagccatttggtactcttgctcttcgatactcagattgctggttctttcatgggttgcaggttttagttgtacaggcaagcgaggcgccgaatgacttgagaagtacagctcaagccaacccagtgggggagaatacgcatgatgcgacgaagaggaatgcaagcgaatcttcagcgttctcgagcacgaaagcggctccagaaggaacctacaaagctagagaaatagtcgcctacgatgatctgttctgaacttctaataaccagccttctttagggaggaggtgagacaaccattcaggtttgttcttgtacactgctagggtctttaggtgagtaagctatgggtattttttagtgtgtgaaggtaccttcagatgggtaggtgtttcttgtattcagcatgtattgtggaagttatcatcaaaacatgagaatttatgtatgttagattgttaatattgacagtgccttaccatcttctcaaaatttctattcaagtgcattcgactattattcgtggctactttgaaaacatttgaaaaagatttagcaaaaaaaaaaagatcaaaagtgttttgatcgattcaatatttgacaccgtttcataaaaggcagaagaaccgtctgatcaaagaggtgaaaaaaaaggaatctgggagttgtgcttcgtatcacatcagtctataccagtaaaaatagagcaaaagtaaatcgaatatatcacactggcatgtcacaaatatacaaggtattattccgggaatgttcagcgagtactttttgttaaacatgttcgattaaaacgctccaacctgtaaagctctaaaaataacgctcttagcaaacgcctaaagtagcagaattttctagtgaaattattctgaagacggaaacactataattttaaaggcacataatatgaccaccttgtatatatacggaaaattttatccagatacacgtgtaacctattatttacgcaattacactgtctgcaaaacagctctatcaggttacattctcagaactgacaaaattgttccagctgcatgatcttcagtgcttggcactcatgcagcattttgcagactcactattaacctctcttcaaggcaagtgctttatcaacattctattggtaaaccatttacctgagacttttgttaacagaaatatcaaaccatgtctgacttatcttgctggcctgcgtgttgaacatgctattcttgaagcttttttgtcttcctttttggcataccactcaccatgtctgacttatcttgctgtcaaatttcaaaaaggaaaatatgtagttaatataacaggaggaggtaataaaataagaaattttaggtcattatcgccaaaggttaaaaagatatagccaaatcaatcatgtatacaaagaggaaaaggctgtacagtgacatctgactggtttgttgatgattattcatagcattgtgtcaatatgactagttaagctgattgttcccagacgtaagcagtcttctaatgatttctgattgattgcagaagcagacagcctcataacgctatctgattaatggagtatccattggcactagtcaatttttaattcattagcgttatatactcgtgcagtgacgatagttccagcattgatcccctctcttagctggttcatacaatgttgtgacatttcttaaaccttcaggctcactctgtggtataagattggagaagaatgttttggtggtattttttggcactgacaaaacattggaagtattagatgctattttctctaaaatagaagggcagaatcattctatgataaagaacaggatagggtaccaatcttgcgccttgcaatccattatccttgcagaaacggactgccaaagattgagaaggggcagctggggggaaatcttcagctggcattgcaaatggacgaaccattttatcaaatttgtccaaggtgagatatgatccaacttcctgcaatctttctggctccataattttcatagtgtgatcatcaggtagcaatgaatcttttccatgttcgctctgtatggatacatttttcaagaactgttgagttaataaccagaaatgttgaaaacaaacatcttacatttcatttgaaggggaccaaactcacctgtaaggaacttatatctgcaccacgactatatgtcatttctatgcgaaacctttttgggtcttccaaagaaacctgcaatagttgtccaatgacaagatcaatatcacttctcaccggtagtattagtaaagtaaaagcttatgattacactataattttttaatacctctgtattctcgaacatacgcaatacaatgtaactcatgtagtcaagttcccttgttttaaacagattatctagagcatttttgcaaacaagactttcttctccatccatagattcatcaaaattgcagtatcgaagtacattcattagagaatgtatatgtgattcctgacaacaaaataatccttagtcattcttatcagggagaagaaaacaaaaacaaagaatttcagttaaaaaaaaactccaaagaaatgtcatataggaaattgtcgtttccatgatgatgtatgctttttagagccttagtttttagggttttttttttttgaaatttctgtatacttctatagttatattgatatattaccataaatcaagaaagcataaacttaacaatttgcaaggggaatatgaaaactcaatgtaatttgtcttactgatgtaaaatagagccttgttcgaacacgtcgttcaggttccatcacattggcatatctacaacaaaattatttgaatatcaattgtattcttcatagtcaagattcctaactggaatttcgtacttactttggatccaagcagtatttggtttctttgtgcgaatcatcaagatcaattgacttcttgtttgagttaggtctatcaaaaccctcattcttaacatccccatagtaacccctatccttccgttttgaagaaggcactattgttggatcatggcatgcattagattcaccaccagcagcagcaacctctcgtctggtgttatgcaggtcaatcagaatcttgcccaacaaacggcgtgcaatctgaagaaaaggacatgagaaacatcataagttgcttgtgactaaaaaacaaaacagtgccaaataaaagggctagcctctaggagaaaattgggtactacatattttctgcaacaaattcctttagcatccttcatttctagaaacaaaatctcatttatgttagtttttcggataaacactacataatgaaaacaatgaatatacaggacgcaactcataacagtttcttttccagttttcaaatatatttacacaccagtacctttgaaccaattttgagtttctgcttcgcatttattccatactcatttggaattacaccatcagctagtgactgaatgaaaaagaaacattataaatagttagatagcaggcagaaaatggatagaaaaagagcattagaatgaccaatcataaaattcagaattcaacataagcacgccactcttactagtaacgtactccctccatcccataatataagggattttatccctctcactagacccacaatataagagattttgctatactacttgtcacatccatcatctctaattcaaatttctacctattttagcctccaactacccactcaccacaaccaaaatcacatttaataggggtattgtagtcttttcttttcatccttaacctttcccaaaagggaataatcccttatattatgggatggagggagtaataggtagtatagcagtacatgtttctaatagtgcatagcatattgagttctctcagtgttaatttagtaacagtaaagcaataatcattcaccactctactagttgtattcataatgtaaaacagggatcaaaggatttcatttaggacctgagtgctatgaaatgatgtcttcatgtgcaaatatttcacaaatacacaggagcagctgtatatccgtggttctacacacatttaagtgcaaggtacattttaagagtgcgatacatatttaatttacctgagaaactctgaagagatcactcaaaccattaagtttgagatgtgagttatgaaggaggtcatacctgtcaagtatactgttagaaatagatgaggtgaagagatatgctggaacaaagaaatgtttttgaaacttgagaaaatgcttttgtttcgaacaaaagcatcacgtgatttttaaaataattgcaagaagccttgaattgcaaaaaagagagagcagatgaacacttgcaaaaaaagcaaaatgaagttattttgggcaaattttatctgtctttgagatcgtcaacattgtgaactttccagtgatccactagcaaactttcaggtaagctttaggaaatatttgagactttgatagtcatgtttttttttttttgaaaccaatagtcatggttttcttatgaaaataagaaatttattttcctacggctgggctgtttcgctgaacattcttgttgattccctaggtcacagcccctaaggcctaaacagcatggaaagcagctgggcaaatcaaggtcaggccctctcatggccaagtttcgaggcacaatttggtatgctaatttgcatgttcattcagaaaagcaaattcgaatgaagttgacaattgacaaagatcttatggaagagcatgatacaatcatataataggcatccagggcccagctattttgtgaagagaaatagaagcatctggagatggtaacatggttacccacttgcaagagtcatatatatcaggtatttgcgtagtgtcaaaacgtctgcatcataatgagagttttagcaatggttacacaagctgcaactccttctgagaatttaatcaacaagaatattaaaagcttggaaacatacttttttctttcgttgtagagatccctctctagtttcttccaacgggcaaacatcaaaaggaagctctcgctgccacaaggcaatccagaagcaatgcggtccatatcaattgctgttttccctagtgcctttgcttgatcataaggatgacttggtgagtcactatctgtcacagcctcttcatcttcattgtcagaaagcagcttcacttgtgcagttatttccttggtcaattgagcctgattggacagttgagataagggcaacttatttgtcaccattatagatgtaattatcttaacgtttggttgttttagatgtgcaagtttctgcagaaacaactcacaagtatacggtatagaaagcaaaggggaaaggaaataaatacatctaatgcatataccaaatttgtgagaaggttagcagcatttggaggcactccagctccatcaaccatccatgggaactccatagtctcaccatttgcaatttttgaagaaaggataatattgtgcaaacgagcctgcagagatctgacattttatgacagaaacttttgaagtttcaaacaaatattttttttcataagtatgagttatggcattggtatctgaaggcgaccttcgcttcatctatctcaatagagccatcctgaagtccatcaagcatagaagagtccttactgacaagtgaaacctggagacagtaaatccaatgaattgcagctctgtcaagtcttcaactggatatatttccgtaataggaacaaaccagaattggagttaactccccctccaaatcaagaagacctttcgcaaaagctgctgcagacatctattaggtaacaacaagaaaaaaaatgtaagcaaccatccgttaggaccgttacccagtacaagaaaaatgacataggatagtaaggtcaggaaaccccagcaatcattactttttttacatattaaatgcaaaattatttgatggcatgtcattatgttcatgttgtctttggattttctcctttattttctctgttgtctgtgtgcatccctgcctgatgtaattccattacttaatgaaatatcccttgcctaaaaaatttaatggcatgtcacagaaggcataaatgtacaaaaaacataaacatttcagtgaatccagaatggaactaaatagtttctggtagttagagaattactacgaagaagaataagttattacattacgttactattgattatatggaccagggtccagaaatctgctaccagttctgcttaatactgggtttttgcccacttgaaggtgtgatgcatcaaatcatgtgtaatcatgtgaaaagaccagtttttcagatagctgccaaaaaatggctggttttcagaggaacagagcaggcggttcaatcctgagtcccgactctaaaatcctaaccctgatatggacatgatgtacccaaaaaatggctggttttcattttcttttacattcaataacccaagcctgtaagaagaaatactgccatttacctggacacgaccttcatctgaactgtatattttcagatcatgcctatatgtactgtgcagacgaagcaatcctggtccttcacctaaataaaccgaagtcacaccaaaatagtacatgagacacaaaagccaaataaatggtgctgttttcagacagttagagaaaagaatgggaggctatctaaagaatgggaggctatctaactgacatctagacagaaatggcagccaaattaacaaagggaaaggaaagaaaggacataagtagggcacaaaatatcaacgtgaaggataataaaccattttgtgaaatgattgctggagtaatttcactaaaagtaaagattgagataccatttcagtaaaccaactgaactgaaatagctgaacctgaccaagttacattttattgaaaaattcactacgattattttgtttagttaagttttttatttcaaattggtacccaaagtggcacagtgaaactgaatataaacatttagtgaagacttcaccgaaggtctgaaatggattagactattgtggtgtttagtgatgcagttcatacaataatttagttaaaaccagagtttcagcaaaatatcacgttggagacccacagcttgatgccacacatagaaagttctaaacgggaagcggaaaagtttaggataaggcatacttggatacatattatttctgaagtatcttcccaactcttctgcctgcatgatcaaacaaaagcatctgagagacacaaaggggggacacgataagaacttaaatgaaatgaacagactgatcattaatcatgtttacttagattatgtccatagtactaataagttgaatatttggacattgaaattggagattgttgaattaacataaaatatccataaaccccaaaaaatcataccgacatcaaactaaatgagcttcattggcaacgcagtgctcattataataatgacagataataaaatcttcaataggtgaaatgaaagcaacctgctttctcccagcatgagttagaactccaccgtacttgagaaccatcagtgcttcaattggatactcctccttcccgttgccgttacttttaggaatatggacccaattggatggctttaactgcactttcctataaatacctgaaaaatgtccaccctacaggccatagggaaactaatacttaatgcctaagaatctattgtatttgcaactaaaattgacaatgaggacaaatgcagattatatatggcagtaaacaaaaggaaatgtctagacagcgcctttgtatcgcatttctattcatgcaacacaattgtctcagcaagaacaagtacataaataaacaatcttatatgtagtatttaattaaacagaaaacattttgtaaatagtgatgtggtatttgattatacttcacgaaaatctacaagaactctgcaatggaggcatggagctccatagatatgtaaacagtaactgctgaaccacataagctatttatgtatatacaaactgttaacaattttatgttttttttaacatttatagatggaaaaatgatttttgaagaacaggtagaacaacaataagcatgatggagatccacgggaaatatacagttatcaacatgaagggaatgctttcattatgcactgacaagatcacaagaagcatgctgctatcgttgtagtagaaattagctgacctaaataccaggcaccagtgaacaccttttcgtgccactccaaagtacgtccaaccaaaaccaacactttaggctttaatcctcacttcattttacagggttaacccagttggtgtgcatggctcttcaaggtttatgtacaactaccattcttatgcttgtatattcatcctaggtgccatgccaaacatatagccctattaatacttgaacactattttacctcttctagaactgctctaacttggcgtagcttctctgcatgctcaatttcagcatcactatcactttcacggccagacctgaagttagaaatttttttcctctttgttagcaacaaatcaacaatgcaacatacaagggagagaacatgctcacaattaagatccgtgtggatgtctactatgtattgttagaagtcagaactctaaccaagatacacatattacataaaaacataatttctgacatcaaaaggtaaaatattatatggggatattaaacatgatctcatagatttttagcattttgtaaactagcaaaaatgcacatattttgaaacccttgagaacaaacaataaattggaagacatatttgatacggattaatattttgttttggtgtatgttactagtgacatccagctgcacatacacaaaccataaaccataaaaccatagaaaatttgaggctccagaaattacctagcacgtggaacaaggattcttgttgcatctaatagatcttgcagctgcaaggcacttttaagttttgcctgcacaatttgacaacatgatcagttttcaggaagcaaaaatataaagctcatgaataaatctaaatcgaaattgagttagttttcgtacctctgcatgggcctttcctccattgtatttcaacattaattttaaaagcttttcttcagttaccttcagcttcaccttttgctttggcgtgcgatccccacttgcatatcattttttgtagtgtcaaaaacaagtttgatgatgatacaatttagagatcataagattatccttactggcgtataacagctatgacacagcgcagctcttctgattgcctagatatgccaacagttcccctttctcgatctcttacagcatcaaatggttggactggctcactgactttccatggaagattagcaggaatggtggatgaaatatgtggagctttatcatcgagaaacattttcctcagaatgcatgcagcatcatcgtagtacctggagttatgaaggcattcaccaaataaacaagatataacgaggaatttgaccatagaaaactacaaatgcattaaactgttacagtaattgttccaacagagtgagaaagatttacttgtgtgagcttttcacaaaactccagccattgacatcacatacataagaccttgcctcccccaaatcacaccttagaagatcaaaaccacacacctacacaaagaaggaacaactactgagctaatacaactacctgtatggtcttttggttttggaatcctgacatatatcaaattgttatccgcagtcttatgtgcttcgttctttgtaataattggctgtagattctgttgaagcaaatgccggaattaatctaattccattatataataaaaatataactaagcacatataaattagctctctgtatatttgttttctgcatgtatggcttctggtcatggaatagaggtgtgtccaattcatctccaatctatctaattgatccattttgctcaatggcaggaaagagcattgcatgccatttcattaagctagaggatcgaaagtattttagttaaaaaaagtcaaactcagtaatcacaagatattcagccagagatcaggtccctaaaggaaaaaacaaaacaaaaaaagaaaatcaaggaactcatttagtacagatgcgccagcagaataaggtcaagaatgaccaacaaaggaaaatttaagctacatatataagctcttaaaagcattttgctccagcaaggtgccatttcatgcactccttgatcaaccaaacttgaaccactgcagcattgatcctattgaaaattctcgttccacagaatccaagcaacagagatcactatggagttggatgctcaataccttcttgatcttccacactacttgaccttgtgctaattaatcttgaaggaaacaaattctacttatatgctgtagatgacttaacacgatgatggtttcactaactgtatccattatgtctagtggtattgacaggtgacagcccataaatacacaatataagatacatcctaagttctgaaatagtgtaagcttccgacatagtaggaattaaataataactaaaagaattctgtaccgcttgtccgaaggcttggcaaatattccttgcaatttgtttctcagtaggggttagtaaaacaggatagcgcaccttcaagaaagatacaaattatacaacaagtgttagatacaaattatacaacaagtgttactatatatctacacagaatggtaactaaagaacataaacgggttaaatatccatcaaagtgtcaaatactgaggcatattgatagcactggtgaatcctatggcaaataggcaacaaaggttacctcttttccatcagaattcctcataacaaccccatctacaactggagatttgcgggcttcagcatgtgcatatcctggcccaactgtataaacctacaacatgatggttagtcttttataggacaaagcaaccctggaccaattgggaaactgtcctgatgaagataattttccctcaaacccagatttccaagagaatgtgattcccttttggtatccctagagattcaagtccttaccatggtgcatttcttaatgcccaaataaaaaaaagggaagcttgtggcatatgttgcatgttatggcaacaatgcatgtaggcatcaactgtataaaatataattattttatgtttactcattaccaagaagaaagctgtaaaaagttcctttttaacatatctggagagtataagttgggaggaaaaaaaaatagcactaggcgcaagttctgtcaccttgacatctgttcctcctgttggcatgaattcttcataaatgtaagatccatctcgcctcaccttcctaatgtctggataaaattcactagatcgattgccaacctatgcataaatattttgaagaatacatctggtgagtgaatttggggagttttgaacagatgaaagtcgactggaagaacatgatatgacaagcagattcagaaatcagaatgcacattaactcattcatttatatcaaagaagtttaacctcagcaagaaaataccaactagagcaaagatagccagttattttttaaggaggccggcctgaatatattaaccttcaaaggtaaaaaaaaaaagtaatacaaaggcggacacagcgcaagcacgtcagagaggacacaaaatagataaaacagcatgttagaacataaagcagatgatcatctgctaggttactgagttatactgtgacagtgtttattatcaagtaatttttcttagcaacaagaaagacatcacacataattgtgtgtgtaaaagaaaaatagataggattatagacactctgtgctaaacaaggaacaagcttggaagaagaaaatgaaaaggaaagcagattagaactgaagcagctccctatcgacagcgctaacaccatctactctagatgctaagtacttcctcagttaagaaatgattagtattttcttaacaagaaagagactaattacaatttttctaccaagaaatgtgtgtgaattgaaggtaacaagtgcccaccttgcggaacagttctttcattcctccaccagcggagctaggataatatatcattatgttatggtcatctcctatgtacaacagaattagtcagcagcagcaaagatttgttctaacacttctttacaatgcggcaaagttaatgtttaaaatagacaatctgacaaattaaatttgcagtaccgcacaaattggaatatgcatggatgcattgataagactgattcatgatttgcatataaaaaaatgtagaacttattgcagaacaattggcagttattaaggataggttttccacaataaatgaaagtacaaggcacagaccacaggggaacaaaatgcatactttagctaaaataaattgtctactactaaaccaataataagaatgaatgaacaattttaagtttcttacccatcagtactaatatgtaaatttgtttcataccatgccatgaagaatatctcatttatgtattttaggagcaagataagcaatgtttagtgtttgacattatttagactgccaaggcttcggcttgttgatgcttcgacagtcaacatatgtttccaaagcactcatgcattctattgaaattagatccatatcacagcaaggtcaggcccaaatatcaattgactcatgatattttgccaaatacatagtttttcctaatcctagagagtggatgcaaggtgggctctaatgagttagctttgcatggtttgttttaattatgtccattaaagatgtattatcaccacccaatcgtaccattaatttgtgttttgagttgtaccctacaatacggaatggattttgccagtttttggaaggctcgcaattttcttttgtaacctgccacttctcatagttgatactaggaagcagccttccatgagaagcttaatcaatcagacctagtgcaggttttctttttctttctttttttttgttttggcgtacatgtattccgcagatataaaatgatagttggtattctagtgggagacagaagaacaggcatgaactagtagaaggaaaaaccattaagaaaatattttttctatcaagagctgatactaacataccatcgattggtttctccacaaaaggcttgtaaaatcgctttccatggatctcaataaaatcatcttgctcaacaaagtactttaactcttggttagggtattctcttctgacaacagcataagttggaacaggaactccgaacaatttaaggtgctaaacaggcaaaagggaagtatcaacatttgcgaaaagagaataagctattatgtaaaaggttgcaaactggagtggagggttgtgtttctctataagtatagttggataaaaccatctgttgactatcttatccatcctataaattttgttgacggtaatagttgctgtgtcaggaaaacaaaacaagaatacttataggccaagcattttgttggatatacataatgatataacaaataaaacaaactatactgttcttgcagactaggaccacatcagtcacataatataaggaacagacataacatctagttttttttacagtacttatctttccatccaaaattatgcatatccttttgcaggttccataggacacatttacacagaggaacatattgtaggcatatgaacttaaaagaaatttcttttcaaactggaaatgctatatctaagaagaacatttgctcacaggagattatctcattggtatcagtttccagagagagagagagagagagagagatcagtaccaacttctgcatttattaggataaaaaggcctgtttgtattggcagtttcaaaagagaatgtaacagatattacagtagagtcttgagattaacatggtcaacaatagactgcagaagcaaaaactagatatttcaaacgaactaaacaaaggttcattaccagatattcatagatgatcttgctgccatcttttggtttatatactgttgagtactactaccttcttcaagagaagttatttcttctagtttaaaggaggttaatttgcatcccatgataactagcaagaaataacacatctttaaagaatctattacagaacaagcaactcagtcaaaacatgaaaaaaggatatctcaaatgtacgaagcatcattttttattataccgatattaatacctcatatactttgctgcgatcatggaggaggtattggggatccaactcattgaccaaaaatggcctgcataaagatatttacataatgttattgcatcaagttgatgaacttatataggtatctagctaataataaacatgtgaatttcttaggcccataatcaacactgcctgtgtatttcccaagaaaaataatatacacattaataatatgttcaaattgcagctgaccagtgttaaaaaaaggctagctcaaatgataacctatacttatgatttctaaagttctcttcattttcttcagctacagaaaaaaggcataggcaaactcatatatacatacatgaatgaaacagtgatatcaataagagcttaggtgatgctattatgaatagagttgctttagatacattaattagccatgggcacattcagtagcaactatatcaaagtaactttaaaagtggtgcaaatgttgaagccaaaaagggcaactatacagaaacaacacatgggtcatcaatgtccacaattttattgttgataattatcttagtccagctgctagtagtactagaaatgttctatatgtcagggaagcctgttgtgaaactaaagatacttgcagatccagcacaaagatgtgctctgaaaatttcatgtgtcaggaaaagcatttaacctgcgtaaagcagcatatttctctgccttttctagtggatacccagccgagtaaaaggcaatcagacagtcacatagaggccagctgtcaacaaaaaaacagaacaaagatgatttcatagtaaacacaatatatgaagaaaaataaatcactgaattaacctcattatactccatccaatcacgaaaacatatgtgcagataattagatgttttggacatgtttcaagtcaaactttaaaaagttgaacatcaatgtattactagattgaatgtatgaaaatcatatgcgtagatttgcctcaaaaagtattgttgtaatacatcaggtattcaaagattttacaatagaaattagtggtcaatactgcattttgaagaccgtgtaactgtccaaaaaggcatttttttgtgaccagaggtaatatcatgtaaagtctgatatcatcagatagaaggaaatctttagtattctaggaatattaagttgacatctgctaagaggtgcatcatcacatatggacaatggatttatttagcagcacaaaattttaaaacatatcagttatatttcctagacagatattcataatcactctatcaaggattaaatatggttatgctacagcaatcatttgtgaactgactatatttatcctaggtcttatccttcaagtaagacagcatgatccatcattcatgtctgtacatctgtacagatattttgacctgcataatttgcttttctattttgccaataacaacaaattgagaactaaagaattcaagctcatagaaggctctcccttcacagctatcaggcatacctttcaataggatcttcaagaatgattttgtcaccaaaaattataatctgcatccataaagcatgcatgtagttattaacattcagcacaatgtagttgctttactaaagagccagagatgctcatatgttgtattgatcagaagcaaaacactttactatgccaatacaccatggtggcatatacgtatcttctgcaggattcatagctacaactgactgtatttggcaactgataacagaagagagagtataattacaaggttcttcttccataacattttatagatatttatctagtttttatgactaccaaacttgaagttgtgcaggccacacatagacttttgtaggaaataatacaagaatggcgttttgcatggttgttgtttgttcctcctacatattcttgttttccgggtacccggccaaataatgaaggattgattgagccgtggaacccgggcaatatgtaatcgccacgccttaacttgtacagcagtcagaaaatagggtgctaatgggttcagttacacagtttactcctgcatatggaaacagagacacaaggatcatatgcttttttcagttgatgttgtcatagacctctagcatgtttcttcagacagttcgcgggcatcaataatcctaattgaatctctgaatgcttctcatcctacaaaaagactccatttttcctctccatttgatatcaaaatttgctcttaaggagaaacgtcaaactaattaacaaaagaaacacgggctggaatctgcctgaagaccagaatgaccttttccgaaccatacctcgaactccccgaacgcccgcagcctctcaagaatctgctccatgggggaacaccacacctgcaaccaacatgggagaaaaagaataccaaaaagtaatcaacatggccacctccgcattggagccaacccaagaacacaactgaaaaaaatggataaaaaatcacaccttcttctccatgacgcagacaccaatcttgatcttgcctccaccgtcacagccatcattccgccgctccatcccctcgctacccctttctgttctccgggaaagaagagattacaacgggaaagggagggtctgtttcttaggacatttcgcaccccccacaaggattccaagattgaagctttttatggaggagggcagggagggacgaagagggtatgtgaggagagtgcactgtgcaaggataaacttttcttcctttttccccctttatttttcaaggactacaagtctacaatgagcagctctctgcgtctctccccatgctagttattctgaatctcttcccatgctagtttatctcggatttgctcggaaagaacctccttttcattgcttttacttttgtttatgtgctcagcagtcaacatgactcttctctttttcagtttctccacttctgttcagcaagaaattaggagatacggtagttagttggcttattgctacgggcacacggcaagttttggtttacttgcaagcacgaccacacattcgaggtttctgacaatacatgatgagtctagtagcaacacaagcacaatttaggacaatttagggtgtgtttagttggggaaaaggaaatttttaagtgtcacattgaatatttgaccggatgtcggaaggggttttcggacacgaataaaaaaactaatttcagaactcgcctggaaaccgcgagacgaatcttttgagactaattaagccgtcattagcacatgtgggttactgtagcacttatagctaatcacggactaattaggcttaaaagattcgtctcgcgatttcccccataactgcgtaattagttttttatctatatttaatgctttatgtatgtgtccaaagattcgatgtgatgtttttgagaaaaaattttggggaactaaacgggccccaaaggactacgttttttggctgtcaaagtttcttagagcatcgatagtactgcaacttggcgaatgcttttggattaggtgttttttcttttctttttgtcatatggaagaaaataaatagaaaaacaaaatcgatactgcttttgagcaacgcatggtatgaactcatgtttgctttagttgtagtcaatccacaacggaatgtctagagtgatttcataattaattaaaatatgtcggtccagttttttttaatgtgcttataagatatagagatataatgtacgtgaatatgcatgtgtatattagccgtagtacgtttagaaaataaaatacaactacatgtgcatgggaatgggtgcacctagtatttcattagtttgttcggtttcattttctcagtcagatactcccaacactttgtaaggtagcaattggttcctcctatgtttttttttcttcttatgaccagttgtgatagtcaaagttttaaaactttaattgaatgtcaaagttttaaaactttaattgaattttatctacttcctccatcctagaatttaaatattttttaagtagacgcggatattaagaaactaagtagaggatgattaaaagaggattgtgattggtaaacagaaagtaggtgaagaaattactttattttggacaagttactatgctacaaatagatatattttgggacagagatagtagatattaaatatgtatgacttacggtgtacttatatgtcactatatttgcatattttcttttcaattacaatagtaataaaaaatacttcatacttcgtcacactggagtgtggtgaaggcgcccatggattacgtcgctcaggaaggaaatttaagattgaatggtctttcgaaagatgcatactgtatctcattttatatatatagtcttataaaatattattgctactttaaaaagaaaggctagatttatttaggagactgaccaagaaatgtataggcaaatttttatatgagcaagcaaatgtttcttgcaagacccagcaaaatgttccatcagcttatggaaaattttgacgttagtcagccatgtcatgcaaaaaggaaaaagaaaaaaaaatcttttaaggcatccattcattgtggccctctttttacagtgggctttgacaaataaacacatgtattttaatcacaaattttgataatttacccttttccgaaaattatttttacaaataatctgcggccaaaacttatttcaaaaatgactcttttgtcaggcgcaaatggtatggcgctaaatttaaacacatcagcgtcatgtcagctggcgttaaatgtcgtgccaccgcgnatgagaggttgagtcggcgtgccaacatgcattcagcacagtgctatttgatactgaggtgtctaaattcagcgccatacgatttggcgctgaacaaaaggatcattttttaaataagttttggccgcggttcatttgtaaaattagttttcgaaaagggtcaaattgtccaaatttgtgtacttttataattgatgttctctaaccacaggcacttaatcgcaaaatagaaaataatagaagtaggtgacaaaatgttgtactacctccgtttcaggttacaagattttctagcattacccatatttatatagatgttaatgaatctagacatacatgtgtatttaaattcattaacatatatatatatatatatatgaatatgagcaatggtagaaagttttataatatgaaacggaggaaatacattttacagaaccagatcttggacgaattcctgtcagtgacgcgcgcgcgcgcgagatcacatcccacaaaaggtgaggtacacctatcagatgtcctttgggtctgaaagtgctaatcagaaatgtttagggaatcaatcaccaaattttcagctgtcaaatatttgccccaaaaatcagtattacatctccaaatcctccctttcagatgattcagaaataaaaaaaaaaccaaaaatggaagacccaagcaggaatattttgaagaacattcagtcataccatggaatatccaggcaaatgctcccatcagaagagcaccctgagattaggcgaaattgacccgtgatctaatccaattggtgttcccgtcggcgtcgacgtcgagatcgtagcacgtagcaggaacatccaactggaatatcccaaaaaatgattttggaggctcatgcgagattatctgaccaaatctttgtgctacgcgccacataatccaagaattatgggaacctttgcttccacgttcaaactccagaaatgattgttttcggctatggacaaatacaattacgtctgatcctttatatatatatatatatatatatatatatatatatatatatatatatatatatatatatatatatataaggcaaggatagaatttttgtatttaacacaactgatagaatatttgattgtgtaagttttgatcgaactggagcactgaagaccatttgatttactggagagtcatctactgcgtgtaactagccgacacttattatagtagtgtctgctttgtgtgtctctactctctagagtctgctttcaaaaggtcagcagtttgatctttaggaagacagcatctgagaatattgttctttgaagaaccagatgcgtcactacagtattatatatattcaatccagaatatggttctacgctacgacgaatagcctccgatggtatattggtatggcatactgattactgaatttattttaaattcatctataatggagaggtcgaatgtggagtccaaataaggtaaatatagcccgggattggtaaagttatcacaaaagaaattgaccaaatcatgttgcacacttaatttttactccaatgacaacacaagaatggatctgatgttttgcttctgtactagccataaaggggaatccagcatgatactaactaatcagactctaagccagaattcaccgcaatggtaaatccactcccacaatagacgttaactgaagcagaagaacatggcctcttatcacctatattaactctctgtggagtcacttgatcacaagtatctcccaaaccaagctgtccatgctctccccaaccccaggtgaagactgttcctttatctgacaaaaagatgcaagagcaattagtttgtaccacccagggattatgtgctcattttcagcctttgagtaacttacctgttaccgaagcagaatgttcagtgccagcagctatgtgcaccacctgttctccatcaacacagggaaccttcaccagtgttgatgatgaggatgattctgcaaatcacaaagacacattttatatggtgatagggaaaaaaaatgcagcatgcagatcaaatggcaaagaaaagaatgccaacctcttattgaaaaaaaaaattgttcgacgtccgatttaccctatgctatgagtttatttcaactaatcttgtatgaactaaccagattgttattccaaaagaaattaacagaaagcacaacggttgggcaataattactaggctaacacatagaatgagtattcatctatatgtaaagatattttccagtccagctactggttcctaataaaaacttaatacaactacgtgacataatataaccaaaattgaaaagagactaccatcatgactatggcttgttgtggcgggatttagtctctgcactggctctgc

SEQ ID NO: 31397 - DNA, 1602 bp, Oryza sativa
  unsure (1)..(1602): unsure at all n locations
gatctccattggcatatatattccctatcttacagtctggaaaaccatcaattattcttggaacatcatagaacttttggttcctagtgcatctaccaatttgtccccgtcttgttgagccaaatccatagacagaattatctgcaagaacaaggactagcagtgtcatccgtttgtaacatatataacaattagtttgtcaatacatcaagtagaagaggtgtccatataattctcaggacgtccaataggaaagatatatgactgatgagctaaaacctgcaacatctcatgcatattcatcattagaacacaatgatggtgcagcatccctctgaaaagaatgctaaaggatggctcaaaggtacaccttcatagattccacatcatcagagaaagcagtggccttaaaattctcagatgactgataggaaatattatatggttgtggattgatgaccctcccacgtctcccgaatcactagtgcagaagggatggttctgcatccacatgaatgctttgtatgccatattgccatagttggaaaaaaatcaaagaatgctcactcagcccttcttcaaggaatcaacaaccctaagttgccggtatgtttggcttcaaagaagtgtataactgtgtataggtcatcttgttcttgattttcgctttcaataaaaattatcagtatggtcttgccctgctatagcgatgcctatcctcaattgaaaagaaaaaatattgattaattgtttctttcaaaggctgtttaactttagaaaatgcattacggaatatgattgggtcatttaaaagttgggtattgcccagacaatggaagatttctgagcaagtggtttcagaagaggtaacagagtaaatctgggtaggttcatgtactatgcaatttcttaaaaattaagctaacatcgcaacacatgatgttgcatacctttcaaaaggacaagagaatgacgcatcccaagtgcaagcctcacaacatgctttgtggtaaagtatgccacttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaactttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
